United States Patent 11,098,302 (IDENTIFICATION OF POLYNUCLEOTIDES ASSOCIATED WITH A SAMPLE) - sequence listing, part 56

SEQ ID NO: 191492 - DNA, 566 bp, Homo sapiens
  misc_feature: GYAE6OF02JE95Z.47.70.G04.1.454.CMB.1.raw
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggcaagtcagagcattaacagcgatttaaatggtatcaccagaaaccagggaaacgcccctaacctcctagacttctaatgctgcactcctagtttgctagtaggtcgggtccatcgtaggttcagtgcagtgatcgtgggacagtactttcnctctcacatcagctagtcngcaacctgaatntgttcgactaacttattacgtacttaaanaaaacttataactacgtccgccccgtacttaccgtacgtttaccgggccgggtaacgggtaaccgtaaggggtcggaaagtacgttaaccgaaacggtacgtcggtacggtcctacggcctaacccgtaacg

SEQ ID NO: 191493 - DNA, 692 bp, Homo sapiens
  misc_feature: GYAE6OF02F0I09.47.70.G04.1.454.CMB.1.raw
  modified_base (201)..(201): a, c, t, g, unknown or other
  misc_feature (201)..(201): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtcctccactccctccctgtctgcatcgtgtagganacagagtccaccatcctacgttcggaccgggctaaaggtcaaggagactaactttaaacgagacgtaatttaaacgttggtaactcaaccaacgaaaccaaggggaaacgccccctaacctacctagactactatcgctgcactccgtagtttacgactagttaggtcggggtccctacgtcgttacggttcgaggtcggactaggtaggtacgtacggtacgggaacgtagttacttttacgacttcctaccgtaacctctacacgtactacgtctacgaacctacccgtagtaaaccgtttattttaccgacttaaaccgttaccttacgttacgtaacaaacggtacggttaaccggtttacccggtaaccccgttagtttaccgtttacggacccggtaacgggtaacctaacgtacggtaacctaactaacggtaaaccggtactgggtacgtaccgtacacctaccgtacgttcctacgttaccc

SEQ ID NO: 191494 - DNA, 550 bp, Homo sapiens
  misc_feature: GYAE6OF02IEW1T.47.70.G04.1.454.CMB.1.raw
  modified_base (221)..(221): a, c, t, g, unknown or other
  misc_feature (221)..(221): n is a, c, g, or t
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagacgcaattaacagcgtaattttaaattggtaatacaccaagaaaccgaagggaaacacccctaaacctcctagactactatgctagcactcctagtttgctagtggtcgggtccagtcgtagttcagtggcaggtgatgtggacagtatttcactctcacatcagnagtctcgactaactgaagttnttttacgactaacttactacttgacaacgtagtacgttaccgtacccgtattacgtttacggaccgaacgggtaaccaacgtgacaactacgaaacgtacgtaggtacggctacgacctacctactccgtattcc

SEQ ID NO: 191495 - DNA, 717 bp, Homo sapiens
  misc_feature: GYAE6OF02IIS0O.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatgacccagtctaccatccctccctgtctgcatctgtaggagacagacgtcaccatcaacgttgaccgggacaagtcagagacaattaaacagtacgtaattttaaagttggtaataccaaccaagaaaaccgaacgggaaaccgtacccccttaaacctccgtaggtacttacttaatcgtactcgtctaacttaccgttaagttttcgactagttacgggttcgggtaccctagttacgttaggtttaccaggtcggacgtaaggttagggacttaccggtaggggacctaggttaacttttaccgaaccttcctacccgaacctacttacgaacgtcgtaaacgtcctacgaccgtaaaccgttagtaaacgtttattttaacgacccttaaactttaacctaccgttacgtaacgtaaaccctagggttaaccggtttaaccccggttaacccgtttaccttaacgtttccgggaaccgaacgggtacctaacgtcggtaaccaagttaacccaaacggtaacgtcgtagcctacgaccaccctatccttagttaccc

SEQ ID NO: 191496 - DNA, 754 bp, Homo sapiens
  misc_feature: GYAE6OF02JG057.47.70.G04.1.454.CMB.1.raw
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcacatcacttgccggacaagtcagagcgttgacaaatgctttggaccttggtttcagtcagacacagggaacgccctaagcncctgatctatggtnacatacacgtttgacgtaaaaggtcggggtacccaagtaccgtaaacggttcaacggtcgggactaagggttaacgggttccgtacgggggacctaaacggtacgtttaccgtaacgttaccgtaccgtaaacgttacgtaccgaaacggtcccgggtaccttacgggtaaccgtaacgggtccccgttaaggtaaacggttaacgtttcccgtaacggtaaccttaaaaccgtttaaccgtttaaccgttaccgggtttacccttaacccgttaaacggtttaacttacggttaccgttaacggttacccgtttaaccccggttaccggttaacccggttttacccgggaacccggtaaacggggtaacccgtaaagggtaaccggttaaaacgtacccgtaaaaccgttacggttacggtacggtaccgtacgtaacccgaccgttaaccgg

SEQ ID NO: 191497 - DNA, 549 bp, Homo sapiens
  misc_feature: GYAE6OF02IWFSV.47.70.G04.1.454.CMB.1.raw
  modified_base (281)..(281): a, c, t, g, unknown or other
  misc_feature (281)..(281): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (543)..(543): a, c, t, g, unknown or other
  misc_feature (543)..(543): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttcggcccgggcaagtcagagcattaacagcgtatttaaattggtatcaaccagaaaccagggaaacncccctaacctcctgactctatcgctgcatccagtttncatggtcgggccatctagttcagtgnagtgatcgnggacagtactttcacttctcaccatcagtcagtctcgacctaaccgtgtaacgttattttcgacttaacttactactgacaacgtagtacgttaaccgtaccgtacttacgttcggaccgtaacgggacctaacgtcggaactacgtaaccgaaacgtacgtggtacggtacgtacgccaactcttcgtnttaccc

SEQ ID NO: 191498 - DNA, 523 bp, Homo sapiens
  misc_feature: GYAE6OF02JCAIW.47.70.G04.1.454.CMB.1.raw
  modified_base (396)..(396): a, c, t, g, unknown or other
  misc_feature (396)..(396): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccaagaaacagggaaaacgcccctaaacctcctagatctaatgctgcatccagtttgcatagtgggtccatctagttcagtggcagtgatctggacagatttcactctcaacatcagcagtctagcaacctgaaagtntttgactaactttactactgtacaacagtacgttaaccggtacccctattacgtttggaccgtaggggaaccaacgtggacaattaccaaacgtaactgtacgactcgaccactacttcgtgttacc

SEQ ID NO: 191499 - DNA, 607 bp, Homo sapiens
  misc_feature: GYAE6OF02JY6A1.47.70.G04.1.454.CMB.1.raw
  modified_base (543)..(543): a, c, t, g, unknown or other
  misc_feature (543)..(543): n is a, c, g, or t
  modified_base (601)..(601): a, c, t, g, unknown or other
  misc_feature (601)..(601): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatactacttcggccgggacaagtcagagactaattaacagcgtaatttaaagtgtatacacaagaaaccgaagggaacacccctaactcctagtactctatcgctgactactaccgtagttgactagtacggtcggtacccattacgtaggtacagtggagtaggtagatcgaggactagtacttcgactctacacatcacgtctaagttcacgacctaacgtgaaacgtttacgttacaacttaacgttaactacgtacgtaacctaagtaccgttaacggtttaaccccggttaccttaacgttacggtttcgaaccgaagggaaccttaacgnggtactaagtaaccgaaacgtacgtaggtacgacgtaccgacctaacgagtttccgtnttaccg

SEQ ID NO: 191500 - DNA, 582 bp, Homo sapiens
  misc_feature: GYAE6OF02FYEBC.47.70.G04.1.454.CMB.1.raw
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
tcagagctcacgtacacgaccggtgctcgatttagtgtagtgtgaaggggaaagggggggagtcagtctcagtcaggacacagcatggacatgagggtccccgctcagctcctggggctcctgctactctggctccgaggtgccagatgtgacatccagatgaccccagtctccatcctccctgtctgcatctgtaggagacagagtcaccatcacttgccgggcaagtcagagcattaacagcgatttaaattggtatcaccaagaaaccagggaacnccccctaacctcctagatactatgctgcactcctaagtttgactagtacggtcggggtacccagttcgtaggttccaggtggcgagtggactcgtgggacagtacttcactctacactancagcgcctgctacgcctagaacgtattcngtactaactttattacctcgtacctaccgtaagttagtagtactcgtaccctttacccgtccggtaccgtttacccggaccgaacggggtaacctaagggtacggtaaactaccgaaacggtacgttcggacggtcctacggtacctacctacg

SEQ ID NO: 191501 - DNA, 696 bp, Homo sapiens
  misc_feature: GYAE6OF02FOO5K.47.70.G04.1.454.CMB.1.raw
  modified_base (223)..(223): a, c, t, g, unknown or other
  misc_feature (223)..(223): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgctatctgtaggagacagatcaccatcacttggccgggtnaagtcagagctaattaacagtacgtaattttaaagttggtaattccaacaacggaaaaccgaaggggaaaacctacccccttaaccgttcccgtagtaacttcttaagtcgcttacgactactccgtagtttcgactagtacggtcgggtaccctattcgtagttcgaggtcggactagggtgtaactcggttacggggaactaggtaacctttacgactttcctaccgaacctagtaccgtagacgtacggtactacggaaccctaacgtaggtaaacgttcgttttaccgaaccttaactttaacctcgttaacgtaaccgtaacgtaaccggtttacgttaaccccgggtaacccgtttacttaccggttttaccggaccggtaacgggtaaacctacggtcgtaacctaacgtaaccgtaaacgtacgttaggtacgcgttacaccgtacctaagttccgtcttacccg

SEQ ID NO: 191502 - DNA, 763 bp, Homo sapiens
  misc_feature: GYAE6OF02ILLJE.47.70.G04.1.454.CMB.1.raw
tcagagctcacgtacacgaccggtgctcgatttagtgtagtgtgaagggaaagggggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttggccgggacaagtcagacgcaattaacagacgtaatttaaagttggtaatccaacaagaaaccgaagggaaaccgcccccttaacctcctagacttacgtatcgtctgacctagtcctagtttgactaagtaggtcgggtaccctagttcgttagggtttcaagggtggacgaggtggtacgtccggtaggggaactacgttaacgttttcctaaccttacctacctaaccctaactaccgaacgaccgtaacgtacctacgtaccgtaaacccgttaaggtaaacgtttacgttttacgtaaccttaaacctttaaaccgtaaccgttacgttaacctaaacggtaacggttaaccggtttaacccggttaaccccgttaaccgtttaacccgggtttttaccgggaacccggtaaaaccggggttaacccgtaaacggttaccggtaaccgtaaaccgttaaccgaaaaacggttaccgttaacgggttccggtaccggttacgtaacccgtaaccgttaccgtttacgttaccgttttacccg

SEQ ID NO: 191503 - DNA, 543 bp, Homo sapiens
  misc_feature: GYAE6OF02GLDYV.47.70.G04.1.454.CMB.1.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
tcagagctcacgtacacgaccggtgctcgatttagtgtagtgtgaagggaaagggggagtcagtctcagtcaggacacagcatggacatgagggtccccgctcagctcctgggctcctgctactctggctcgaggtgccagatgtgacatccagatgacccagtctccatcctccctgtctgcatctgtaggagacagagtcaccatcacttggccggnaagtcagagcattaacagcgatttaaattggtatcacagaaaccaggaacgcccctaacctctgatctatgctgcactcagtttcgcagtagtggggtccatctaggtcagtgacngtgngtctgggacngtatttcgactctctacatcagcagtcgtacgcaacctagtaagtacgtttacgactaaacctttctaaccttgtaccaactacgtacgttaccggtaccccgttactacgtttttacgcccgtaagggacccaacgtacggacaagtacctaacgaaccgttgtcgtacgtagaccaccacgttctagttccc

SEQ ID NO: 191504 - DNA, 831 bp, Homo sapiens
  misc_feature: GYAE6OF02G3BEB.47.70.G04.1.454.CMB.1.raw
  modified_base (204)..(204): a, c, t, g, unknown or other
  misc_feature (204)..(204): n is a, c, g, or t
  modified_base (444)..(444): a, c, t, g, unknown or other
  misc_feature (444)..(444): n is a, c, g, or t
tcagagctcacgtacacgaccggtgctcgatttagtgtagtgtgaagggaaagggggaggtcgagtctcagtcaggacacagcatggacatgagggtccccgctcagctcctggggctcctgctactctggctcgaggtgccagatgtgacagtccagatcgacccagtcctccactcctccctgtctgctatctggtaggaanacaggagtcaccatccgtacttcgggacccgggtataacggtcaaggacgtacctaaagttaaaccgagaccgtttaaagttttaaaagttggtttaacaccaaccgaaaaggtaaaccgaacggggaaacctaccccctaaccgttactcggtaaacttctaagtcgcctacggtccaattccgtaacgtttggaccttaaggtacggttccgggtaccctacttacgtacgggttttnaagggttcgggtaacaagggtttcgggaatttccgggggtagggaaacctcggttaaatttttcccgaaccttaccgtaccgtaacccttaacgtcctaacggtacttacggtacgtaaccggtaacctaaacccggtttaagttaaacgtttacgttttactaaccttaaacgttttaccctagttaaccgtaaaccgttaaacgtaaaccggtttacggttaaaccccggtttaaaccccggttatttaaacccggttttaccgggtaaccggtaacggggtaaaccccgttaaacggcggttaaaccgtaaaccgttaaccgtaaaaacggtacgttacggtccggaacttaccggaacgttaccctcttacggttaccttcgg

SEQ ID NO: 191505 - DNA, 663 bp, Homo sapiens
  misc_feature: GYAE6OF02HCFL6.47.70.G04.1.454.CMB.1.raw
  modified_base (101)..(101): a, c, t, g, unknown or other
  misc_feature (101)..(101): n is a, c, g, or t
  modified_base (198)..(198): a, c, t, g, unknown or other
  misc_feature (198)..(198): n is a, c, g, or t
  modified_base (654)..(654): a, c, t, g, unknown or other
  misc_feature (654)..(654): n is a, c, g, or t
tcagagctcacgtacacgaccggtgctcgatttagtgtagtgtgaagggaaagggggagtcagtctcagtcaggacacagcatggacatgagggtccccgntcagctcctggggctcctgctactctggctccgaggtgccagatgtgacatccagatgacccagtcctccatccctccctgtctgcatctgtagganacagagtcaccatcacttgccggcaagtcagagctaattaacagtcgtaatttaaattggtaactcaaccacgaaaaccagggaaacgtccccctaaacctccgtacgaactctaatcgctacgtcctatacctagttttcggactagtacgttcggggtaccctagtcttagggtttcaggttcggcgtagtggtactgtagggacagtactttccgactccgtaccactaactcgtaagcctagtacctagacctaaccgtgtaaagtttactttagacctttaaaccttaccgtattacgtaccaaacgtacgttaacggttaacccggttaaccgttccttaaacggttttccggaaccgtaaccggggttaaaccaacgttaccggaacgtaacctaaccgtaaaccggtaacgttcgtaacggcttacggtaccaccggttaacttccgngtttaaccc

SEQ ID NO: 191506 - DNA, 553 bp, Homo sapiens
  misc_feature: GYAE6OF02JIY80.47.70.G04.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
  modified_base (432)..(432): a, c, t, g, unknown or other
  misc_feature (432)..(432): n is a, c, g, or t
  modified_base (545)..(545): a, c, t, g, unknown or other
  misc_feature (545)..(545): n is a, c, g, or t
tcagagctcacgtacacgaccggtgctcgatttagtgtagtgtgaagggaaaggggggagtcagtctcagtcaggacacagcatggacatgatggtccccgctcagctcctggggctcctgctactctggctccgaggtgccagatgtgacatccagatgacccagtctccatcctccctgtctgcatctgagganacagagtcacatcacttgccggnaagtcagagcaattaacagcgaattttaaatggtatcaccaagaaaccaggaaacncccctaactccngatctangctgcatcctagttgcaatggtcggtcccatctaggtcagtgcagtgatgtggacagtacttcacgtcaccaacctatacacgntacggtctacgacctaacgtgtaaagttactttcgaacttaaccttactaagtnttacaacgtagtacgttaacccggtacccgtattaccgtttacgaccgaacgggtacctaaacggcgtaactacgaaccgtaaacgtaacgtgtacgcgtacgaccaaccgtntacttacg

SEQ ID NO: 191507 - DNA, 592 bp, Homo sapiens
  misc_feature: GYAE6OF02I6RC3.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggacaagtcgagggcttgacaatgtctttggcctggttcagcagacacgagggaacgaccctaagcgcctgatctagtggtgctatactactttagacgtaaaggtcgggtacccagtacgtaaggttcgacggcggacgtaaggtaggtcgtagggaacaggtacgttaccactctacacctatcagcacgtcctgcacgtcctaggtaagttatttacgacttaacttatactagtacaacgagtacgttaccgtacccgttagtacgtttcggaccgtaacgggacctaacgtcggtaactaacgtaaccgtaaaacggtacgttacggttacggacgttcgaacctaaccgtacttacgtcgtttacc

SEQ ID NO: 191508 - DNA, 538 bp, Homo sapiens
  misc_feature: GYAE6OF02FJXJ5.47.70.G04.1.454.CMB.1.raw
  modified_base (392)..(392): a, c, t, g, unknown or other
  misc_feature (392)..(392): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaaccagaaaccagggaaacgccccctaacctcctgatctatgctgcatccagtttcgctatggtcgggtcccagtctaggttcaggtggcagtggatcgtagggacagtactttcactctcacctatcagcagtcngaccaactagaagtattttgacctaacttactacttgtacaactagtacgttaccggtacccttacttactttcggaccgtacgggacctaacgtcggactaataccaaacgtacgtgtaggctacgcctacctatccgtgttacc

SEQ ID NO: 191509 - DNA, 836 bp, Homo sapiens
  misc_feature: GYAE6OF02GQ5MD.47.70.G04.1.454.CMB.1.raw
tcagagctcacgtacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttccttgttgctattttagaaggtgtccagtgtgaggtgcaattggtgcaatcgtgggggagcttggtccagccgtggggggtccctcgagactctcctgtcgcagcctctggattcctacctttagttccttcttggtattgtaagttcggggtcccgaccagaccgtccgaaggggaacggggcgtgggacggttggggttcggacaaacgtaagtaaaactcccgaagtagtagggaaacgttacgaaaacggtaaaaaccttagttacggttaacgggtaccttccgttacggtaacgggtaaaccggggtacccgttaaacgtttacccgaacccgtaactttacccgtacccgtaaaggaaaccggtaaacccaaacccggtacccaaaacggtaaaccctttccgttaccgtttaccggttttaccgttacggtaaacctaaaacggttcgggaaaccaacgggtcccgtagggtaaccgtaacggtaaccggaaacggtaaccgtaccgggtacgttacgggttacgttaacgtttaaccgttggttacggtttcgttaccgtcgttaccggtacccgggtccccgttcccggggtaccccgggttaccgtttcgggtacccgtttaccggggttaccgggggttaccccgttacccggggttaacccccgg

SEQ ID NO: 191510 - DNA, 541 bp, Homo sapiens
  misc_feature: GYAE6OF02HG9GK.47.70.G04.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (380)..(381): a, c, t, g, unknown or other
  misc_feature (380)..(381): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttgccgggcaagtcagancattaanagcgattaaatggtatcacagaaaccaggaacgaccctaacctccngactctaatcgactcgacngtaccaagtttgactactaggtcgggtaccagtctagtcagtcggatagnggatcgagganagtatttcactcncacnncagcagtcngacacnggaatatttgactaacttactactgtacaacgtagtaacgttaccgtaccctacttacctttacggaccgtagggacctaaccgaggtaacacgaactaaacgtaacctaggtcgtactacgtaccaccctagttcctagttccc

SEQ ID NO: 191511 - DNA, 677 bp, Homo sapiens
  misc_feature: GYAE6OF02F8R9R.47.70.G04.1.454.CMB.1.raw
  modified_base (234)..(234): a, c, t, g, unknown or other
  misc_feature (234)..(234): n is a, c, g, or t
tcagagctcacgtacacgaccggtgctcgatttagtgtagtgtgaagggaaaggggggagtcagtctcagtcaggacacagcatggacatgagggtccccgctcagctcctgggctcctgctactctggctccgaggtgccagatgtgacatccagatgacccagtctccatcctccctgtctgcatcgtgtaggagacagacgtcaccatctacttcggccggcaagtcaganacataacacgacgtatttaattggtactacaaccaagaaaccgaacggaacgacccctaacctccacgtatctatcgctgactactcctagttagcgtagtcggttacggggtccctagttcgttaggttcgtacggtacggacgtaggtacggtacgtacgtacgggtacgtacgttacttttaccaccttctaacctaccctaacgtacgacgtctacggttctacgaccgtaacgttaggtaattagttttacacttaaaccttacttacgtacgtaacctaacgtacggttaaccggttacccggttaacccggttaccttacggtttaccggaaccggtaaccgggtaaccttaacgtacggtaacctacgtaaaccgaaaccgtaaccggtaggttacgacgtaccgtaccgtaccctagttacccgtcgttacccg

SEQ ID NO: 191512 - DNA, 667 bp, Homo sapiens
  misc_feature: GYAE6OF02FX98Y.47.70.G04.1.454.CMB.1.raw
  modified_base (241)..(241): a, c, t, g, unknown or other
  misc_feature (241)..(241): n is a, c, g, or t
  modified_base (279)..(279): a, c, t, g, unknown or other
  misc_feature (279)..(279): n is a, c, g, or t
  modified_base (650)..(650): a, c, t, g, unknown or other
  misc_feature (650)..(650): n is a, c, g, or t
tcagagctcacgtacacgaccggtgctcgatttagtgtagtgtgaagggaaagggggagtcagtctcagtcaggacacagcatggacatgagggtccccgctcagctccgtgggctcctgctactctggctccgaggtgccagatgtgacatccagatcgacccagtctccatccctccctgtctgcatctgtaggagacagagtccaccatcacttgccggcaagtcagagcaattaacngctaatttaagtggtatcaccaagaaaccagggaaccncccctaactcctagactctatcgtctgcacttccgtagtttcgctaagttcgggtacgggtccctagttccgtagttcgaggtcggctaggtggacttcggtacgggtaacaggttacttttaccaccgtaccttaccaacctacgtcacgtacgtacgttccgtacgacctaaaccgttaggttaaattcgttttacgaaccttaactttaccgtacttacgtaacctaaacgtacggttaaccgtttaacccggtaccccgtttaactttaccggtttacgacccgggtaacgggtaaccctaacggtcggtaaacctaacgtaaaccggtaaaccgtaaggttccgtacggacgtcgaaccgtaaccncgttacttcgttacccg

SEQ ID NO: 191513 - DNA, 716 bp, Homo sapiens
  misc_feature: GYAE6OF02HASQ1.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctcgaggtgccagatgtgacatccagatcgacccagtctccatcctccctgtctgcatctgtaggagacagacgtcaccatcacttcggccgggcgagtcgagggtcgttagacaaagttcgtcgtttaggtccgttggtttcagtcacgtaccgaaccgaggggaaccggtaccccgtaaggccgaccgttagacgttctagtacggtgactaactactactttgaccggtaaagggtcgggtaccctaattcgaaacggttcgaggtccgggacgtaaggttacggtacgtagggaactacggtacgttccaaccgttcactactacgtaccgacgtaccggctaggcctacgacccgttagaacggttacttcgtacgacgttaaactttagttaccgtcgttacccgtaccgtagttacgtacgtaacgtttcccgttaaccgtttaccccggttaccgttaccgttacccgggtaccggtaaacgggtaccgtaaacgggttaaaccgaaacggttaaacccggtaacggtacgttacgggtaccggtaccgttacccggacttacccgtagtttacccgg

SEQ ID NO: 191514 - DNA, 719 bp, Homo sapiens
  misc_feature: GYAE6OF02GSDPP.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttcggccgggacaagtcaagagctaattaacagacgtaatttaaagttggtaactcaaccaagaaaaccgaagggaaacacccctaacctcctagtactactagtcgctgactactcctagtttcgactagtacggtcgggtccctagttacgttaggttcgaggtcggacgtaggtacggtagttcggtacgggtaactaagtacttttacctacctacctacccgaacctacgtacacgtacgtacgttaccgtacgaacctaaaccgtaggttaaacgtttacgtttacgtaaccttaaactttacttaacgtacgtaaccgtaaacgtaacggttaaccgtttaacccggttaaccccgttaacgttaccggttttaccggaaccggttaaccgggtaacccgtaacgtacgtaaccgtaacgtaaacccgtaaaaccggtaacgttacggtaacggtaccgtaccgtaaccgtaaccgtacgtttaccgttcgttaaccc

SEQ ID NO: 191515 - DNA, 698 bp, Homo sapiens
  misc_feature: GYAE6OF02HH243.47.70.G04.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatccctccctgtctgcatctggtagganacagatcaccatcacttgccggcaagtcagagactattaacagcgtattaaatggtatcacagaacaggaacacccctaactctagatctatgctnacgatcctagtttagcgtactaggtcggggtcctacgttcgtacgggttcaggttcggacgtaggtgggtaattccggtacgggtactacggtacgtttttcaaccgttacctccctaaaccacttacgacgtaccgagttaccgtgtaccctaaccgtagttaaacgttctttttaacggaaccttaaaccgttttaaactacgttacgttaaccgaaacgttacggtaaccggttttaaccggtaaccccgtttacctttaacgggtttcccggtaaccggtaaccggggttaaacccaaacgggttcggtaacccgtaacgttaaccgtaaaaccggtaaccggttaggtccggttaccgtacgtacccgaacccgttacttcccgttagttttaacccg

SEQ ID NO: 191516 - DNA, 726 bp, Homo sapiens
  misc_feature: GYAE6OF02GRYCI.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacacagtcaccatcacttgccgggcagtcaggacattagctaattattagcctggtatcagcagaaaccgaggaagttcctaagctcctgatctatgctgcactcctagtttgaccgtatacggtcgggtaccctagttcgttaggttactaaggtcggtacgaggttacggattcggtcgggactagtacttttcgaaccttccttaccgaacctacgtacgacgtccgtaacggttccgtacggtaccctaaaccgttaggtaaacgttacgtttttaccgaacctttaaaccgttttaaccgtaaccgtttaacgtacccgtaaaaccgttaaacgggttaacccggttttaacccgggttaacccccgttaaacgtttaacccggtttttaccgggaacccggttaaccgggggtaaacccctaaaccgggttaccgggaaacccttaacgtaaacccggtaaaaccgttaaccggttacggttaccggtaccgttaacggacccgttaaccctacgtttaacccg

SEQ ID NO: 191517 - DNA, 709 bp, Homo sapiens
  misc_feature: GYAE6OF02H5PQU.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggatccgaggtgccagatgtgacatccagatgacccagtctccatccctcctgtctgcatctgtaggagacagagtccaccatcacttggccgggacaagtcagacgactaattaacagtcgtaaattttaaaagttggtaactaccaacccgaaagaaacccgaaggggaaaccgtaccccctaaactcccgtagaacttcctaagcgtctgacctacttccgtaagtttcacgtagtacgggtcgggtcctagtcgttaggtctaggtggcgtaggtagtctcgagggtactagtacgtttaccaacttccacgtacctagtaccgacgtactaaggttctacgaccttaacgtaggtaacgtttaattttacgaaccttaaactttacccgtacgttacgtaacctaaagttaacggttaaccggtttaaccccggttaaccccgttaaacgtttccggttttaacgggaacccgtaacggggtaaccctaacggttacggaacctaacggttaaacctaaaccggtaacgttcggtaccgttcgtacgaaccttaccgtacttccgttacgttaccc

SEQ ID NO: 191518 - DNA, 776 bp, Homo sapiens
  misc_feature: GYAE6OF02H4P80.47.70.G04.1.454.CMB.1.raw
  modified_base (318)..(318): a, c, t, g, unknown or other
  misc_feature (318)..(318): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatcgacccagtctcccactccctcccctgtctgcctatctggtaggagacaggagtcaacctatcacttcggaccgggacaagtcagagactaattacagacgtaatttaaatgtatcacaagaaaccgaggaaaccgccccttaacctcctagtactctancgctcgacacttccgtagtttcgactagttacggtcgggtacctaacgttaccgttaggttacacggttcgggtagtacgggtaggtacgttcggttaacggggaactaggttacttttaccgaacctttcccgtacctaacctaaccgttacgacggttaacctacgtcccgttaacgtacctaaaaccgttacggaaacgtttttacgttttaacgaaccctttaaacgtttacccgtaaacttcggttaaaccaaaaccgttacgggttaaaccgtttaaccccgggtaaccccgtttaaaccgtttaccggtttaccggggaacccgtaacgggggtaaaccttaacccggtacggtaaccgtaacgttaaaccgtaaaccggtaaccggtttacggtaaccggtacggttaccgaacccgttaaccgtacgtttcccggttagtttacccccg

SEQ ID NO: 191519 - DNA, 832 bp, Homo sapiens
  misc_feature: GYAE6OF02HYG9C.47.70.G04.1.454.CMB.1.raw
  modified_base (149)..(149): a, c, t, g, unknown or other
  misc_feature (149)..(149): n is a, c, g, or t
  modified_base (285)..(285): a, c, t, g, unknown or other
  misc_feature (285)..(285): n is a, c, g, or t
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
tcagagctcacgtacacgaccggtgctcgatttagtgtagtgtgaagggaaagggggaggtcgagtctcagtcaggacacagcatggacatgagggtccccgctcagctccgtgggctcctgctactctggctccgaggtgccagatgngacatccagatcgaccctagtctccactccctcctgtcctgaccatctggtaaggacactaggatcaaccatcgaacttcgggccgggacaaaggtcaagagtcctaattaacaagcgtaaatttaaattggtaancaaccaagaaaaccgacggggaaaactaacccctaaacctcctagtaactacgtaatcgtctnacctactacgtaagtttcgactaagnggtcgggtccaatcgtaaggtctagtcgagtagtgggtntaccgtaggggacaaacgggttcttttaccgaccgttacctacctaaccctaacgttaacctagacccgttaaagtccgttaaacgacccgtttaaaacccggaaggttaaaaccggttttaatttttaccgaaaccttaaaaaccgttttacgtaaaccttttaaccgaaaccggtttaaaaaccagggtttaaaacccgggtttaaaccccgggttaaaccccgtttaacttttaacccgggttttaacgggaaaccccggggttaaaccggggggaaaccctaaaaaccggttaggggtaaacccctaaagttttaaacccgggaaaaacccggtaagtttaaaccggggtttccgaaccggtaacccggtaacccttaaacccggttacttaaccggtttccggttttaaacccg

SEQ ID NO: 191520 - DNA, 625 bp, Homo sapiens
  misc_feature: GYAE6OF02HPCVE.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccactcctccctgtctgcatctggtaggagacagagtcaccatcacttggccggacaagtcagagctaattaacagcgtaatttaaatggtatcacaagaaaccagggaaacacccctaactcctagactctatcgctgctactccagttttcgactagtaggttcgggtccagttcgtaggttcaggtgctaggtgtatcgtgggaactagtatttcgactctaccacctatcagtcgtagtcacgacctaacctggtaacgttatttcgaacttaacctttactaccttacgtactaaacgtaacgttacgggttaacccggttaaccccgttaacttaccggttttacggacccggttaacggggaacctaacggtacgtaacgtaaccttaaccgaaacgtacggttaggtacggtacctacggaccctaaccgtacttcgttactttcccg

SEQ ID NO: 191521 - DNA, 610 bp, Homo sapiens
  misc_feature: GYAE6OF02GJ2DD.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttgccgggcaagtcagagcattaacagcgtaatttaaattggtaatccaaccaagaaaccagggaaaccgcccctaacctcctgactctatgctgcatcctagtttgcagtagtcgggtcccatctaggttcaggtcggcagtggatcgtgggacagtatttccactctacacatcagctagtctagccaaacgtggaaacttagttttagtaaactttagtttatttacgtacctaaacgtaacggggttaacctcggtttaccccgtcttaacccgtacccgttcgggacggtaaccggggaaccgtaaggggtgtaacggtaagttaaggaaaaccggttaacgtgggttacgaccgttacgtacccacccgttaattacccgttcgttaacc

SEQ ID NO: 191522 - DNA, 608 bp, Homo sapiens
  misc_feature: GYAE6OF02GG1A9.47.70.G04.1.454.CMB.1.raw
  modified_base (223)..(223): a, c, t, g, unknown or other
  misc_feature (223)..(223): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttggccgggnaagtcagagacaattaacgagtacgtaattttaaaagttggtaactccaaccgaagaaaaccgaagggaaacctccccctaacctcctagacttctatcgctgctactcctagtttcgactagttacggtcgggtaccctagttcgtaggttcaggtcggactaggtgactcgtagggactagtactttcactctacactatcagctacgtctacgactaacgtagtaagttactttacacttaacttactactacgtaacaacgtacgtaacgttacccgttacccgttacgttaccgtttacggaccgtaacggtaacctaagtacggaactaacgtaaccgaaacgtacgtcgtacgacgtcgaccactacttcgtcttacc

SEQ ID NO: 191523 - DNA, 652 bp, Homo sapiens
  misc_feature: GYAE6OF02JG6RY.47.70.G04.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagagctcacgtacacgaccggtgctcgatttagtgtagtgtgaagggaaagggggagtcagtctcagtcaggacacagcatggacatgagggtccccgctcagctccgtggggctcctgctactctggctccgaggtgccagatgtgacatccagatgacccagtcctccatccctcctgtctgctatctggtagganacagagtccaccatcacttcggccggcaagtcaganctaattaacagacgtaatttaattggtataccaaccaagaaacccgtaagggaacctaccccgttaacctcctagacttacgtatcgctagactacttctagtttcgactagtcggtacgggtacccagttacgtaggttcaggtcggactaggtggtaatcgtaagggactaggttacttcaaccgttctaacgacctatacgatacgagttcctagacctaaccgttgtaactttacgttttacgaccttaaacgtttactaccgttagtaacccgtaaacgtacgtttaacccggtacccgtttaaccccgttacgtttacccggtttacggacccggtaagggtaaccctagtacggaactagtaaccgaacgtaacgttgtcggtactacggacctatacgttctgtaacc

SEQ ID NO: 191524 - DNA, 643 bp, Homo sapiens
  misc_feature: GYAE6OF02FVHNC.47.70.G04.1.454.CMB.1.raw
  modified_base (239)..(239): a, c, t, g, unknown or other
  misc_feature (239)..(239): n is a, c, g, or t
tcagagctcacgtacacgaccggtgctcgatttagtgtagtgtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggacaagtcagagcattaacngacgtatttaagtggtactcacagaaaccgaggaacgcccctaactctagatactatgctgcatctagtttgctagtaggtcgggtacctatacgttaggtctagtggactaggtacgacttacggtaggtactaacgtactttacctacgtcctacgaaccctactacgacgaccgtagtcctacgtacccgaaccgttagaacgtttagtttacgaaccttaactttaacctacgtacgtaaccaaacggtacgtaaccgtttaacccgtacccgttaaccttacgtttaccggaccggtaacggggaaccctacggacgtaaccgtaacgtaaccgtaaaacccggtacgtagggttaccggtctaccgggtaccctaaccacgttccttaccggttaacc

SEQ ID NO: 191525 - DNA, 740 bp, Homo sapiens
  misc_feature: GYAE6OF02IB4NJ.47.70.G04.1.454.CMB.1.raw
  modified_base (204)..(204): a, c, t, g, unknown or other
  misc_feature (204)..(204): n is a, c, g, or t
tcagagctcacgtacacgaccggtgctcgatttagtgtagtgtgaaggggaaagggggagtcagtctcagtcaggacacagcatggacatgagggtccccgctcagctcctggggctcctgctactctggctccgaggtgccagatgtgacatccagatcgacccagtcctaccactccctccctgtctgcatcgtagtagganacagacgtccaccatctacgttcggaccgggacaagtcagacgactaacttaacgagtacgttaaattttaaagttaggttaactaccgaaccaaacggaaaaccgaacgggaaacccgtacccccttaacctacctagtacttactagtcgactcgactacttaccgttagttcgactacggttacggttaccgggttaccctaagttccgttagggttactacggggttggacgtaggtacggtacgtacggtacgggtactacgttactttccctacgttacctacctaacctagtacgacgtacgtagttccacgtaaccgtaacgtagttaacgtttactttacgacctttaaacttctaacgttactaccgaaacggttcgtaacccgtttaacccgttacccgttaacgtttaccggttacggaaccgggtaaacccgggtaacctaacggtaccgtaacgtaacgtaaccgtaaacgtaccgttacggtacgtcgtacgtacccttaccgtatttcccgtagtttccc

SEQ ID NO: 191526 - DNA, 687 bp, Homo sapiens
  misc_feature: GYAE6OF02FK251.47.70.G04.1.454.CMB.1.raw
tcagagctcacgtacacgaccggtgctcgatttagtgtagtgtgaagggaaaggggtctgggagaggagcccagcactagaagtcggcgttgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggaagtccctgagactctcctgtgcaacgtctggattcaccttcagtacctacggctatgcacgtggggtcccaccgaggcctccgaggccgaagggggctgggaggtggggtggctaagtttagtagtggtacgtagtgggaaattaatttaacgtttaactaagtgactacgtaccgttccggtagggacgggggtaccctagttaccgaaccctatacctaccgaagtaacgaactaaacttacccgaaagtaaaccgtaacgggttacgtaacttaccgtagaactaaaacgtagtaaacgttaacggacccgttagggaacggaacggacccggtaaacgggaccgtaaccgggtcttaggttacgttaagttaccgtggtaggtacggaagtaaggttaagttaggttaacgttcggtaaccgtcccggtacgtacgttactaccg

SEQ ID NO: 191527 - DNA, 813 bp, Homo sapiens
  misc_feature: GYAE6OF02HJLF3.47.70.G04.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgaccngtcnccatcctcctgtctgcatctgtaggagacagagtcaccatcacttggcccgggcagtcgaggggtcgttagacaaagttcggtcgttttcggaccgtttgggttttaccaggtaccgaacggtaacccgaacccggaaacgggggtaaacccggtacccccgttaaaacgggcccggtacccgtacgggtaaccttaccgtttaacggttcgggtcggtactaacttaacgttaccgttttacggaaccggttaaaaggtccggggttaacccaagttaccgtaacggtttacgacggtaccggacgtaggtacgggtacgtggggaaactacggtacgtacctacgttaccgtacgtaacgtacttacggacggtccggtacccgtcgacgtaccgtacccgttagaaacggttcttccgttacggtaaccttaacgtttaacgttaccgttacgttacccgttacgtacgtaggttactacggttacccgtttacccgttacccggttccggttaaccccggtttacggggaacccgtttaaaccggggaaccggttaaacgggggtttaaccggaaaacttaacccggtaaaacgttaaccggttcggtacgggtcttaaccggtacctacgttaccgttacg

SEQ ID NO: 191528 - DNA, 701 bp, Homo sapiens
  misc_feature: GYAE6OF02GXUTV.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacgttgccgggcaagtcagagcattaaacagacgtaattttaaagttggttactccaaccaacgaaaacgaagggaaacgaccccctaacctcctagactctatgctgctagtacctagttgctagtacggttcgggtccctattccgtaggttacgaggtggcgtaggtaggtacgtcggtagggtactaagttactttcctaccgttcccttaccgacctaatccacgtacctacggttacctcgtaaccccgtaaccgtaaggttaaacgttttacttttaacggaccctttaaaccttttaaccgtaaccctttacgtaaacctaaaccgttaaccgggtttaaacgggttttaaccccggtaacccccgttttaacgtttacccggtttacgggtaccgtaaccggggtaaacccaacggttacgacgtactaaaccgtaacgtaacggtgtacggtctacgacctaccgtcttacgtcgttacc

SEQ ID NO: 191529 - DNA, 689 bp, Homo sapiens
  misc_feature: GYAE6OF02GB92I.47.70.G04.1.454.CMB.1.raw
  modified_base (487)..(487): a, c, t, g, unknown or other
  misc_feature (487)..(487): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctcgaggtgccagatgtgacatccagatgacccagtctccatcctcctgtctgctatctggtaggagacagacgtcaaccatctacgttcggccggtacaagtcaagacgactaattaaacagtacgtaaattttaaagttggtaactacaaccgaaagaaaaccgtaacgggaaacctacccctaacctacgtacgtaactactaagtcggactcgactacgtaccgtagtttacgacgttacgtacggtcgggtaccctagttacgtaggttacaggtcgacgtaggtgtagtcggtaggaactagttacgtttaccacgttccaacgtaacctatacgacgtacgtagtccgtanaaccgtaacgttaacggtaagttactttacgaaacgttaaccttataacgttcgaacaaacgttacgtaaccggttaaccgtacccttaagttaccgtttacggaccggaacggtaacctaacgtagaaccgtaacgaaccgttaaaacgacgttggtacgacccgttacgaaccctacgtaacgtttccgtagttaacccg

SEQ ID NO: 191530 - DNA, 838 bp, Homo sapiens
  misc_feature: GYAE6OF02IAG93.47.70.G04.1.454.CMB.1.raw
  modified_base (198)..(198): a, c, t, g, unknown or other
  misc_feature (198)..(198): n is a, c, g, or t
tcagagctcacgtacacgaccggtgctcgatttagtgtagtgtgaagggaaaggggtctgggagaggagcccagcactagaagtcggcgttgtttccattcggtgatcagcactgaacacagaggactcaccagtggagtttggctgagcttgggttttcctcgttgcttctttaagaggtgtccagtgtcaggtgcngcgtgggtggagtcgtgggggaggcgtggtccagccgtagggaacgtcccgtgacgacctctcctgtcgcaacgtctggtacttccaccttcgaacgttacccgtacggtaccagtcgaccgtaaccggttcggggtaccccggacccgtagggtccccgttaccccggaaggggaccggtaaacggggggtccgttagggggtaagggttcgggggttcggtaacgttaagttttagttaacggtcgggttaaacggtaaggttaaggggtaaaacgtttaaatttaacgtttaacttacgtacgtacgtaccgtacgttcccgggtaggggacccggggtacccgtacgttaccctaccctactaccccgtacgagaaacgtaactaaaccgttaccgaaacggtaaaccgtaacgggttacgtaacgttaccgtaacgaacgtaaaagtacgtaaacgttaaccgtaaccggtaggtaacgggaccgtaccggtaacgggtaaccggacgggtaaccgtttagtaacgtttacgttacggtttaggtcgggtaacggtaaggttaaggtaagttaacggggtttaaacgttaccgggttaaacccgttacccgggtacttaacccgtacgttaaccc

SEQ ID NO: 191531 - DNA, 687 bp, Homo sapiens
  misc_feature: GYAE6OF02JR5FY.47.70.G04.1.454.CMB.1.raw
  modified_base (102)..(102): a, c, t, g, unknown or other
  misc_feature (102)..(102): n is a, c, g, or t
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
tcagagctcacgtacacgaccggtgctcgatttagtgtagtgtgaagggaaagggggggagtcagtctcagtcaggacacagcatggacatgagggtcccgntcagctcctgggctcctgctactctggctccgaggtgccagatgtgacatccagtatgaacccagtcctaccattccctccctgtcctgctatctgtaggagacagacgtcaaccgatcacgttcgccggganaagtcaagacgactaattaaccnggtactagttttaaactggtactacaaccgaagaaaccgaacgggaaacctccccttaaacctcctgtactactaactcgctagcctatccgtagtttcgactagtacggtcgggtaccctagttcgtacggtcaggtcggactaggtcgtagtcgtaggactaagtactttccaactctcaactactcgacgtcgacgttcgtacgtaccgaacgtaggtaacttacgtttacaaccttaacgtttaacctaaccgttagtaaccgaaaccgttcggttaaccggtttaacccgttaaccccgttaactttaccggtttaccggaccggttaaccgggtaaccgtaacgttaccgtaacgtaacgtaaaccgaacgtaaaccgtcggttagaccgttcgtaacccaaccgtacttcgtaccggtttac

SEQ ID NO: 191532 - DNA, 662 bp, Homo sapiens
  misc_feature: GYAE6OF02GQQQE.47.70.G04.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtccaccatcacgttggccggnaagtcagagcaattaacagcgtaatttaaatgtatacaccagaaaccgaggaaacncccctaaacctcctagactctatcgctgctactcctagtttgactagtacggtcggggtacccagttacgttaggtctaggtggacgtaggtggactcgtagggactagtactttcacttctaccgacctactacagtacgacgtcgtacgaccgtaaccgtagtaagttacgttttacgaccttaaacttaaccttaccgtacgtaccgtaaacgtaacggttaccggtttaacccggttaacccgttaacgtttacggtttttaccggaccggttaaccggggaaccctaacggtacggaacgtaacgttaaaccgtaaaccggtaacttacgggttacggtaccgtacggacccgtacctaacgttcctagtttaccc

SEQ ID NO: 191533 - DNA, 823 bp, Homo sapiens
  misc_feature: GYAE6OF02H7Z1F.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctccgtggggctcctgctactctggctccgaggtgccagatgtgacatccagatcgacccagtctccactccctcctgtctgcatctgaggagacagacgtacaacctactctacgttggacccgggactaaagtaccgaaggactactaaacttaacgacgtaacgttaaatttttaaaaagttcgggttaactacaaaccccgaaaggaaaaccgaacggggtaaaaaccctccccctaaaccctacccttactaacgttaccttacctacgttacgacctaacttaccctaacgtttacggaaactaaacgggttccgggtaccctaataccggtaaaggttccgaacggtacgcgtaaggtgaacgttccgtacggatagttacttaccacgttaccacttacgtaactacgacgtacgacgtccgtacgaccgtaccgtaccgttaaggttaacgtttaacggtttttaacgtaaaccttttaagtttacgttaacgttacccgtaaacggttaaccgggttaaacctttccgggtttacccttaccgttaaccggttaacccgtttaccggggaacgggaaccgggtaaaccggtaagggtacggaacgtaacggtaaacggtaaaaacggttaccgtacgggttaacgtaccggttataaaccccggttacccggttaaccgtttacgtttacccgttaacttttacccgg

SEQ ID NO: 191534 - DNA, 656 bp, Homo sapiens
  misc_feature: GYAE6OF02IDUK4.47.70.G04.1.454.CMB.1.raw
  modified_base (101)..(101): a, c, t, g, unknown or other
  misc_feature (101)..(101): n is a, c, g, or t
  modified_base (145)..(145): a, c, t, g, unknown or other
  misc_feature (145)..(145): n is a, c, g, or t
  modified_base (148)..(148): a, c, t, g, unknown or other
  misc_feature (148)..(148): n is a, c, g, or t
  modified_base (174)..(174): a, c, t, g, unknown or other
  misc_feature (174)..(174): n is a, c, g, or t
  modified_base (203)..(203): a, c, t, g, unknown or other
  misc_feature (203)..(203): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (644)..(644): a, c, t, g, unknown or other
  misc_feature (644)..(644): n is a, c, g, or t
tcagagctcacgtacacgaccggtgctcgatttagtgtagtgtgaagggaaagggggagtcagtctcagtcaggacacagcatggacatgagggtccccgntcagctccgtggggctcctgctactctggctccgaggtgccagntgngacatccagatcgacccagtcctccnctccctccctgtctgctattctgtagganacagactccacactccacgttcggcccgggataacgtcagacgtactaactaacgacgtcgtaaatttttaaagtcggtaactccgaaaccgaaagaaaacccgaggggtaaaacctccccccttaaacgtccgttacgtaactcgttacgcgtacttcgacctactccgttagttacgctaagttacggtcggtaccattcggtacggttnacggttgactaggcgtaatcggttagggactaggtactttccacgttacncctacacgttcacgtntaacgtctacgacgtaacgtaggtacttgttactacgaactttagcctttaanacctanacggtaacctttccgaacccgttcttaacggttcgacgggtaacgacccttagcgttaacgaactaccggtaaagtccttaggaccgctaccgactaaccgttntacgtacttacc

SEQ ID NO: 191535 - DNA, 750 bp, Homo sapiens
  misc_feature: GYAE6OF02J0HUF.47.70.G04.1.454.CMB.1.raw
  modified_base (194)..(194): a, c, t, g, unknown or other
  misc_feature (194)..(194): n is a, c, g, or t
tcagagctcacgtacacgaccggtgctcgatttagtgtagtgtgaagggaaagggggagtcagtctcagtcaggacacagcatggacatgagggtccccgctcagctccgtggggctcctgctactctggctcgaggtgccagatgtgacatccagatgaccagtctccatcctcctgtctgcatctgtagganacagagtccaccatcacgttcgccgggacaagtcagacgctaattaacagacgtaatttaaacgttggtaactacgaaccgaacgaaaccgtaacggggaaacctaccccctaaccttaccgtaggtaacttacgtactcggcctacggtacctacggttaccttaggtttcgtacgtacgttagggttccgggtaccctacgttacggtacgggttacgtaacgggttgggtacggtaaggtcggtacgttacggtacggggtaaccgtaagttaccgttttacctaccgtaccttacccacctactaacgacgtacggtaactcggtaacaccgtacctaagtaacgtttacttacgtacctaacgttaccgtacgtagtaaccgtaaacgttaacgtaaccgttaccccgggtttaaccttaccggtttaccggttacggaaccggttaaccgggaaccctaacgttaccggtaaacctaacggttaaccgtaaacggtacgttacgggtacctacggtaccgtctaaccggttcggttacctacgtttaccc

SEQ ID NO: 191536 - DNA, 944 bp, Homo sapiens
  misc_feature: GYAE6OF02JILXW.47.70.G04.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
tcagagctcacgtacacgaccggtgctcgatttagtgtagtgtgaagggaaagggggagtcagtctcagtcaggacacagcatggacatgagggtcccgctcagctcctgggctcctgctactctggctccgagtgccagatgtagacatccgagatgacccagtctccatccctccctgtctgctactctgtaggagacagacgtaccaccatcctacgttcggcccgganaacgtgaagacgactaataaccgngacgtatttaaagttacggtanacaaccaacgaaaaccggaagggaaacctacccctaaccgtcgtagtactacttagtacgactacgtctacttacgtaacgttttgaacttacggttacgggtaccgttacctagttaccggttacggttacgtaacggttcggtacgtaacgggttggtaaccgtttcggtttaaacgggaaccgtaaaacggttttcccgtttttacgtttaaacccggggtacccttaacccgttaaacccggtaaacgttttacccggaaacggttacccggtttaaaccgggtacctttacccggaaacccgtttaaacccgggtttacggttaaaacgttttacttttaacccgggttaaaaccctttaaccgttttaaccgttaccggtttaaacgtaacccgtttaaaacccgggttaaacgtttaaacccccgggggtttttaccccggtttaaaaccccccggttttaagttttacccccgggtttttaaaggggtaaaccccccgggaacggggggtttaaaaacccccttagggttaaacccggaaacccgtttaaaccccgggttaaaacgtaaacccggttaacccggttcgggttaaaccggtacccgttacggttaaacccccaaggtttacccggttttacgtaccccggttttaaccc

SEQ ID NO: 191537 - DNA, 907 bp, Homo sapiens
  misc_feature: GYAE6OF02JKWS1.47.70.G04.1.454.CMB.1.raw
tcagagctcacgtacacgaccggtgctcgatttagtgtagtgtgaagggaaagggggagtcagtctcagtcaggacacagcatggacatgagggtccccgctcagctcctgggctcctgctactctggctccgaggtgccagatgtgacatccagatcgacccagtctccatcctccctgtctgctatctgtaggagacagagtcacctatccgtacgttcggcccggggcgtaacggtcgaacggggtcgttacgaccgtaaagtcggtcgttttcggtccgtttacgggttttaccgaggtccaacggaacccgaacccggaacgggggtaaaccggtacccccgtaaagggtcccggtcccgttaacgggacttacccggttaaggttcgggtaccggtactaaacgttaaccgttacccgttttaagggaacccggttaaaaacggggttccggggtaaccccttaagttaacccggtaaacgggtttaccgacgggttaaccggggaccgttaaaggggttacggggttaccggttaacggggggtaaccgtaaacgggttaccgttttaccgtaacccgttaccgttaaccgttaacccgtaacgttaccggtaaaccgggtccccggttaccgttacggaaccggtacggtacccgttaagggttaacgttaccgttttaccgtaacgtaacctttaaaccgttacgtttaaccgtcggtttaactacccgttaagttacggtagtttaacgtacccgttacccgtttacccggtaccggtttaccggtttacccggtaaccgggtaacggtaaccggttaacgggtaaacttaaacggtaaccgtaaacgtaccggttacggtacgggaccttacggaacccgtacgtacccgtttacg

SEQ ID NO: 191538 - DNA, 647 bp, Homo sapiens
  misc_feature: GYAE6OF02HNV0N.47.70.G04.1.454.CMB.1.raw
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
tcagagctcacgtacacgaccggtgctcgatttagtgtagtgtgaagggaaaggggggagtcagtctcagtcaggacacagcatggacatgagggtcccgctcagctcctggggctcctgctactctggctccgacggtgccaggatgtgacatccagatgacccagtctccatcctccctgtctgcatctgtaggagacagagtcaccatcacttgccggcaagtcagagcattaanagcgatttaaatggtatcacagaaaccaggaaancccctaaactccctgactctatgcctgcatccagtttgctagtagtgggtccctaagtcctaggttcctaaggtggactaaggtggaacgttcgtggggaactacggaacttttcaaccgtcttccaaccctattccgaacgacacgggtactcggtacctaaaccgttacggtaaacgttacgtttttcgtaaccgtaaacctttaacctaaccgttagttaccgtaaaactacggaaagggtttacccggtaacccgttaaccgtaaccgtttttcggaacccgtacggggtaacccaaacgttcggtaaccgaagttaccaaaacgtaacgtacgttacggacgtacggactacccaattccgtacgttacc

SEQ ID NO: 191539 - DNA, 938 bp, Homo sapiens
  misc_feature: GYAE6OF02GX85W.47.70.G04.1.454.CMB.1.raw
  modified_base (101)..(101): a, c, t, g, unknown or other
  misc_feature (101)..(101): n is a, c, g, or t
  modified_base (206)..(206): a, c, t, g, unknown or other
  misc_feature (206)..(206): n is a, c, g, or t
tcagagctcacgtacacgaccggtgctcgatttagtgtagtgtgaagggaaagggggagtcagtctcagtcaggacacagcatggacatgagggtccccgntcagctccgtggggctcctgctactctggctccggaggtcgccagatgtgacatccagatcgacccagtcctccatccctcccgtgtctgcatcgtggtaagganacgagtacgtaccaacctatcacgttcgggccgggactaacggtcggaagggtcgttacgaacgtaaaagttcggttaccgttttcgggtacccgtttacggggttttaccgaacggtaccgtaacggtaacccgaaacccgggtaacggggggtaaaacccggtacccccgttaaacgggcccggtaaccccgttaggtaaaccttacgttaaggtacgggttacgtacctaacgttaaccgttacgtttacggaaccgtaaaggggttccgggtaccctaagttacgtaaggttcgacggtacgtaacggtacggttacgggttacgtacggggtaaacctaggttaaccgttaccaacgtttaccgtacgtaaaccgtttaacggtaccgtaaccgggtccggtacccgtcgggtaaccgtaccggtaacccgtaggtaaccgttacgtttaccgtacggttaaccttaaaccgttttacgttaaccgttaccggttacccttaaccgttaacggtttaacgttaccggttaacttacccgtttaaccccgtttacccggttaacccgggtttaccgttacccggggtaacccgggtaaacgggtaaacccggttaaacggggtaaaacccggttaaaacgttaacccgggaaaaaccggtttaacggttaaccgggttacgggtacccggttaccggttaacccgtaccggttaccggtttaacccgg

SEQ ID NO: 191540 - DNA, 778 bp, Homo sapiens
  misc_feature: GYAE6OF02H370E.47.70.G04.1.454.CMB.1.raw
  modified_base (749)..(749): a, c, t, g, unknown or other
  misc_feature (749)..(749): n is a, c, g, or t
tcagagctcacgtacacgaccggtgctcgatttagtgtagtgtgaagggaaagggggggagtcagtctcagtcaggacacagcatggacatggagggtccccgctcagctccgtggggctcctgctactctggctccgaggtgccagtagtagtagacatccgagtatcgacccagtcctaccactcccttccctgtccgtgacactcgtaggtaggacgaagaggtagtaccacactacctacttcgggacccgggataacgccaggataccgtaaataaccgtaggtacgtttaaaatttttaaacgttggtaaactccgaaaaccgaaacggaaaaccgtaacggggtaaaccctaccccctaaaccgttccgacgtatttaccttaagggccgtacttacgaccgtaacgtttacccgtaggttttagaccgttaggtttaaccgggtcccgggtacttaacgttccggttaaaggttacagggttcggacttaaggtagccgttcggaggggaactagttactttccgactttcacctactactcaacggttcgactaccgttaggaccttaaccggttagttagtttaccgttactaaccttaacttaactacggttataaccgaacgttaacgttacgggttaacccgtacccggtttattttcggtaacggccgttaaagggaccccttaaggccggaacttaaacgaaccaaacgggtaccttaaggaccggtcgttaanccccgtaattacccgttggcctttacccg

SEQ ID NO: 191541 - DNA, 728 bp, Homo sapiens
  misc_feature: GYAE6OF02JD7BF.47.70.G04.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
tcagagctcacgtacacgaccggtgctcgatttagtgtagtgtgaagggaaagggggagtcagtctcagtcaggacacagcatggacatgagggtccccgctcagctccgtggggctcctgctactctggctccgaggtgccagatgtgacatccagatcgaacccagtctccatcccgtccctgtctgctatctggtaacgganacagtagtaccaccatcacgttcggacccggganaacgtcgagacgactaacttaacgagtaccgtaatttaaagttggtaataccaaccgtaaacgaaaaaccggaacgggaaaaccgtaccccccttaaaacccgttcctaggaactttaccgagttaccgtcctacggcctaattacccgttaagttaccgacttaaggtacgggttaccgggtaccctaagtttaccgttaaggggttacacgggttaaggtcgaaaggtttccggaattaccggttaagggactaaggttacctttactaccgtacctaccgtaactacgtacgacgtactacgtactccggaactaaccgtaggtaaacgtttattacgacttaaacgttactacgttacacgtaacgtaacgtaacgttacccgtaaccgtacttacgttacggacgtaacgggactacgtacgaactaacgtaacgaaacgtacgtacggtacgaccgtactaccacgtttatacctcgttaacc

SEQ ID NO: 191542 - DNA, 722 bp, Homo sapiens
  misc_feature: GYAE6OF02JM37B.47.70.G04.1.454.CMB.1.raw
tcagagctcacgtacacgaccggtgctcgatttagtgtagtgtgaagggaaaggggggagtcagtctcagtcaggacacagcatggacatgagggtccccgctcagctcctggggcctcctgctactctggcctccgaggtgccagatgtgaacatccagatcgacccagtcctccatccctccctgtctgcatctcggtagagacagtactcacctatccgtacgttcggccgggcgagttcgagggtcttgacaagtgtccgttcggtccttcggtttacacggcgacgaccgtaccggaagggaaccggacccctaacggccgccgtcgtacttacgtagttcggtagacctaacgttaacgtacgtttacggaacgttaacgggtccgggttaccctaagtaccggtaacggtttacaccggtcggacggtacggttacggtacgttacgggacgtacggtaaccggttctaccttacgtacccgtaattcgacggcgtcccggctgaccgtaggacctaggtaccttcgtacctacgttacctaactttaccgttactcgttaccgtaccgttaatcggttaactcgttaccgttacctttacccggttaggtacctttaccgggacgtaacggaccggttaagggtaactaaacggtaccgtaaacggttaacgttgggttacccgacgtccgaacccgttacgttacgtttcccg

SEQ ID NO: 191543 - DNA, 738 bp, Homo sapiens
  misc_feature: GYAE6OF02FJ4IN.47.70.G04.1.454.CMB.1.raw
  modified_base (196)..(196): a, c, t, g, unknown or other
  misc_feature (196)..(196): n is a, c, g, or t
  modified_base (385)..(385): a, c, t, g, unknown or other
  misc_feature (385)..(385): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttcgccggcaagtcagtagctaattaacgagacgtaatttaaagttggtaactacaaccaagaaaaccgaagggtaaacgacccccttaaccgtcctgactacctagtgactgactaactccgtaagttttcgactaagttacggtacgggtacccagttacgtaacggtttnaacggtagggtcgaaggttcggtactacgttaggggaactaggttaccttttacaccgtttaccgtacctaacccgtacttcgaacgtactaacgttaccctagaccctaaacgttaggaaaagtttcgttttacgaaccttaactttaacgtaaccgtttacgtaaccaagttaacggtaaaccgttttaccccggggtaacccctttaaacttacccgggttttacgggaacccgttaaccggggaaccctaacgtacgggaacctaaccgttaaccgtaaaaaccgtaaccgttaggggttaacccggtacttacgtaacccgaactacgttttccgtaccggtttaacc

SEQ ID NO: 191544 - DNA, 659 bp, Homo sapiens
  misc_feature: GYAE6OF02HBRA2.47.70.G04.1.454.CMB.1.raw
  modified_base (441)..(441): a, c, t, g, unknown or other
  misc_feature (441)..(441): n is a, c, g, or t
  modified_base (645)..(645): a, c, t, g, unknown or other
  misc_feature (645)..(645): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgaccacccagatgacccagtcctccactccctccctgtctgcatcgtgtaggagacgagagtccaccatcacttcgccaggcgacgtcaggactattacgactaaacttaatttaaattggtaactacagacaaagaaaccgaagggaaacacccctaagctaccctgactaccgtagatacgctactacctaaagtttacggaaacgtacgggtccctaagtaccgtaaggttacaggtaggtagtggtactcggtaggactagtttacttttacgttaccactataccgtanccgtactcgtacgcgtactacgtaagtaacgtacttagtacgaactacttaaattcgttactagtacaagttacgtaatacgttaactaacccttcccgttaaccccttcgtttacccgacccggttagggtaaacccttagggtacgtaacttaaccgttaaaccgaaacgttaagttcggtagtctaacggccctaacgttnttcctacgttaccc

SEQ ID NO: 191545 - DNA, 722 bp, Homo sapiens
  misc_feature: GYAE6OF02FM7RB.47.70.G04.1.454.CMB.1.raw
  modified_base (103)..(103): a, c, t, g, unknown or other
  misc_feature (103)..(103): n is a, c, g, or t
  modified_base (129)..(129): a, c, t, g, unknown or other
  misc_feature (129)..(129): n is a, c, g, or t
  modified_base (388)..(388): a, c, t, g, unknown or other
  misc_feature (388)..(388): n is a, c, g, or t
  modified_base (477)..(477): a, c, t, g, unknown or other
  misc_feature (477)..(477): n is a, c, g, or t
tcagagctcacgtacacgaccggtgctcgatttagtgtagtgtgaagggaaaggggggagtcagtctcagtcaggacacagcatggacatgacgggtccccgntcagctcctggggctcctgctactcnggctccgaggtgccagatgtagacagtccagtagtacgacccgtagttcctaccacttcccgtccctgttctgctatcgtagtaggacgacagtacgtacacctatacctacgttcgggaccgggactaaacggtcgaaggaccgtaaccttaaagttaaccgaggttaaccgttaaagttttaaagttggtaactaccgaaccaaacggtaaaccgacgggaaccctacccctaaccgtctagtaactcttacgtcgntcgtacctagtaccgttagtagcgtaagtacggtcggtactagttagtacgtacgaggtcgacgttagtgtagtacgagagttaacgtntttaccgactcgaacctaccagtcgaacgtacgacggttcctagtacctaacgtaagttaatcgtttaacgactttaaacgttacacggttaactacaacggttacttaacccgttaccgtaccgttaacgttaccggttaacggaccggtaaacggtaaccgtaacgtagtaaccgtaacctaaacgacggttaactcggtaccggtacctacgacccgaagttacccttgtaacgttaccccg

SEQ ID NO: 191546 - DNA, 695 bp, Homo sapiens
  misc_feature: GYAE6OF02G6QBO.47.70.G04.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagagctcacgtacacgaccggtgctcgatttagtgtagtgtgaagggaaaggggggagtcagacccagtcaggacacagcatggacatgagggtccccgctcagctcctggggctcctgctgctctgctcccaggtgccaaatgtgacatccagatgacccagtctcccttccaccctgtctgcatctggtacgganacagagtcacatcacttcgccgggccagtcagagtntgatggtgtgctggtancagnaagaacagggaacgccctagtaactcttaatctaagtaggcgtcttatttaagaacgtcgggtaccctatacgagttcgaggccggcgtagtgacgtcgtacggggactacgtacgttacacctcctacctacctactacccgaacctcccgtacgaccgacgtacctaggattaggttactttcggtaccgttaaccttttaacgttaactacggtaaaacctaaagttaaagtaagtttaccggttaccgttacccttaccggtttccggggtttaccgtaccccgggttacgggaaccgttaaacgggttcggttaaacgtaccggttaaaccgtaacggtaaccggttggtaccggtacggttaccggacccttaccaacggttccctttaccggttaccctttacgttaccgtttccccgtacccggttacccg

SEQ ID NO: 191547 - DNA, 707 bp, Homo sapiens
  misc_feature: GYAE6OF02G7KHX.47.70.G04.1.454.CMB.1.raw
  modified_base (211)..(211): a, c, t, g, unknown or other
  misc_feature (211)..(211): n is a, c, g, or t
  modified_base (443)..(443): a, c, t, g, unknown or other
  misc_feature (443)..(443): n is a, c, g, or t
tcagagctcacgtacacgaccggtgctcgatttagtgtagtgtgaaggggaaaggggggagtcagtctcagtcaggacacagcatggacatgagggtccccgctcagctccgtggggcctcctgctactctggcctcggaggtcgccagatgtgacactccaagactacgacccagtctccatccctcctgtctgctatcgtaggtagganacgagtactacaccatcacgttcggaccggacaagtcgagagtctaattaacgagtacgttaaattttaagtcggtacaacccaaccgaaagtaaaccggtaacgggaaaccccctaccccgttaaaccttccgtacggtaactcgttacgcgtctacgtcctaccgtttaccgtgttacgacttaggtacggggttccggtacctagttccgggtaattccgtggtacggngtaacggtggtacgtggtaccggaattacgtactttacctacctacgtaacccgtactaacgtcgaccttacgtacgtcctacgtaaacctaccggtaagttaagttcgttaccgaaccttacgttactcgtaacgtacctaacggtacgtacccggttacccgttaccgtacgttaaccggttacgaaccggtacgaactacgtacggtatacggtaactaacggtctacgggtctccgacgtaccctatcgtacgtcttacg

SEQ ID NO: 191548 - DNA, 668 bp, Homo sapiens
  misc_feature: GYAE6OF02FGXMO.47.70.G04.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (663)..(663): a, c, t, g, unknown or other
  misc_feature (663)..(663): n is a, c, g, or t
tcagagctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtnacatccagatgacccagtctccatcctccctgtctgcatctgtaggagacangtacaccatcacttggccgggacaagtcagagcaattaacagcgtaatttaaagtttggtactcaaccaacgaaaacccgaagggaaaccgtcccccaaccttcctagactcttagtgctcgcaactccgtagttttcgacctaagttacggtcggggttacccctagttacgttacgggtttacgaaggttcgggtaccgaggttgggaacttccggttaggggaacctaaggtttactttcgacttcctactacctactaccagtaccacgttaccgtacgacctaaccgttaggtaaacgttagtttttactaaccgtaaactttaaccgtaacgttactactaacgtaacggttaaccgttaaccggttaaccccggttaccttacgtttacggacgtaaccgggaacctaacgtacgaactaacacgaaacgtacgtgtacgctacgccactctcgtnttccg

SEQ ID NO: 191549 - DNA, 941 bp, Homo sapiens
  misc_feature: GYAE6OF02FHGR4.47.70.G04.1.454.CMB.1.raw
  modified_base (914)..(914): a, c, t, g, unknown or other
  misc_feature (914)..(914): n is a, c, g, or t
tcagagctcacgtacacgaccggtgctcgatttagtgtagtgtgaagggaaagggggagtcagtctcagtcaggacacagcatggacatgacgggtccccgctcagctccgtgggctcctgctactctggctccggaggtcgaccgagtattggtacaactacgtacccgaagtagtccgaaccccgagttacctacccgacttcccctccccgttgtccgtcgactacgttcgtaggtaagggaacgtaaccgtaggtacccgtaccaccctaacgttcccgttaaccgttaccgggggaacccggggttaacaaacggttccgaacgggtaaccgtaacctaaacgttttaaacccgacggtaacggtttaaaactttttaaacgggtttacgggtaaacttaaccggaaaaccccgaaaaccgggtaaaaacccgggtaaaccggggtaaacccccgttaaccccccttaaacccgttaccgtacgtaccgttaccgttaacgcggtacgtacgtacctaacgttccgtttaagggttaccgttaacgttaacggttccggggttacccgggtaacccttgtttaaccgggttaacggttacggtagggtacgtacggttaggtaggtaccgttcggtaaccggtaagtacgttacctacgtaccctttaccaaccgtaccgtaccgtaacggaaccggtacgtaacgttcccggaaactacccggtaaacggttatacggtttaacctttaccgaaaccgtttaaaccttaccgtaacgttacgtaaaccttaaggtaacccggttttaacccgtaacccccggttaacttacgttaccggttacggaccgtaaaccgggaaccttagtaccggaaccttaaccgacgttaaacgcgtagtccgtaaccncggtaaccgtctacgttactcgttacc

SEQ ID NO: 191550 - DNA, 751 bp, Homo sapiens
  misc_feature: GYAE6OF02HQSLV.47.70.G04.1.454.CMB.1.raw
tcagagctcacgtacacgaccggtgctcgatttagtgtagtgtgaagggaaagggggggagtcagtctcagtcaggacacagcatggacatgagggtccccgctcagctcctggggctcctgctactctggctccggaggtgccagatgtgacatccagatgacccagtctccatcctcctgtctgctatcgtaggtaggacgacagactacaccactacgtacgtcggaccggacaacgtcgaagacgtactaacgttaacgaggtaacgttaaattttaaagttcggttaactaccgaacgaaacggaaaccgaaacgggaaaccgtacccccttaaaccgtcctaggtacttacgtagtcgtctcgtactactaccgttacgttacgacgtaagttacgggtcgggtaccctagtacgttacggtcgtaggtcggtacgtaggtacggtactcgggtaacggtacgtaacgttaccttttaccgaaccgttcctaaccctactacgtccgaacgtacgtacgtacgtcgaacccgtaacgttaacggtaatttacgtttaacgaacctttaaccgttaacttcgtaacgtaacgaacgttacgtaaccggtttaacccggtacccgtttacgttaaccggttcggaaaccgggtagggtaacccgaacggtaccgtaaacgtactaaaccggttaactaacggtcgttacggtcgtacaccgtacgtacgttacgttcgtttaacccg

SEQ ID NO: 191551 - DNA, 778 bp, Homo sapiens
  misc_feature: GYAE6OF02HYRMB.47.70.G04.1.454.CMB.1.raw
tcagagctcacgtacacgaccggtgctcgatttagtgtagtgtgaaggggaaaggggggagtcagtctcagtcaggacacagcatggacatgacgggtccctgctcagctccgtgggacctcctgctgctcgtcggcctacccagggtcgaccgtagggttcgtcgaccactccgagactcgaccctagttcctacctacttcccgtccctgttctcgtacctgtcgttggaaggaactacgaggaccttccaaccgtattacctccgggttcggcccggggagtacggtcggacgggtcgttacggaactaagtcgttacggttcggtcccgtttggtttaccgaagaccgtaacggaacccgaacggaacggggaacccggtacccctaacggccgtaccgtagtactcgttaggtcggtactacgtactacgttaacttacggtaaccggtaaacgggttccggtacccaagttaccggtaaggttcggacgcccgggttacgtaacgggttacggtccggtaacgggtaaccgtaggttccggttaactacccgtttacgtaaaccgttaccgttaacgtccgtaccgggtacccgtcaaccggccgtacgtcccggtaagttacgtacttacgtctaaacgttacctttacttacgtcgttacctcgtagtactgtactccgtcttaaccgtcgttacgtccggaaccgtaccggtaagtaccggtaagaaccgttaagaaccgtgttacggcgtacctacgacctacgtacg

SEQ ID NO: 191552 - DNA, 656 bp, Homo sapiens
  misc_feature: GYAE6OF01AU1OZ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggaggcttagttcagccgtgggggtccctgagactctcctgtgcagcctctggattcaccttcagtagtcactggatgcactgggtcctcaagttccaggggagggctggtgtgggtttcacgtattacgagtgatgggactgacacaatctacgcggactccggtgaacgggccattccacccctcagagacaacgccaagaacacactatactctagacaaatcgaactagtactaggaagacggccggaaggaccgacgggtcttaggtaccttaagttaacctggttacgaccgtaaaggtacgggttacgggaccttaaacgtaaagttaccgtaaggtttttaggggttttttacggaaacgttttcccggtttaccggggttacggggggggtaaacccccaaaaggggggtaaacccttaaagggtttccggggttacccctaaacccccggg

SEQ ID NO: 191553 - DNA, 537 bp, Homo sapiens
  misc_feature: GYAE6OF01C9LS5.35.44.D11.1.454.CMB.1.raw
  modified_base (405)..(405): a, c, t, g, unknown or other
  misc_feature (405)..(405): n is a, c, g, or t
  modified_base (495)..(495): a, c, t, g, unknown or other
  misc_feature (495)..(495): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctgggggtccctgagactctcctgtgcagcctctggattcaccttcagtagtcactggatgcactgggtccgtcaagttccgagggaaggggctgggtgtgggtttcacggtattacgagtgatgggactgacacaatcacgcgactccgtgaaggccattcacccctcagacgacaacgcaagacacactanatctagacaaatgaacagtctagagacgccgaggacacggctgtactattactgtgactaggaggtggactacaatcgagttggttttanattcgtcgttacggggaccaagggactaagtggtacctaccg

SEQ ID NO: 191554 - DNA, 536 bp, Homo sapiens
  misc_feature: GYAE6OF01CCHQ9.35.44.D11.1.454.CMB.1.raw
  modified_base (165)..(165): a, c, t, g, unknown or other
  misc_feature (165)..(165): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (467)..(467): a, c, t, g, unknown or other
  misc_feature (467)..(467): n is a, c, g, or t
  modified_base (525)..(525): a, c, t, g, unknown or other
  misc_feature (525)..(525): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtgtcgttttctaggtggctattttaaaaggngtcagtgtgaggtgcagctgttggagtcgtgggggaggcttggcacngccgtggggggtccctgagctctcctgtgcagcctntaggnttcacctttagctaacctntggcatgagcgtgggccgcggcnccgaggggagggctggagtggtcncaatgttgatggtatgctacataacnagtgagcagctcgngaggccgtnaacntcncagacactatccaaggaaccncgtntatactacgaaagaagtcgactagtcgagacgacggacgtaacgactacgtacttaagtacgtacgngtacgaacgtaaagtcgaacgtggcgtcgtacggacgtagggtacggtacgattacgngtaccgtcggg

SEQ ID NO: 191555 - DNA, 537 bp, Homo sapiens
  misc_feature: GYAE6OF01EPOO4.35.44.D11.1.454.CMB.1.raw
  modified_base (344)..(344): a, c, t, g, unknown or other
  misc_feature (344)..(344): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctctggattcaccttcagtagtcactggatgcactgggtccgtcaagttccggggaaggggctggtgtgggtttcacgtatacgagtgatgggactgacanaatctacgcggactccgtgaagggccgattcacccctcagagacaacgccaagaacacactatatctagacaaatgaaacagtctgagacgccgaggacacggctgtctatactgtgcaagaggtgctacaatctagttggttttagatcgtacgtggggaccctaaagggacaagttcggtccaccgttccg

SEQ ID NO: 191556 - DNA, 522 bp, Homo sapiens
  misc_feature: GYAE6OF01BRTJR.35.44.D11.1.454.CMB.1.raw
  modified_base (491)..(491): a, c, t, g, unknown or other
  misc_feature (491)..(491): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccatcaagttccagggaaggggctggtgtgggtttcacgtattacgagtgatgggactgacacaatctacgcggactccgtgaagggccgattccaccccctcagacgacaacgccaagaacacactatatctgacaaatgaacagtctgagagccgaggacacggctgtctattactgtgcaagaggtggctacaatcattggtttnatctcgtggggccaagggacaagtggtaccg

SEQ ID NO: 191557 - DNA, 526 bp, Homo sapiens
  misc_feature: GYAE6OF01BVGST.35.44.D11.1.454.CMB.1.raw
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccggggggaggcttagttcagccgtggggggtccctgagactctcctgtgcagcctctggattcaccttcagtagtcactggatgcactgggtccgtcaagttccgagggaaggggctgggtgtgggtttcacgtattacgagtgatgggactgacacaatctacgcggactccgtgaacgggccgattccacccctcagacgacaacgccaagacacactatactctagacaaatgaacagtctagagagccgaggacacggctgtctattacngtgacagaggtgactacaatcgattggtttgatctgngggaccagggacagtgtctaccg

SEQ ID NO: 191558 - DNA, 627 bp, Homo sapiens
  misc_feature: GYAE6OF01C82FR.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccgggggaggcttagttcaggccgtggggggtccctgagactctcctgtgcagcctctggacttcaccttcagtagtcactggatgcactgggtccgtcaagttccgagggaagggctggtgtggttcacgtatacgagtgagtggactgacacaatcgtacggcggtaactccggtaggaacgggtccgacttcccaccccctcgaacggtacgaaccaaccgaccaaagaaccaactaactatactactagaacaaatagaacagttacagagacgaccgaaggaccgacggtctgtaccttattacgtgtagacgtaaggacggttacggactaaacgtaagtaccgtaagtttgggttttacgcgtttacgttaccggtacgggggtacccgtaaaggggtactaaacggttcgggtacccgttacccgg

SEQ ID NO: 191559 - DNA, 547 bp, Homo sapiens
  misc_feature: GYAE6OF01BZJ5X.35.44.D11.1.454.CMB.1.raw
  modified_base (471)..(471): a, c, t, g, unknown or other
  misc_feature (471)..(471): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccaggggaaggggctggtgtgggtttcacgtattacgagtgagtgggactgacacatctacgcgactccgtgaagggccattccaccccctcagagacaacgccaagaacacactatatctagacaaatgaacagtctgagacgccgaggacacggctgtctattacgtgtgacaaggnggtcggctaacaattcgtagttggttttagacttcgtcggtcggggtaccaaggggaacaagtgggtcctacccgg

SEQ ID NO: 191560 - DNA, 639 bp, Homo sapiens
  misc_feature: GYAE6OF01B9ZNI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccggggggaggcttagttcagccgtggggggtccctgagactctcctgtgcagcctctggattcaccttcagtagtcactggatgcacgtgggtccgtcgaaggttccgaggggaaggggcgtgggtgtgggtttcacgtattacggagtgatgggactgacacaatcgtacgcggactccggtaggaacgggccattccaccccctcagacgacaacgaccaagaacacaactatactctagacaaatcgaaactagtctagaacgacggaccggaagggaaccaaccgggtcttacggtaccttaagtttaccgtggtacgacgaaaggtaggggttcggaaccttaacgaaagttaccgtaaggtttgggtttttagtacttccggttacggtacggggggtacccaaaggggtaacctaacggttcgggttaccgtaacccgg

SEQ ID NO: 191561 - DNA, 661 bp, Homo sapiens
  misc_feature: GYAE6OF01CIC6W.35.44.D11.1.454.CMB.1.raw
  modified_base (160)..(161): a, c, t, g, unknown or other
  misc_feature (160)..(161): n is a, c, g, or t
  modified_base (164)..(165): a, c, t, g, unknown or other
  misc_feature (164)..(165): n is a, c, g, or t
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtgtttcgtgtagcattaagtgtcgtnngtnnantgtgagngngggngctggcagctggnggtcctgagctgtctgtgcngcctngattcaccttnaganactattcgatgactggactccgcagacncgaggaggtcnggagtggctcacacatcagcagtacgnggacaaatccctaagtcgttaaccaacgcctaaggtacctctaggtaggaaacgggtcctattaccgaaccgtttaagtttacggggaacctacggtaccggtaagggttacgtctaggttactaccgttaggtaaacctaaaggtcaaaccgggtacgtaacggtaagggaacggtaaccggtaacgggaaccggtaaccgtaccggtaccgtaacgtttaaccgttacgttaaccgtacggtacgtaaaccggtaacgtacggttacggttagggttacgggttcgggttacggtacggtttaacggtttcgggttaacggttaacccggtttaaccggttaaccggttacgggtaacgg

SEQ ID NO: 191562 - DNA, 592 bp, Homo sapiens
  misc_feature: GYAE6OF01CCXCQ.35.44.D11.1.454.CMB.1.raw
  modified_base (388)..(388): a, c, t, g, unknown or other
  misc_feature (388)..(388): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagccgtgggggtccctgagactctcctgtgcagcctctggattcaccttcagtatcactggatgcactgggtcctcaagttccgagggagggctggtgtgggttcagtattacgagtgagtggactgacacaatcgtacgcggactccggtagaaacgggcctaacttccaccccccgtnaacgtacgaaccaaccgaccaacgaacacaactaatatactagacaaatgaacagtctagagacgcgaaggaccacggctagtcgtaattacgtgtacgacaaggtaggtacggtactaactaactcgtagttaggtttttacgacgttccgttaggtcggggtaacccaaaggggtaactaacggtggtacccgttaacccgg

SEQ ID NO: 191563 - DNA, 611 bp, Homo sapiens
  misc_feature: GYAE6OF01DTMI8.35.44.D11.1.454.CMB.1.raw
  modified_base (136)..(136): a, c, t, g, unknown or other
  misc_feature (136)..(136): n is a, c, g, or t
  modified_base (144)..(144): a, c, t, g, unknown or other
  misc_feature (144)..(144): n is a, c, g, or t
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcggngtttcgtntaggccgatttaaagtgtcagtgtgagtgcagctggtggagtccggggagcttagttcagcctgggggtccctgngactctcctgtgcagcctctggattcaccttnagtacgtcacgtgatcgcacgtcggtaccgtactacggttccgaaggggacgggtcgttggtggttcggttctacgttagttacgagtgagtcggactgacaactatcgtacgcgtactcggtagaacggtcctactacccacccctcgagacgaacacgaccaaagtaccaactactatactctanactaanacacagtactagacgacgacgacgacgacgtacgtacgtacttagttacgtacgtacgtacgtaggtacggtacggtacgtacgtaacgttacgttacgttaggtttacgttcgttacgttacggtacgggtacggtaacggtaacgtaacgttacggtccgtaccg

SEQ ID NO: 191564 - DNA, 575 bp, Homo sapiens
  misc_feature: GYAE6OF01ATMEJ.35.44.D11.1.454.CMB.1.raw
  modified_base (499)..(499): a, c, t, g, unknown or other
  misc_feature (499)..(499): n is a, c, g, or t
  modified_base (529)..(529): a, c, t, g, unknown or other
  misc_feature (529)..(529): n is a, c, g, or t
tcagtacagatcgtcacgaccggtgctcgatttagcgcagtacgaagggggccccgagccctgggactcccagctgtttctgcttgctgatcaggactgcactacagagaactcaccagtgggagttcggctgagctcggtttcttgttgctatttaaaggtgtccagtgtgaggtgcagctggtggaggtccggggagtcttagttcagccgtgggggtcctgagactctcctgtgcacgcctctggacttcaccttcagttagtcactggatgcacgtgggtcctcgtaagttccgaggggaagggcgtgggtgtgggtttcacgttatacggagtgagtgggactgacacatctacgcggactcggtagacggccactcccacccctcagacacacgacaacgaacactactatactctagactaaaagtcgaaactgtcctaggagacgccgaaggaccgacggtctggtacttaagttctggtcgacgtaaggnggtcgactaccgattcgtacgtttggtttnacgttcgtcggtacgggacctaagggaaccagttcggacctacccg

SEQ ID NO: 191565 - DNA, 567 bp, Homo sapiens
  misc_feature: GYAE6OF01AF10K.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcacgtgggtccgtcaagttccaggggaggggctggtgtggtttcacgtattacgagtgagtgggactgacacaatctacgcgactcggtgaacgggccattccaccccctcagacgacaacgccaagaacacactatactctgacaaatgaactagtctgacgacgccgaggaccacggctagtctattactgtgacaggaggtcggactaacgaattcgtaagtttgggttttagacgttccgttacggtcggggacccgaaaggggaaccaaggttcggtaccctacccgg

SEQ ID NO: 191566 - DNA, 585 bp, Homo sapiens
  misc_feature: GYAE6OF01DQ27C.35.44.D11.1.454.CMB.1.raw
  modified_base (544)..(544): a, c, t, g, unknown or other
  misc_feature (544)..(544): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccggggggaggcttagttcaggccgtggggggtccctgacgactctcctgtgcagcctctggattcaccttcagtagtcactggatgcacgtgggtccgtcaacggttccgaagggggaaggggtcgtggggtggttggggttcacgttagttacggagtgagtgggactgacacaatcgtacggcggtactccggtaggacggccacttcccacccctcaagacgaacaacgaccaaacgaacactaactatactctagacaaatgaacagtcaggacgacgacgaaggacacggtctcgtacttagttactgtgacgaggaggtcgactacaatcgtagtttggtttangttcgtcggtaggggaccaagggtacaagtcggtctacccg

SEQ ID NO: 191567 - DNA, 571 bp, Homo sapiens
  misc_feature: GYAE6OF01DVLB2.35.44.D11.1.454.CMB.1.raw
  modified_base (290)..(290): a, c, t, g, unknown or other
  misc_feature (290)..(290): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
  modified_base (553)..(553): a, c, t, g, unknown or other
  misc_feature (553)..(553): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggaggtccgggggaggcttagttcagccgtgggggtccctgagactctcctgtgcagcctcgtggattccaccttcagtagtcactggatgcacgtgggtccgtnaaggttccgaggggagggctgggtgtgggttcacgttagtacgagtgtagtgggactgacacaatcgtacgcggacctccggtagaacgggcgtacttccacccctcgagacgacaaccgccaaagaaccacaactatactctagaactaaancgaacagtctaggagacgcgacgacgcggctgtactattacgtgtacgagaaggcggtagactaanagttacagtttggtttanacgtcgttggcggggaactaacgganaacgttggtcctaacccg

SEQ ID NO: 191568 - DNA, 608 bp, Homo sapiens
  misc_feature: GYAE6OF01CZTRP.35.44.D11.1.454.CMB.1.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (484)..(484): a, c, t, g, unknown or other
  misc_feature (484)..(484): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtcttgggttttccttgttgcctaattttaaaaggtgtccagtgtgaggtgcagctggtggaggtccgggggagcttagttcaggccgtgggggtccctgagactctcctgtgcagcctctggacttcaccttcagtagtcactggatgcacgtgggtcctacgaagttccgaaggggaagggtctggtggtggttcacgtattacgagtgagtggactgacanatcgtacgcgactcgngaacggcatccaccccnaagagaacaacgacaagaacacactatatctagacaaatgaaacctgtacgtagacgaacgaccgaaggaaccacggtctaggtactaacgttacnggtagaacgtaaggagggtacgaccttaaagaactcgtaaggtttggttttacgaagttcccgttacgggtacggggaaacccgtaaaaggggtaaccaaagggttcggtacccgttaacccgg

SEQ ID NO: 191569 - DNA, 584 bp, Homo sapiens
  misc_feature: GYAE6OF01DBSNF.35.44.D11.1.454.CMB.1.raw
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (530)..(530): a, c, t, g, unknown or other
  misc_feature (530)..(530): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctattttaaaaggtgtccagtgtgaggtgcagctggtggaggtccgggggaggcttagttcagccgtggggggtccctgagactctcctgtgcagcctcgtggacttcaccttcagtagtcactggatgcacgtgggtccgtcaagttccgaggggaagggctgggtgtgggtttcacggttattacggagtgagtgggactagacacaatctacgcggtactcggngaacggccgacttccaccccctnagacgaaccaacgaccaagacacactatactctagacaaatcgaactagtctagagacgaccgaggaccacggctagtactattcgtgtcgacgaggtaggtcggctaactaatcgtagttggttttanacgttcgtacggttacggggaccgtaagggtactaacggtcggtacccgtaccg

SEQ ID NO: 191570 - DNA, 714 bp, Homo sapiens
  misc_feature: GYAE6OF01B1LGY.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgcctaattttaaaggtgtccagtgtgaggtgcagcgtggtggaggtccgggggagtcttagttcaggccggtgggggtccctgagactctctgtgcagtcctcgtggtacttccaccttcagttacgtcacgtgatgctacgtcggtccgtcgtaagttacggagggacgggtcgtggttggttggttacgtacgttagttacgtagtgagtgggtactgtaacactaacgtcgtacgaccggtacgtccggtacggaacgggtaccgtaccttacccgacccccgtaccgaacgaacgaaccgaacccgaaccgtaaacgaaccgtaactaaccttaactaacgttacgtacgtaaacgaaaatacggaaacgtacgttacgtacggaacgaaccgaccgggaagacccgtacggtccgttacgttacgttaattaccgtaggttacgacgtaaggtacggtcgactaacgtaaatcgttaagtttggtttacgtcgtttacggtaccgggttaacggggtacccgaaaggggtaactaacgggttccgggttcccgtaacccgg

SEQ ID NO: 191571 - DNA, 583 bp, Homo sapiens
  misc_feature: GYAE6OF01BF7CR.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccgaggggaagggctgggtgtgggtttcacgtattacgagtgatgggactgacacaatctacgcggactccggtggaagggccgattccaccccctcagacgacaacgccaagaaccacactatatctagaccaaagtcgaacaggttcctagaacggacgcccggaaggaccgacggctagttactattactggtcgacaagggtaggtcgactaacaaattcgtaagtttggtttagacttcgtacggtacggggtaccaaagggactaaaggttggtacccgtacccg

SEQ ID NO: 191572 - DNA, 736 bp, Homo sapiens
  misc_feature: GYAE6OF01BIWIE.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagcgtggtggaggtccgggggagcttagttcagtccgtgggggtccctgagactctccgtgtgcagcctctggacttccaccttcagtagtcacgtggatgcacgtcgggtcctacgtaacgttccggaggggtaacgggcgttgggtggttcgggtttaccacggttacttacggacgttgagtcgggactgaactaactaagtcgtaacggcggtaacgttccggtaggaacgggtccgtacgttaccccgaccccccgttacgaacggaacgaaccgaaaccgaccaaacgaacctaaccgaacctaactaacttaccgtacggaactaaaacgtacgtaaactacgttacgtaggaacggaacgacccggaaagggacccgtaacgggccttaacgttacgttacgtttaaccgtcggtacgtaaccgaaggtacgggtaccggtacttaaaccgaaagttacgtaggttttacgggtttacgtaacgttcgtttaccggacggggtaccgtaaaggggaaccttaaagggttcccggtaccgttaacccggg

SEQ ID NO: 191573 - DNA, 531 bp, Homo sapiens
  misc_feature: GYAE6OF01B49ZC.35.44.D11.1.454.CMB.1.raw
  modified_base (341)..(341): a, c, t, g, unknown or other
  misc_feature (341)..(341): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (460)..(460): a, c, t, g, unknown or other
  misc_feature (460)..(460): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttcctgttgccatttaaaggtgtccagtgtgaggtgcagctggtggagtccgggggagcttagtcagccgtgggggtccctgagactctcctgtgcagcctctggattcaccttcagtagtcactggatgcactgggtccgtcaaggttccgaagggaagggtctggtgtggttcacgtattacgagtgatgggactgacanaatctacgcgtactccgtagacggccattccacccctcagacacaacgcaagaacacactatanctagacaaatgaactagtntagacgacgaccgagaccaggctagtctaattacgngttgacgagcggtggactanatcgtagttggtttnatcgtcgtaggggaccaagggcaagtggtcctaccg

SEQ ID NO: 191574 - DNA, 949 bp, Homo sapiens
  misc_feature: GYAE6OF01ACY7W.35.44.D11.1.454.CMB.1.raw
  modified_base (162)..(162): a, c, t, g, unknown or other
  misc_feature (162)..(162): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggngtccagtgtgaggtgcagctggtggagtccggggagtcttagtcagccgtgggggtccctgagactctcctgtcgcagcctctggacttccaccttcagtagtctacgtggatgccgtacgtcgggttccgtacgtaacggttccgaagggggtaagggggtccgttggggttcggtttcggggtttttaccgtaaccgggtttaacgtttaaccgggtaaggttagggtaaggttacgggggtaaccgttacgggaaacctaaacgtaaacgtttaccccggtaaaccggggtacccggggtaacccggttaccccgggttaacgggggaaaacccgggggtaccccgtaacccgttttaccccccgaaacccccccccgttaaccccggaaacgggtaaacccgaaaccccgaaacccggaaccccgaaaacggaaaccccaaacccttaaaccgttaacttaacggttactaacgggtaaaccctaaaaggtttaaccgaaacccgtttaaggtacccgttaagggtaacggaaccgggacccgggtaaacgggtaaccgtacccgggttacgttaaccgggtttacccgtttaacgtttaccggtaggttaaccggtaaccggtaaaggggtaacgggttaccggtaaccgttaaaccgtaaacgtttaccgttaaggttttacgggtttttagacccgttttaccgggttcgggtaaccgggggtaacccgtaaacggggggtaacctaacgggtttcccgggtaaccccgttaaccccggg

SEQ ID NO: 191575 - DNA, 645 bp, Homo sapiens
  misc_feature: GYAE6OF01BFNP5.35.44.D11.1.454.CMB.1.raw
  modified_base (568)..(568): a, c, t, g, unknown or other
  misc_feature (568)..(568): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagctgggtggaggtccgggggagcttagttcagccgtgggggtccctgagactctcctgtgcagtcctctggattccaccttcagtacgtctacgtggatgctacgtgggtcctacgaacggttccggaaggggtaaggggtcgttagggttggttcgggtttacgacgtagttacggaggttgagtcgggactgaactacaagtacgtacgcggtactccggtaggaacgggcctacttcccgacccctacgagacgaccaacgacaagaaccacgtaataactactacgtacgaactaaagtacaacgtagtaccgtaaggaacggtaacgcccggaaaggaccgtacggcttacgtacttagttacgtgtacgaacgaggtacggngtaacctagtaatcggtaagtttagttgtacgttccgtgggtaccgggtacgaaggataggttcggtaccgtacccg

SEQ ID NO: 191576 - DNA, 583 bp, Homo sapiens
  misc_feature: GYAE6OF01AIIWW.35.44.D11.1.454.CMB.1.raw
  modified_base (335)..(335): a, c, t, g, unknown or other
  misc_feature (335)..(335): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcaggccgtgggggtccctgagactctcctgtgcagcctctggacttccaccttcagttagtcactggatgcacgtgggtcctactaggttccgaggggagggcgtggtgtggtttcagtattacgngtgagtggactgacactaatctacgcgactccggtaggaacggccgattcccaccccgtcaagacacaacgaccaagaacacactatactctanacaaatgaacngtcagagacgacgaggacgacgctagtcttattacgtgtacgacgaaggtggttacgctaaactaagtccgtagtttgggttttagcgttacgtccggtacggggtaacctaaggggaacctaaggttcggtccttaacccgg

SEQ ID NO: 191577 - DNA, 594 bp, Homo sapiens
  misc_feature: GYAE6OF01ATAKP.35.44.D11.1.454.CMB.1.raw
  modified_base (245)..(245): a, c, t, g, unknown or other
  misc_feature (245)..(245): n is a, c, g, or t
  modified_base (343)..(343): a, c, t, g, unknown or other
  misc_feature (343)..(343): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggaggcttagttcagccgtgggggtccctgagactctcctgtgcagcctntggattcaccttcagtagtcactggatgcacgtgggtaccgtcaaggttccgaggggaaggggtctgggttgtgggtttcacggttattacggagtgngtgggactgacacaatcacgcggactccggtggaacggccgtattcccaccccctgacgagacaacgaccaagaaccacactatatactagacaaatagaacagtacgtgaacgacgaccgagaccacggctacgtcttaagttaccgtagtcgacgaaggtacggtggtactaacgtaatcgttaagttggtttagcttcgttacggtacggggtacccgaagggtaccaaggttccggtcgtaacccgg

SEQ ID NO: 191578 - DNA, 627 bp, Homo sapiens
  misc_feature: GYAE6OF01DW6OV.35.44.D11.1.454.CMB.1.raw
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccggggaggcttagtcagccgtgggggtccctgagactctcctgtgcagcctctggattcacttcagtagtcacgtggatgcacgtgggtccgtacaaggttccgaaggggaagggctgggtgttgggttcacgtattacgagtgagtgggactgacanaatcgacgcggactcgtagaacgggccattccgacccctnaagacgacaacgaccaagtaacacaactactatctagaacaaatagaaactagtcaggaagaacgacgaaggaccacggccttagtaccttaacgttactaggtacgaaccgtaaaggtacgggtcggtaaccttaaagaacttacgttaagtttagggttttagaacgttcgttacgggtacggggtaacccgtaaaaggggaactaaacgggttcggtaacccttaacccggg

SEQ ID NO: 191579 - DNA, 593 bp, Homo sapiens
  misc_feature: GYAE6OF01BDDE2.35.44.D11.1.454.CMB.1.raw
  modified_base (100)..(100): a, c, t, g, unknown or other
  misc_feature (100)..(100): n is a, c, g, or t
  modified_base (246)..(246): a, c, t, g, unknown or other
  misc_feature (246)..(246): n is a, c, g, or t
  modified_base (433)..(433): a, c, t, g, unknown or other
  misc_feature (433)..(433): n is a, c, g, or t
tcagtacagatcgtcacgaccggtgctcgatttagcgcagtacgaagggggccccagccctgggactcccagctgtttctgcttgctgatcaggactgcncacagagaactcaccatggagttcgggctgagctgggttttccttgttgccattttaaaaggtgtccagtgtgaggtgcagctggtggaggtccgggggagcttagttcagccgtgggggtccctgagactctcctgtgcagcctntggattcaccttcagtagtcactggatgcacgtgggtcctacgtaacgttccgaggggaagggcgtgggttggtggtttcacgttattacggagtgagtggactgacacaatcgtacgcgtacgtcgtaggaacgggccgtatcactcccctcgagacacaacgaccaagaacacactatatactanaacaatagaactagtactagagacgaccggaacggtacgacggtctacgtacttaattacgtgtagacgaaggtaggtacgtaactaaattcgtaagtttggtttagacgttccgtacggacggggtaccgaagggtaactaagtcggtaccgtacccgg

SEQ ID NO: 191580 - DNA, 620 bp, Homo sapiens
  misc_feature: GYAE6OF01EZKGV.35.44.D11.1.454.CMB.1.raw
  modified_base (249)..(249): a, c, t, g, unknown or other
  misc_feature (249)..(249): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctaattttaaaaggtgtccagtgtgaggtgcagctgggtggaggtccgggggaggcttagttcagccgtgggggtccctgagactctctgtgcagcctntggattccaccttcgagtacgtctacgtggatgctacgtggtccgtcaagttccgagggaagggcgtggtggttggttcacggtattacggagtgagtgggactgacacaatcgacgcggactcggtgaacggccatccgacccctcagacgacaacggccaagaaccacacttaactactactagactaaagtcgaaactagtcctaggacgagacccgggaacgaccgacggtctacgttaccttaagttaccgtggtactaaccggaaggtacgggtggacctaaccgtaaagtcgttaggtttaggtttacgacttcgttacgggtacgggaccgtaaacgggattaacggtcggtcccttaaccgg

SEQ ID NO: 191581 - DNA, 990 bp, Homo sapiens
  misc_feature: GYAE6OF01DFA42.35.44.D11.1.454.CMB.1.raw
tcagtacagatcgtcacgaccggtgctcgatttagcgcagtacgaagggggccccagccctgggactcccagctgtttctgcttgccgatcaggactgcacacagagaactcaccatggagttcgggctgagctgggttttccttgttgcctattttaaaaggtgtccagtgtgaggtgcagcgtggtggaggtccgggggagacttagttcgaggccggtggggggtccctgagtactctctgtcgcacgtcctcgtggtacttcctacctttcgacgttacggtccaacgttgggaattcggaccgtaaccggttcgggggttacccgttaaccgtaaacggtttcccggaaggggggtaaacggggggtccgtttaggggtttcgggtttcgggggtttttacctaaccggtttaacgtttaaccgggtaaggttaggtaaggttacgggggtaaccttacggaaaccgtaactaaacgttccgtaacccgggaccgggtaaccgttacccgggtaacgggaaaccggggtccccgtaacccgtttacccccgaacccccccgttaccgaaacggaaccggaacccgaaaacccgggaacccgaaaacggaaacccctaacctaaaccgttaaacttaacgtacgtaacggtaaactaaaacggttaacggtaaacccgggttaccgtaagggaaaccggtacggaaccccggtaacgggaacccgtaccgggtaccgtttacggttacctttaaacgttttaccggtacggttaacggtaaccgttaaaggggtacgggttacgggtaacccttaaaccgttaacgttaccgttaaagggttttcggttttttaacggaaccggtttaccgggttacccggggttaaaccgggggggtaaccccggtaaaaacggggggttacccttaaaccgggttaccggggttttaaccccggtaacccggttttcccgttttaaacccccgg

SEQ ID NO: 191582 - DNA, 617 bp, Homo sapiens
  misc_feature: GYAE6OF01B9DCL.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcaggccgtggggggtccctgagactctcctgtgcagcctctggattcaccttcagtagtcactggatgcacgtgggtccgtcaagttccgaggggaagggcgtgggtgtgggtttcacgtattacgagtgagtgggactgacacaactcgtacgcggactccggtggaacgggccgacttcccgaccccctcagacgacaacgaccaagaacacactataatctagacaaagtgaactgtactagacgacggaccgaaggaccgacggtctacgttacttagttactggtcgacgaaggtagggttcgacttaacgtaactcgtaaggtttgggttttaggtcttaccggttcgggtacggggtaccgaaacggggtaacgtaaaggttcgggtaccgttaaccccgg

SEQ ID NO: 191583 - DNA, 742 bp, Homo sapiens
  misc_feature: GYAE6OF01DJI5C.35.44.D11.1.454.CMB.1.raw
  modified_base (278)..(278): a, c, t, g, unknown or other
  misc_feature (278)..(278): n is a, c, g, or t
  modified_base (662)..(662): a, c, t, g, unknown or other
  misc_feature (662)..(662): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtcgttgggttttccttgttgcctaattttaaaaggtgtccagtgtgaggtgcagctggtgggaggtccgggggaggtcttagttcgaggtccggtgggggtccctgacgcttctcctgtgccacgcctcgtggtacttctaccttnagtagtcacgtggatgctacgtcgggtccgtacgaacggttccggaagggggaacgggggtcgttggggttcggttacgggtttacgaacggttaagttacggtaggttgaaggttcgggactaggaacaactaacgttccgtaacggtccggtaacgttcccggtaagggtaaaccggggtcccgtaacctttcccccgaaccccccgttacgaacggtaaccggaaacccgaaacccgaccgaaaacgaaaccctaaccttaaacttaagttaacttccgtaacgaaacctaaaagtcggaaactcggttaccgagaacgggtaccgaccggaacggaccgtacggtcttagttacttagttacgtaggtacgagtaacggngggttacactaacgtattcggttagttgtttagcttgtaccggcggggtaaccaaagggactaggttcggtcctaaccgg

SEQ ID NO: 191584 - DNA, 592 bp, Homo sapiens
  misc_feature: GYAE6OF01ETJ36.35.44.D11.1.454.CMB.1.raw
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
  modified_base (523)..(523): a, c, t, g, unknown or other
  misc_feature (523)..(523): n is a, c, g, or t
  modified_base (553)..(553): a, c, t, g, unknown or other
  misc_feature (553)..(553): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccaattttaaaaggtgtccagtgtgaggtgcagctggtggagtccgggggagcttagttcagccgtgggggtcctgagctctccgtgtgcagcctctggattcacctttcagtagtcaactggatgctactgggtacctcaagttccgaaggggaagggctgggtggttcgggttacacggtattacggagtgagtgggactgaacacgaatctacgcggaacttcggagaacgggcctaactccaccccctnagacgaccaacgaccaagaaccacactatactntacgacaaatcggaactagtacgtagaaggaccgacgaacggacctacgggcttacggtaactagtttacgngtcgaacaaggtaggngtacctaagaaattcgtagtttgggtttanacgtcgtaggtacggaacgaaggactagtcgtccgtacg

SEQ ID NO: 191585 - DNA, 578 bp, Homo sapiens
  misc_feature: GYAE6OF01EUVID.35.44.D11.1.454.CMB.1.raw
  modified_base (469)..(469): a, c, t, g, unknown or other
  misc_feature (469)..(469): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttcctgttgccattttaaaaggtgtccagtgtgaggtgcagctggtggagtccgggggaggcttagttcagccgtgggggtccctgagactctcctgtgcagcctctggattcaccttcagtagtcactggatgcacgtgggtccgtcgaaggttccgggggaagggcgtggtggttgggtttcacggttattacgaggtgagtgggactgacactaatcgacggcggactcggtagaagggccgtacttcccacccccgtcagacgacaacgaccaacgaacacaactatatctagaacaaatagaactagtctagagacgccgagacncgctgtactatcgtgtgacgaggaggtcgctaactaatacgagtttcggtttagacttcgtacggtacgggaccgtaaagggactaaagttcgggtacctacccggttc

SEQ ID NO: 191586 - DNA, 570 bp, Homo sapiens
  misc_feature: GYAE6OF01E23SC.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggtttttccttgttgcctattttaaaaggtgtccagtgtgaggtgcagctgggtggaggtccgggggaggcttagttcaggccgtggggggtccctgagactctcctgtgcagcctctggacttccaccttcagtagtcactggatgcacgtgggtcctcaagttccgaggggagggcgtggtgtgggttcacgtattacggagtgagtgggactgacacatcgtacgcggactcggtgaaggccatccaccccctcagacacaacgccaacgacacactatatactagacaaatagaactagtactagagacgcgacggacgacggctgtacttaacttacgtgtcgacgaagagggtcgtactaacaattacgtagtttgggtttagacttcgtcgtacggggacgtaacgggactaagttcggtctacccgg

SEQ ID NO: 191587 - DNA, 609 bp, Homo sapiens
  misc_feature: GYAE6OF01D0BPP.35.44.D11.1.454.CMB.1.raw
  modified_base (286)..(286): a, c, t, g, unknown or other
  misc_feature (286)..(286): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccgggggagcttagttcagccgtgggggtccctgagactctcctgtgcagcctctggattcaccttcagtagtcactggatgcactgggtcctnaagttccgagggaagggctgggtgtggtttcacgtattacgagtgatgggactgacacaatctacgcggtactccgtgaacggccacttccgaccccctcgagacgaacaacgaccaagaacacactatatctgacaaatgaacatcgtagagacggccgaaggaccgtacggctacgttacgtaagttaccttggtacgacgtaaggtaggtacggtaccttaacaaattaccgtagtttagggtttttacgacgtttcccgttacggtacgggggtaaccccgaaaaggggtaccttaaacgtcgggttacctaaccccgg

SEQ ID NO: 191588 - DNA, 636 bp, Homo sapiens
  misc_feature: GYAE6OF01D5SE6.35.44.D11.1.454.CMB.1.raw
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccgggggagcttagttcagccgtgggggtccctgagactctcctgtgcagcctctggattcaccttcagtagtcactggatgcacgtgggtcctcaagttccgaggggaacgggtctgggtgtgggttcacgtattacggagtgagtggactgacanatcacgcgactcgngacggcatccaccctnaganacacgacaagacacatatatctagaacaaagtagaacgtagtacgtaggaacgacggaccggaaggaacccgacgggtccttacggttaccttaacgtttacgtacggttacgaaccgtaaaggtacgggttacggtaaccttaaaccgtaaacgttacgttaacggtttgggttttacgacgtttccgttaccggttacgggggtaaccccgaaaggggtaaccttaacggttcgggtacccgttaacccgg

SEQ ID NO: 191589 - DNA, 970 bp, Homo sapiens
  misc_feature: GYAE6OF01E47D5.35.44.D11.1.454.CMB.1.raw
  modified_base (108)..(108): a, c, t, g, unknown or other
  misc_feature (108)..(108): n is a, c, g, or t
tcagtacagatcgtcacgaccggtgctcgatttagcgcagtacgaagggggccccagccctgggactcccagctgtttctgcttgctgatcaggactgcacacagaanactcacagtggtaggttcggctgagtcggtttcggttttccttgttcgactttaaaagttttaaaggtcgtaccgtagttggtaggtaggtcgcgaggtcggttggggtacgggtacggggtaccggggggtacgttacgttttacggttccgaccgggttccgggggttccgggggttccctaggaccgtaccttccgttccgtggtcgacgtaccgttcccttcgtaggttacctttacccttaccgtttacgtaacggttacgtaccgtaaccggttaggtaacgtccggtaccgtacgggtttacggggttaccccgttaaccggttaaccggtttaaccgggggaaaacgggggggtaacgggggtttccggttaggggtttcgggggttttaccgggtttaaccgttaaacgggttttaacgtttaacggggtaggttaacggttaacgggtacgggtaacgttaacgggaacctaaaacgtttaaccgttaccggtaaccggtaccgggttacccggttacggtaacggggaaccgggtcccgtttaaccttcccccgtacccccctacggaaacggaaccgtaaaccgaacgtaaccgaaacgaaccctaaactacgttaactacgtacgtaagaaaccttaagaacgtaactacggttacgaggtaacggaccggacggaaacgggtaccgacggttcgttacgttaattaccgtttacgtagtacgtaagtaacgggtacggtctaaaccgttaataaccgttggtttacggttttggttacgaccgtttccggtagggaacccgggtaacgtaacgggtaaccgttagggttcccgttaaccggttacccg

SEQ ID NO: 191590 - DNA, 869 bp, Homo sapiens
  misc_feature: GYAE6OF01EIWPM.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctattttaaaaggtgtccagtgtgaggtgcagctgggtggaggtccgggggaggcttagttcaggccgtgggggtccctgagactctcctgtgcacgcctctggtacttccaccttcagttacgtcaacgttggacttgccgtacttcggggtacccgttacgaaacggtttccccggaaagggggtaacggggggtccgtttagggggttcgggttttcggggtttttaccgaacgggtttaacgttttaaccgggtaaggttagggtaagggttacggggtaaccttagggaaccctaaccgtaaacgtttacccgtaaccggggaccgggtaacccgttacccgggtagggtaaacggggtaccccgtaacttttacccccgaacccccccgttacgaacggaaaccgtaaacccgaaaccgaacccgaaaacggaaacccaaacgtaaccgtaacttaacgtacctacgaactaaaagtacgtaaacgtacggttaccgtaagaggaacccggtaccggaaacgggaaccgacccgggtcttaacggttaccttaagtttaacgttacgggttaagaaccggtaaaggtaggggttacgaccttaaacgaacgtttcgtaaggtttttagggtttagtaaccgttccggttacggggtaacggggtaaccccgtaaaggggaaccttaacggttccgggtacccttaacccggg

SEQ ID NO: 191591 - DNA, 838 bp, Homo sapiens
  misc_feature: GYAE6OF01CZT7I.35.44.D11.1.454.CMB.1.raw
  modified_base (722)..(722): a, c, t, g, unknown or other
  misc_feature (722)..(722): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagtcgttggttttccttgttcgaccttaagttttaaaaggtcgtaccaggttgtaggaggtgcgagtcgtgggtgggacgggtccgggggagtcgttagtcgacggtccgggtcgggggtccctaggacgtccttccgtccgtgtcgccgacgtcctcgtcggtacttcctaccttacgtacgttacgtacctacggtaggactcgaccgtaacggttcggggtacccgtaacgtaaccgggttaccggaaggggggtaacgggttccgttaggggttcggtttcgggtttaaccgtaacggttaacgttacggaggttagtacggtacgggtactacgaaccgtaagtaacgttccggtaacggaccggtaccgttaccgggaagggtaacccggccgttaaccgttacccccgaaacccccgtaccgaaacggaaaccggaaacccaaccggaaccaaacgtaaccaactaacttaacttaactaccgtaactaaaccgtaaacgtaacgaaccgttagttaccggaaggaacggaaccggtaccgaaggaaccgtacggtcgttacgttactaacgttcgacgggttaanaacggtaagggtcggtacgtaactaacgtaacgtcgtttaggttagttacgtcgttaccggtacggggttaaccggaacggtaaacggtacgtaacggtccgtaacccggttaccg

SEQ ID NO: 191592 - DNA, 723 bp, Homo sapiens
  misc_feature: GYAE6OF01EEXBD.35.44.D11.1.454.CMB.1.raw
  modified_base (288)..(288): a, c, t, g, unknown or other
  misc_feature (288)..(288): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagtcgttggttttctgttgctaatttaaaggtgtcagtgtgagtgcgtagcgtgggtggagggtccgggggtagtcgtttaggttcgacggtcccgggttcgggggtccctaggacgtaccttcgtccgttgtcgcacgtctcgtaggtcttcaccttnacgttacgcagtggacttcgactcggttcggtacctacgtacggttacgggagggtagggtcgttcgggttggttcggttactaggttagtacggtagtaggtagttggactaggaacacaacgttcgacgtccggtattccggaggaacccgtccgtaccgttcccaacccgacgaacggacaacgtaaccgactaacgaactacgacttatcgtnaanaacgtaatacgaacgtagacgtagaaggcccggaacgacgacggcgtagttaccgtagttaccttagtaccggtgaaaccgtagggtaccggtagtactaaacgtaccgttggttaaaggtttttcggttaccgtaacgttccggggtaccgggttaaacggggtacccggtaaaagggtacctttaccggtaacgggttccccttaaacccggg

SEQ ID NO: 191593 - DNA, 770 bp, Homo sapiens
  misc_feature: GYAE6OF01C238E.35.44.D11.1.454.CMB.1.raw
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (616)..(616): a, c, t, g, unknown or other
  misc_feature (616)..(616): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtggagtgcngngtggtggacgggtcggggagtcgttagtcgacggtccgggtcggggtcctgacgtaccttctccgtgtcgcacgtcctcgtgtacttcctacctacgtagttacgtacctacgtggtatcgaccgtacggtccggtaccgtacgtaccggtaccgggaagggggtacgggtcggttgggttcgggtttcgggtttaccgtaacggttacgttaacggaggttagtaggtacgggtacgtacgaaccgaactaacgttccgtaaccggaccggtaaccgtccggtaacgggaaccggtacctaccttacccccgaccccgtacgaacgaacgaaaccgaaccgaccaaacgaaccactaacgttaatactacgtaacgaaactaaagtacgaacgtagttacgaggaacgtacggaccgaacggaccgtacggtnttacgttacttagtcgtggtacgaacgtaggtacggtacgtaacctaagttaacttcgttagggttttaggtttcgtacgtttacccgggtcggggtaaaccgggtaacccgggaaaaggttacccgttacgtcccgggttacccttaccccgg

SEQ ID NO: 191594 - DNA, 822 bp, Homo sapiens
  misc_feature: GYAE6OF01DSLP5.35.44.D11.1.454.CMB.1.raw
tcagtacagatcgtcacgaccggtgctcgatttagcgcagtacgaagggggaccccgagccctgggactccccagctgttctgcttgctgagtcaggactgcactacagagaactctaccgatggagttcggctgagctgggtttccttgttgctatttaaagtgtccagtgtgaggtgtcgagcgtggtggaggtccgggggaggtcgttagttcgaggccgtcggggggtccctaggagactcgtccgtgtgcagcctcgtggattcaccttcagtagtcactggatgcacgtgggtaccgtacaacggttccgaagggaacggggtcgtgggttcggttcggggtttctaacggttagtttaaccggagttaggacgttaggggacttacgggaacaacgtaacgtaccgttaacggtccgggtaacttcccggttaggaacggggcccgtaacgttaccccgaccccccgttacgaacggaacgtaaccgtaaaccggtccgaaacggaaacctaaccgtaaccttaacgttaacgttaacgtacgtaaaccgtaaaagttacggtaaaccgtacgttaccgttaacgggaaccgaacgggtaccccggaacgggaacccgtaccgggtaccgtttaccggttaccgtttaaccgtttaaccgttccggttacgaaccgggtaacggtacgggttaccggtacccgttaaccgtaaacttaccgtaacgtttagggtttttacgacgttcccggttcgggtaccgggtacccggtaaacggggtaacctaacggttaccgggtcccgttaaccccggg

SEQ ID NO: 191595 - DNA, 611 bp, Homo sapiens
  misc_feature: GYAE6OF01AW9IF.35.44.D11.1.454.CMB.1.raw
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccgggggaggcttagttcagccgtgggggtcctgagactctcctgtgcagcctctggattccaccttcagtagtcactggatgctacgtgggtccgtacaacgttccgaggggaagggtctgggtgtgggttcgacgtacgttacgagtgtagtgggactgaacactaatcgtacgacgtaacgtccgtaggaacggcgtactcccacccctacgacgacgacaaccgaccaagaaccacactatntactagacaaatagaacngtacagacgacgacggtagaccgacggtctagtactagttacgtagtcgtacgaaggtacggtcgactacgtaactggtaagttgggttttagactttccgtaccggtacggggtaacccgaagggtaactaacggttcgggtcccttacccgg

SEQ ID NO: 191596 - DNA, 589 bp, Homo sapiens
  misc_feature: GYAE6OF01CTZMQ.35.44.D11.1.454.CMB.1.raw
  modified_base (322)..(322): a, c, t, g, unknown or other
  misc_feature (322)..(322): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaggtgtccagtgtgaggtgcagctggtggagtccgggggagcttagtcagccgtgggggtccctgagactctcctgtgcagcctctggattcaccttcagtagtcactggatgcacgtgggtcctacagttccgagggagggctggtgtgggttcacgtatacgngtgagtgggactagacacaatcgtacgcggtactccggtaggaacggtccacttcccacccccttcgaacggtacgaaccaacgacccaaagaaccacgaaccttatactctagacaaatcgaacagtctagaacgtacgaccggaggaccgacgggtactgttacctaattacgtgtacgacgaggtaggtcgactaactatcgtacgttggtttagacgttcgtcggtacggggacctaagggtactaacggtggtcccgtaccg

SEQ ID NO: 191597 - DNA, 687 bp, Homo sapiens
  misc_feature: GYAE6OF01BCUKU.35.44.D11.1.454.CMB.1.raw
  modified_base (260)..(260): a, c, t, g, unknown or other
  misc_feature (260)..(260): n is a, c, g, or t
tcagtacagatcgtcacgaccggtgctcgatttagcgcagtacgaagggggcccgagccctgggactcccagctgtttctgcttgctgatcaggactgcacacagagaactcaccatggagttcgggctgagcgtcggtttctgttagcctatttaaaggtgtcagtgtgagtgcagctggtggagtccggggagcttagttcagcgtgggggtcctgacgactctcctgtagcacgcctcgtggtacttccaccgttanaggttacgtacacgtggaatcggacgtacgtcggtccgtacgtaaggttccgaagggggtaacgggtcgtagggttcggtcgggtttacgaagttagtttacggagttaggagttcgggtacttacggactaacgtaagtcgtaacggcgtactaccggtaggaacgggacctaacttcccgacccctgaacgacgacaacgcaaacgaactacgactatactactagaactaaagtcgaaactcgttaccagtaacgccgacggaacgacgacggtacttacggttacctaagttaccgagttacgacggtaaggtcggtacggtaacctactaaagttccgttaaggttttgggtttactagtacccgttcgggttacggggaaaccgtaagggtaacctaacggtccggttacccgttacccgg

SEQ ID NO: 191598 - DNA, 621 bp, Homo sapiens
  misc_feature: GYAE6OF01EOAB4.35.44.D11.1.454.CMB.1.raw
  modified_base (574)..(574): a, c, t, g, unknown or other
  misc_feature (574)..(574): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctctggacttcaccttcagtagtcacgtggatgcacgtcgggtccgtcaacggttccgaaggggaaggggcgtgggttggttggggtttacacggttattacggagtgagtgggactagacacaatcgtacggcggactccggtaggaacgggccctacttcccaccccctcgaacggacgaaccaacgacccaagaaccaacaactatactctagaacaaatacgaactagtctagagacgccggaaggaccacgggtcttcgtactaagtttaccgtaggtcgacgaagggtaggtacggtactaaacaagttcgtagtttaggtttancgttccgtcggtacgggaccgaagggtactaagtcggtcctacccgg

SEQ ID NO: 191599 - DNA, 620 bp, Homo sapiens
  misc_feature: GYAE6OF01ENT3Y.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctgggtgggaggtccgggggagcttagttcaggccgtggggggtccctgagactctcctgtgcagcctctggtattccaccttcagtagtcactggatgctactgggtcctcaagttccgaggggaaggggctgggtggttgggtttcacgttattacggagttgagtgggactggacacaatcgtacgcggactcggtaggaacgggcctattcccacccccctgaacgaacgaccaacgaccaaagaaccacaactatatcagacaaatagaacagtctagagacggccgaaggaccacggcttgtactacttacgtgtagacgaaggtagggtaggtaccttaaagtaattaccgttagtttgggttttagtacttcggttaccggtacgggggtaacccgaaaggggaactaacggtcgggtacccttaacccgg

SEQ ID NO: 191600 - DNA, 618 bp, Homo sapiens
  misc_feature: GYAE6OF01D186U.35.44.D11.1.454.CMB.1.raw
  modified_base (510)..(510): a, c, t, g, unknown or other
  misc_feature (510)..(510): n is a, c, g, or t
  modified_base (557)..(557): a, c, t, g, unknown or other
  misc_feature (557)..(557): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtgggttttccttgttgcctattttaaaaggtgtccagtgtgaggtgcagctgggtggaggtccgggggaggcttagttcaggccgtggggggtccctgagactctcctgtgcagcctctggattcaccttcagtagtcactggatgcacgtgggtccgtacaaggttccgaggggaaggggctgggttggtgggtttcacgttattacggagtgagtgggactggacacgaatcgtacgcggactcggtaggaacggtcctacttcccaccccctcgacgacgaaccaacgaccaagaaccacactatactctgactaaatcgaactagtctaggacggacgccggaaggaccgacggctgttactattacgtgtnacggtaaggtaggtaccggacttacgaatccgtaagtttggttttanacgttccgtacggtacgggggtacccaaaaggggtaccctaaaggtcggtacccgtacccg

SEQ ID NO: 191601 - DNA, 543 bp, Homo sapiens
  misc_feature: GYAE6OF01AX4DC.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccggggggaggcttagttcagccgtgggggtccctgagactctcctgtgcagcctctggattcaccttcagtagtcactggatgcacgtgggtccgtcaagttccgaggggaggggctggtggtgggtttcacggtatcgagtgagtgggactgacacatctacgcggactcgagacggccgtactccacccctcagacgacaacgccaagaacacactatactctagactaaatcgaactagtctagacgagccgagacgacgctagtctagtctgtgacgaggcggtgactaactatcgtagttggtttagactcgtcggtacgggaccgaaggacaagtcggtcctaccg

SEQ ID NO: 191602 - DNA, 660 bp, Homo sapiens
  misc_feature: GYAE6OF01E3GAW.35.44.D11.1.454.CMB.1.raw
  modified_base (376)..(376): a, c, t, g, unknown or other
  misc_feature (376)..(376): n is a, c, g, or t
  modified_base (577)..(577): a, c, t, g, unknown or other
  misc_feature (577)..(577): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttttccttgttgcctattttaaaaggtgtccagtgtgaggtgcagctggtggaggtccgggggaggcttagttcagccgtgggggtccctgagactctcctgtgcagcctctggattccaccttcagtagtcacgtggatgcacgtgggtccgtcaagttccgaggggaagggggctagggtggtgggtttcacggttattacggagtgagtgggactgacacaatcacgcgactcgngaacgggcctactccaccccgtcagacgacaacgaccaaagaccacactatactctagaacaaatcgaaactagtctaggaagacggaccggaacggaccgacgggtcttacggttaccttaatttacgtcggtagtaaccggtaaggacgggtggtaacccttaaacgaactttaacgtacgtttttaggggtttttacncgtttaccggttacgggttaccgggggtaacccggaaaaggggttaacccgtaaaggtttccgggtacccgtttaaccccggg

SEQ ID NO: 191603 - DNA, 594 bp, Homo sapiens
  misc_feature: GYAE6OF01EOGH7.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctctggattcaccttcagtagtcactggatgcacgtgggtcctcgtaagttccgagggaagggtcgtgggtgttgggtttcacgtagttacggagtgagtgggactgacacaatcgtacgcggactccgtggaacgggcctatcctaccccctcagagaccaacgccaaagaacacactaatatctagacaaatacaacagtcagagacgcgaggacgacggctgtctattacgtgtcgacgaaggaggtcggactaaccgaaattaccgtaggtttagggtttgtacgttccgtacgggttcgggggaaccgtaaaggggaacttaacgtcgggttacccgtaaccccgg

SEQ ID NO: 191604 - DNA, 696 bp, Homo sapiens
  misc_feature: GYAE6OF01DL2ZR.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaattttaaaaggtgtccagtgtgaggtgcagctggtgggaggtccgggggaggcttagttcgacggccgtcggggggtccctgacgtactctcctgtgcagcctctggacttccaccttcagtagtcacgtggatgcacgtcgggtccgtactaacggttccgaaggggaaggggtcttgggtggttgggttacacgtagttacgagtgagtgggactagacactaatcgtacgcggtactcggtaggaacggccgtactacccaccccgtcaagacaaccgaacgaccaaacgaacactaactatactacgtacgaactaaaagtcgaactagtactaggaagaccggaccggaaggaaccaccgggtcttacggttaccttaatttaccgaggtacgaacggtaagggtacgggttacggtaacctaaacgtaaagttcgtttaaaggttttaggggttttacaccggttttaccggtacggggtaccggggtaaaccccgaaaagggtacctaaagggtcccgggttacccgtaacccgg

SEQ ID NO: 191605 - DNA, 653 bp, Homo sapiens
  misc_feature: GYAE6OF01DZXE1.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctaattttaaaaggtgtccagtgtgaggtgcagctggtggagtcgtgggggaggcttggcacagccgtggggggtccctgacgactctcctgtgcagcctcgtggtattctacctttagccacctagtggcatgagcgtgggcccgcgggctccggagggacggggctgggaggtgggtctacgaacttagttgagttggtagtcgcgtacaagtaaaccacgtagtcggtacgcgaacggtaccgtccgggtaggaccgggggtcccggttacaacctagtcctaccgagtaacgaactaacgttccgaaacggaacacgtctagtactactaacgaaagtcggaactaggtacaggacgaacggacccgaaggaccgtaccggttcttaatacgttaccgtggtacgaacgtaaacggttcgaaacgtaggttgacggttcggaccggtaacgggacggggtacgggtaattaggtacggtaccgtacgggtacccggggg

SEQ ID NO: 191606 - DNA, 534 bp, Homo sapiens
  misc_feature: GYAE6OF01C3A5B.35.44.D11.1.454.CMB.1.raw
  modified_base (489)..(489): a, c, t, g, unknown or other
  misc_feature (489)..(489): n is a, c, g, or t
  modified_base (516)..(516): a, c, t, g, unknown or other
  misc_feature (516)..(516): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagtcagccgtgggggtccctgagactctcctgtgcagcctctggattcaccttcagtagtcacgtggatgcacgtgggtcctcaagttccaggggaaggggctgggtgtggttcacgtattacgagtgagtgggactgacacaatctacgcgactcgtgaacggccattccacccctcagacacacgcaagaacacactatatctagacaaatgaacagtctagagagaccggagacgacggctgtctattctgtgacgaggagtgactacatgtagttggtttanacttcgtcggtcggggacctaaagggntaaagtgggtcctacccg

SEQ ID NO: 191607 - DNA, 605 bp, Homo sapiens
  misc_feature: GYAE6OF01BU6Z7.35.44.D11.1.454.CMB.1.raw
  modified_base (361)..(361): a, c, t, g, unknown or other
  misc_feature (361)..(361): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtggggggtccctgagactctcctgtgcagcctctggattcaccttcagttagtcactggatgcacgtgggtccgtcgaacggttccgggggaagggtcgtgggtgttgggtttcacggttattacggagtggagtgggactgacanaatcgacgcgactcgtagaacgggccacttccaccccctcgacgacgaaccaacgaccaaagaacacaactatactctagaacaaagtagaaactagtacctagagacgccggaagacgacgtctagtactagttactgtacgagaagtaggtggacctaacgaattcgtagtttggtttagacgttcgttacggtacggggacccgtaaaggggacgtaagtcgggtaccgtacccggttacc

SEQ ID NO: 191608 - DNA, 592 bp, Homo sapiens
  misc_feature: GYAE6OF01D1G18.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccgggggaggcttagttcagccgtgggggtccctgagactctcctgtgcagcctcgtggattccacttcagtagtcacgtggatcgcacgtggtccgtacaaggttccgaggggaagggtctggtgtggtttcacgtatacgagtgatgggactagacacaatctacgcgtactcgtagacggctatcccaccccgtcaagacaccaacgccaaagaacacgtactatactactagacaaagtgaactgtactggagacgacggaagacctaggtccgtattacgtattagtcgtacgaacgaagggtacggtcgtaacctacgtaattcgtagttttagttttagattccggttacggcggggtaaccgaaagggtactaagttcgggtcctaacccgg

SEQ ID NO: 191609 - DNA, 740 bp, Homo sapiens
  misc_feature: GYAE6OF01EJEL1.35.44.D11.1.454.CMB.1.raw
  modified_base (270)..(270): a, c, t, g, unknown or other
  misc_feature (270)..(270): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcttgggtttttccttgttgcctaattttaaaggtgtccagtgtgaggtgcagctggtggaggtccgggggagtcttagttcaggccggtgggggtcctgacgtctctccgtgtgcacgtcctgtggtacttccaccttntagtagtcacgttggatcgcgtacggttcggtaccgtacgtaacggttccggaagggggtaacggggtcgttggggttggtttcgggtttactaacggttaagttacggtaggttagaggtacgggtactaggaacctacgtaagttcccgtacggccgtaaccgttccggtaggaaccgggtaccctactttaccccgacccccgtacgaacggaaccgaaccaaccggaacccaaagaaccctaactacttaactacttacgacgaactaaacgtacgtaactacggtcgtaggaacgtcggaacccgaggaccgtacggtcttagttacttaagttacgtaggagaccgtaaggtggtaccggtacttaacgtaacttcgttaacggtttggtttacgaaccgttcggtaccgggttacggggtaaccgtaaagggtaacttacggttccggtaccgtttaacccgg

SEQ ID NO: 191610 - DNA, 923 bp, Homo sapiens
  misc_feature: GYAE6OF01EM0Q4.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgcctattttaaaggtgtccagtgtgaggtgcagcgtggtgggaggtccgggggaggtcttagttcgaggccggtgggggtccctggagacctctcctgtgccacgtcctcgtggtattccaccttcagttacgtcaacgtggatcgacctacgtcggggtacccgtacgtaaacggttcccggaagggggtaagggggtccgttggggttcgggtttacggggttttaccaacgggtttaacgtttacgggaggtttggaacggttcgggggtaaccttaggaacccgtaaccgtaaaactttccggtaaaccgggtaccgggtaacccgtttacccgggtaggggaaaccggggtacccccgtaaccgttttacccccgaaaccccccccgttaaccggaaaccgggaacccggaaacccgaaaacccgggtaacccccgaaaaacggtaaaacccctaaaccctaaaaccggtttaaacttaaaccgttacccgtaacgggaaacctaaaaagttaccggaaaaccgttaggttacccgttaagggaaacggtaaccgggtacccggaaacgggtaacccgtaaccggggtacttacgggtttaaccttagtttaacccggtaggttaacgaccggtaaagggtcgggttacggtaccttaacgtaaacgtttaccgtaaggttttgggtttacgtacgttaccgggttaccggtacgggggtaacccaaacgggggtaaacttaacggtacgggtacccgttaaccccgg

SEQ ID NO: 191611 - DNA, 796 bp, Homo sapiens
  misc_feature: GYAE6OF01CO9GZ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaattttaaaaggtgtccagtgtgaggtgcagcgtggtggaggtccgggggaggtcttagttcagccgtgggggtccctgagtactctcctgtgcacgcctctggacttccaccttcagtagtcacgtggatgacacgttcgggtaccgtacgtaacggttccggaagggggtaacgggggtcgttaggggttggtttacggggttttaccaacgggtttaacgtttaaccgggtaggttaggtaaggttacggggtaaccttacggaacctaacgtaaacgttccgtaaccgggaccggtaccgtcccggtaagggaaccgggtcccgtaactttacccccgaaccccccgttaccgaacggaaccgaacccgaaacccggacccgaaaacgaaacccaaccgtaaaccttaactaactaccgtacggaactaaaacgtacgaaacgtaagttaccgtaagaacggtaacggaccggaacggaaccgtaccggtcgttacgttaccttaacgtttacgtaggtaacgacggtaaggacgggtacgtaacgtaacctaagttacgttaaggtttaggtttacgtacgttcgtcgggtacggggaaccggtaaagggacgtaaacggttcggtaccgttacccgg

SEQ ID NO: 191612 - DNA, 1026 bp, Homo sapiens
  misc_feature: GYAE6OF01DTVEY.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagtcgttgggttttccttgttgtaccttaagttttaaaaggtgtccgagtgtgaggtgcagcgtggtggacggtccggggagtcgttagttcgaggtccggtcgggggtccctggacgtacctcctccgtgtcgcgacgtcccgtcgtacggtacttcctaccgttcgtacgttacgtcctacgtggacgtcgtaccgtacgttacggtacctaagtaccgtaacggttaccggaagggggtaacgggtcggttgggttacgggtttacgggtttaccgtaacggtttaagttaacggtaggttaggtaacggttacgggtaccgtaacggtaacgtaaaccgtaaacggttaccggtaaccgggtacccggtaacccggtttaccgggtaaacggggtaaacccgggtaccccgttaacccgttaccccccgaaacccccccgttaacggaaaccggaaaccgtaaaccccgaaaacccggtaaacccgaaaaccggtaaaacccgtaaaccccgttaaacgttaaacccttaaccgttaaccgtaaaccggtaaacgtaaaaacgttaccgtaaaacccgtaggttaccgggtaaacggaaccgggaaaccggtaacccgggtaaaccgggaaccccgtttaacgggtacccgttttaaccggtttaaccgttttaaacggttaacccggttagggttaacggtaaacccgggtaaagggttacgggtaaccggttaaacccttaaacgttaaaccggtttaccggtttaacggttttttagggtttaaccggttaaccgtttacccggggtttaacccgggggtaaaccgggtaaacccgggttaaaaaccggggttacccgttttaaacggggttcccgggtttaaacccccg

SEQ ID NO: 191613 - DNA, 592 bp, Homo sapiens
  misc_feature: GYAE6OF01EIWTO.35.44.D11.1.454.CMB.1.raw
  modified_base (370)..(370): a, c, t, g, unknown or other
  misc_feature (370)..(370): n is a, c, g, or t
  modified_base (402)..(402): a, c, t, g, unknown or other
  misc_feature (402)..(402): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggagcttagttcaggccgtgggggtccctgagactcgtcctgtgcagcctcgtggactttccgaccttcgagttagtccacgtggatgcacgtcgggtcctcgtaacggttccgaggggaaggggtcgtgggtggttcgggtttcacgttagtacggtagtgagtggactgacanatcacgcgactcgagacggccatccacccctnagacgacaacgccaagaacacatatatcagacaaagtgaactagtctagacgaggccgaggacgacggactgtactacgttacgtgttacgacgaaggtcgggtagacgttaaacagttacgtaggtttggttacgtacgttccgtacggtacggggtaccgaaggtacctaaggttccggtctacccgg

SEQ ID NO: 191614 - DNA, 663 bp, Homo sapiens
  misc_feature: GYAE6OF01EY83F.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggaggtccgggggaggcttagttcagcctggtggggtccctgagactctcctgtgcagcctctggattcaccttcagttagtcactggatgcacgtgggtccgtacgtaagttcccgaggggaaggggcttggggtgtggggtttcaacggtattacgagtggatgggactgacacatcacgcgactcgtgaacggccattccaccctcagacgacacgcaagaacacgactatatcgtagacaaatcgaactagttctcggaagaacggcccggaaggaacccgacgggtccgttacggttaccgttaaagttttaccgttgggttaacggaccggtaaagggtacggggttacggtacccgttaaagttaaaccgtttccgttaaaggtttttcggggttttttagaaccgttacgtttcggtaaccggggggtaacccaaaagggggtaccctaaagggttccgggttaaccccg

SEQ ID NO: 191615 - DNA, 843 bp, Homo sapiens
  misc_feature: GYAE6OF01CX0GT.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagtcttgggttttccttgttgtcctaattttaaaaggtgtccagtgtgaggtgcagcgtggtggaggtccgggggaggcttagttcgacggccgtcgggggtccctgacgacttctcctgtgcacgcctcgtggtattcctaccttctagtacgtacacgtaggtatgactacgtcgggtaccgtaccgtaacggttaccggaaggggtaagggggtccgttaggggttcgggttacggggttttaccaacgggtttaactttacgggtaaggttaggtaacggttagggtacctaggaaccgtaacgtaaccgttaccggttaaccgggtccggtaaccgtaccccgggtagggaaacccgggtcccgtaaccgttacccccgtaacccccgtaccgaacggaacgaaacccgtaaacccggacccaaaaacgtaaccctaaccgtacgttaaactaaccgtacgtaacgaactaaaagtcgaaaccgtagttacccgtaaggacgaaccggtacccgtaacgggacctaacgggtaccttaggttacgttaacgttaccgtggttacgtaaccgtagggtaccggttaggttaccctaaagtaccgttacgtaggttttacgggtttaacgcgttacccgggttagggtaccgggggtaaccccgtaaaaggggtaaccttaaagggttcccggttaaccccgtaacccgg

SEQ ID NO: 191616 - DNA, 591 bp, Homo sapiens
  misc_feature: GYAE6OF01AR6OR.35.44.D11.1.454.CMB.1.raw
  modified_base (515)..(515): a, c, t, g, unknown or other
  misc_feature (515)..(515): n is a, c, g, or t
  modified_base (545)..(545): a, c, t, g, unknown or other
  misc_feature (545)..(545): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcacgtgggtccgtctaacgttccgaggggagggtcgtggtggtggtttcacgttattacggagtgagtgggactgacactatcgtacgcggtactccggtaggaacgggtccgtacttcccgaccccctcgacgacgaccaacgaccaagaaccacactatactctagactaaatacgaactagtctagagacggaccggaggaccgacggtctacgttactattacgtgtagacgaaggnggtcgactaacgattcgtagtttggtttancttcgtcggtacgggaccgaagggacaacggttcggtcctacccgg

SEQ ID NO: 191617 - DNA, 769 bp, Homo sapiens
  misc_feature: GYAE6OF01BMOOV.35.44.D11.1.454.CMB.1.raw
  modified_base (655)..(655): a, c, t, g, unknown or other
  misc_feature (655)..(655): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgagtcttcgggtttttccttgttgacctaagttttaaaaggtcgtcctagtgtgagtgcagcgtggtggacggtccggggagtcgttagttccgagtccggtcgggggtccctgacgtactctccgtgtcgcacgccttcgtaggtacttacaccgttcgtagttacgtacgtacgttaggatcgtccgttacggttccgggtaccgtaacgtaacggttacccgggaagggggtaacggggtcggttcgggttcgggtttacgggtttacgtaacggtttaagttaccgggtagttaggtaacggttacgggtaacgttacgaacaaccgttaacgtaccgtaaccggacgtaccgtaccggtagggaaccggtcctaccttaccccgaacccccgtagaacggaaaccgaaccgaacccgaaccaaacgaacctacctaacgttaactacttacgacgaaactaaagtacccgaatacggtacaaggagaccgacggtaacggccgacgtctattacgtattacgngtatacggaaggtcgacgtaacttacgtaacttcggttagtttaggtttacgcgttacgggttacgggacccggtaaacggtaacggtaaccgtacgttcggttcccgtacccg

SEQ ID NO: 191618 - DNA, 723 bp, Homo sapiens
  misc_feature: GYAE6OF01DQLL3.35.44.D11.1.454.CMB.1.raw
  modified_base (602)..(602): a, c, t, g, unknown or other
  misc_feature (602)..(602): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgagtcgttgggttttccttgttgtacctaagttttaaaaggtgtaccagttgtggaggtgcgagcgtgggtggagggtccgggggagtcgttagttcgaggtcccggttgggggtccctggacgtcttcctccgtgtcgcacgtcctgtggacttcctacttcaggtactcacgttaggatcgaccgtacgtcgggtaccgtaccgaaggttaccggaaggggacgggtcgtgggttcggttacgggttcctaacggttagtacggtaggtaggtaagttggacgtacgaaccgtaataacgtccggtaacggacggtaccgtaccggtaggaacgggcccttaaccgttaccccgaaccccgacgaaagacccgaacgaaccgaaccaaagaacccaactaacgtaagtactacgaagaacctaaagtacaactagtaccgtagaaacggaccgaccggaaggtactaccggtnttacgtcttaaacgtcgagtacgacggaagcggtagaactaccgaatacgttgtttaggttcggacttccgggttacggtacgggaaccgtaaaggaaccgtacgttcgtaccggttaccc

SEQ ID NO: 191619 - DNA, 563 bp, Homo sapiens
  misc_feature: GYAE6OF01EYZE2.35.44.D11.1.454.CMB.1.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgccattttaaaaggtgtccagtgtgaggtgcagctggtggagtccgggggaggcttagttcagccgtgggggtccctgagactctctgtgcagcctctggattcaccttcagtagtcactggatgcactgggtcctcaagttccgagggaaggggctgggtggtggtttcacgtattacgagtgagtgggactgacanaatctacgcgactccgngaagggccatccacccctnaaganacaacgccaagaactacactatatctagacaaatgaacngtacngagtacgccgaggacacggtcngtactattacngtgacaaggtggtggacttaanaattcgtaagtttgggttttanacttcgtacggttacgggggaacccaaagggggaacctaagtcgggtcctaacccg

SEQ ID NO: 191620 - DNA, 763 bp, Homo sapiens
  misc_feature: GYAE6OF01DWLFR.35.44.D11.1.454.CMB.1.raw
  modified_base (748)..(748): a, c, t, g, unknown or other
  misc_feature (748)..(748): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtcgttgggttttccttgttgaccttaattttaaaggtcgtaccagtgtggaggtgcgagtcgtggtggacggtcggggagtcgttagtcgacggtccgtcgggggtccctgacgtacctcgtcgtgtcgcagtcctgtgtacttctacctttgacgttaacgtctacggtggaacgtcgtaccgtaccggtcgggttacccgtacggttaaacggggtcgggggtaacgggttcggttcggggttagggtttacgggttacctaacggtttacgtaacggtgtagtacggtacgggctacgaactacgtacgtaccggtacggcgtacgtacggacgacgtccgtaccctacccacccgtagaacgtacgtaccaaacgtaccaaacgacctacgaattacacgtctaaagaaccttagacgtaacgtacgtacgtaaggaccgacgtaaccggtacgacggtacgtcgtagttacgtagttacgtagtaccggtaagtaacggtacggttaacggtactaaacgtagttacggtacggtttttcggttaactaccggtaccggttacgggggaaacgtaacccgggttaaagggtactaacggtttacccgggtnttaaaccccggttcg

SEQ ID NO: 191621 - DNA, 765 bp, Homo sapiens
  misc_feature: GYAE6OF01C7327.35.44.D11.1.454.CMB.1.raw
  modified_base (159)..(159): a, c, t, g, unknown or other
  misc_feature (159)..(159): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
tcagtacagatcgtcacgaccggtgctcgatttagcgcagtacgaaggggccccaggccctgggactcccagctgtttctgcttgctgatcgaggactgcacacagtagactcaccatggagttcggctgagctggtttccttgtgcctatttaaaggngtacagtgtgagtncngctggtgagtccggggagcttagtcagccgtggggtcccngagcgtctcgngtgcagcctcgtgattcctactcagtcgtcacgtgagtgcacgtcgggtcctactaacggttaccggaggggtaacggggtcttgggtggttcgggttacgtacggttagttacggagttggaacgtgggtacctagaaccctaataacgtcgtaaccggtcggtaaccgtccggttaggaaacgggcccgtactttacccgaccccccgttacgaacggaaccgtaaccaaacccgaaccggaaaacgaacccgtaaactaaccttaacgttaacgtacccgttacaaacgtaaaagttacgaaacacggtaaccgttaggacgggtaaccgaccgggtaaggtacccgaacggtccgtttacggttaccttaacgtttaaccgtagttacggacgttaacgggtaggttacgggtaacctaaagtaaaccttaggttacgtttacgggttttagtaaacgttcccggttagggaccggggtaaacccgggtaaaggggtaactaaacgggttaacgggttcccgttaaacccccggg

SEQ ID NO: 191622 - DNA, 646 bp, Homo sapiens
  misc_feature: GYAE6OF01AQ8AO.35.44.D11.1.454.CMB.1.raw
  modified_base (226)..(226): a, c, t, g, unknown or other
  misc_feature (226)..(226): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctattttaaaggtgtccagtgtgaggtgcagctggtggaggtccgggggagcttagtcagccgtgggggtccctganactctcctgtgcacgccttctggtactttccgaccttcgagttacgtcctacgtgggatgcctacgtcgggtcctacgtaacggttccgagggaggggtctgggtggttcgggtttccacggttattacgagttgagtggactgacacgatcgtacgcggactccggtagaacggccgtacttccacccccctacgagtaacgacaaccgcccaagaaccactacgtatactctagactaaagtagaactacggtactacggacgaacgccgaaggaccgaaccggtcttacgttacgttattaccgtgtacgacgaaggtggttacggacctaactaagtactaaggtttggtttagtaccgttcgttaacgggtcggggtaaccaacggggtacctaacggttcggtacccgtacccg

SEQ ID NO: 191623 - DNA, 723 bp, Homo sapiens
  misc_feature: GYAE6OF01B85M2.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccagtggagttcggctgagtcgttggttttccttgttgacctaagttttaaaggtgtccagtgtgaggtgcagcgtggtggaggtccggggagtcttagtcgagtccggtggggtccctgacgaccttctccgtgtcgccgacgtccgttcgtggtacttcctaccgttagtagtacgtcgacgtgactcgacgtacgttcgggtacctacgtaacggttccggaaggggtacggtcgttgggttggttcggtttaccgtacggtttacgtttaacggagttaggtagtacgggtactagaaccgtagtaacgttacgtaaccggcgtaccggtaccggtacgggaaccggtaccctacgttacccccgacccccgtaggaacgaaaccgaaccgaaccgaaccgaaacgaaccaactaactaactacgtactacgaactaaagtacgaactagtacgtagaacgacgtacgaaggaccgacgtcgtactacgttaatcgagtacgaacgtacggtagtacgtactaactagtaccgttagtttcggttaactcggtaccgtcgggtaaccgtaacggtaacgttacgtaacgtccggttaccgtaacccg

SEQ ID NO: 191624 - DNA, 881 bp, Homo sapiens
  misc_feature: GYAE6OF01DABDQ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagtcttgggttttccttgttgcctaattttaaaaggtgtccagtgtgaggtgcagcgtggtggaggtccgggggaggtcttaaggttcgacggccggtcgggggtccctgacgtaccgttctcctgtcgcacggtcctcgtggtacttcctaccgttacagttagtaccacgtggtaatcgcctaacgttcgggtccccgttacgtaaacggttcccggaagggggtaaacgggggtcgttggggttacggtttacggggtttacctaaaccggtttagtttaaccggtaggttacggtagttacgggacctaacggaaacctaacgtaaacgtccggtaacggaccggtaaaccggtacccggttaaggaacccgggtacccgttaccgttacccccgaaccccccgtacgaacgtaaacgaaacccgtaaaccgaacccgaaaacggaaaccctaacctaaacgttaacgtaactaccgtacgaaactaaaacgtacgaaccgtagttaccgtaacggaccggtaaccggaccgggaacggtaccggtaacgggtccttacgttaacctttaaccgtttaacggagttacccggtaaggtaaggtacgggtaccgttacctaaacgttaacgttccgttaaaggttttaccgggttttacgtaaccgtttaaccgggtcggttaaaccgggggtaaacccgtaaaacggggttaccttaaaaccggtcggttaaccccgttaaacccgg

SEQ ID NO: 191625 - DNA, 844 bp, Homo sapiens
  misc_feature: GYAE6OF01DFEPQ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagctggtggagtccgggggagcttagttcagccgtgggggtcctgagactctcctgtgcacgcctcgtggacttcctaccgttcagtacgtcacgtggattgcctacgtcgggttccgtacgtaaacggttccggaagggggtaacgggggtcttaggggtcggtttggggttttaccgtaacggtttaagtttaaccggaggtttacggtaaggtagggggtaccttacgggaacctaaacgtaaacgtttccggtaaaccgggtaccgggtaaacccgttcccggggtaacgggtaaacgggggtaccccgtaaccgttttacccccgaaccccccccgtttaccgaaacggtaaccgaaacccgaaacccggacccaaaacggaaacccaaccgtaaccttaactaacttaccttaggaaacctaaaaagttccgaaaacgtacgttccgtaagggaacggaaccggtacccgggaaacgggaaccgtaaccgggtcttacggttaccgtttaactttacgtacggtacggaacgtaacgggtaggttaccggaccttaacgtaagtaccgtttagtttaggggttttagaacgtttccggttacgggtacgggggtaacccgaaacggggttactaaacggttccgggtaccttaccccgg

SEQ ID NO: 191626 - DNA, 794 bp, Homo sapiens
  misc_feature: GYAE6OF01BG27A.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgcctattttaaaaggtgtccagtgtgaggtgcagctggtggaggtccgggggaggtcgttagttcgaggccgtgggggtccctgagactctccgtgtgcacgcctctggacttccaccttcagtacgtcacgtggatgctacgtcgggtaccgtcgtacgttccgaggggtaacggggtcgttgggttggttcgggtttaccgtacggttacgttacggtaggtcggtaaggtgggtacttacggaactaacgtaaacgttaccgtaaccggaccgggtaaccgttaccggtacgggtaaaccgggtcccgtaaccgtttaccccgaccccccgttacgaaaccggtaacgaaacccgtaaacccgaccgaaaacgaaacccgtaaccgtaaaccgttaacttaaacgttacccgttaacgaaaccgtaaaacgttacggtaaactacggtttacgtaacgggtaacggaaccggaccggtaagggaacccgtacggtaccgtttacgttaaccgttacgtttacgttcggtagaaccggtaaggtacggttgtaacctacgtaattacggttagtttacggtttagtcgttccgttacggtaccgggaacgtaaacgggtacgtaacgtcggttacccgtacccgg

SEQ ID NO: 191627 - DNA, 737 bp, Homo sapiens
  misc_feature: GYAE6OF01ANK7Z.35.44.D11.1.454.CMB.1.raw
  modified_base (671)..(671): a, c, t, g, unknown or other
  misc_feature (671)..(671): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctgggtgggaggtccggggggaggtcttagttcaggtccgtgggggtccctgagactctccgtgtgcacgcctcgtggtattccaccttcgagttacgtactacgtggatcggctacgtcgggttccgtacgaacggttccgagggggaacgggggtcgttgggtggttagggtttcgtacggttagttacggaggttcgagttgggactagacaacaacgtaccgtacggccggtaacgtccggtaggaccgggtccgtactttaccccgacccccgtaccgacgaacgaacccgaaccggacccaaacggaaccaaccgaacttaacgttacgtacgtaacgaactaaagtacgaactacggttacagggtacgaccgggaccgaagggaacccgtacgggccttaggttaccttaattaccgtcggtacgacgaaagggtcggtacggtacctaacgtaacgttaccgttaggtttcgggttttancgtttacgtcccgggttacggggaaacccgtaagggtaacgtacggttcggtaccccgttacccgg

SEQ ID NO: 191628 - DNA, 693 bp, Homo sapiens
  misc_feature: GYAE6OF01AZZYQ.35.44.D11.1.454.CMB.1.raw
  modified_base (366)..(366): a, c, t, g, unknown or other
  misc_feature (366)..(366): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctattttaaaaggtgtccagtgtgaggtgcagctggtggaggtccgggggagtcttagtcgagccggtgggggtccctgacgacgttcctccgtgtgcacgtcctcgtggtacttccaccttcgagtagtcacgtggatgcacgtcgggtccgtcgaggttccgaggggaagggcgtgggttggtcggttcgtacgtagtacggagtgagtgggacngacataatcgtacgcgactcgtacgacgggccgacttcccaccccgtacacggacgaacaccgaccaacgaaccactaacgtatacgtctacgacaaaagtcgaaacgtgttacgtaggaacgggtaacgaccgggaacggaccgtaccggtcgttaacgttacttaaacgtttaccgtagtacggtaacaacggggtacggttacgaaccttaaacggtaaccgttacgttaaggttttcgggggttttaacacgtttacccggttagggtacgggggtaaacccaacggggttaaactaggttccgggttaccccgttaaccccg

SEQ ID NO: 191629 - DNA, 677 bp, Homo sapiens
  misc_feature: GYAE6OF01EQ10U.35.44.D11.1.454.CMB.1.raw
  modified_base (167)..(167): a, c, t, g, unknown or other
  misc_feature (167)..(167): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (488)..(488): a, c, t, g, unknown or other
  misc_feature (488)..(488): n is a, c, g, or t
  modified_base (654)..(654): a, c, t, g, unknown or other
  misc_feature (654)..(654): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcgttgggtttttccttgttgcctaattttaaaaggngtccagtgtgagtgcagcgtggtggaggtccgggggagtcttagtcacgccggtggggtccngagactctctgtgcacgcctntgattcaccttnagtcgtcactggatncgtacgttgggtacctacgaacggtttccggaaggggtaacggggtcgtggttgggttacggtttacaacggttattacggagtcgtagagggtacgtacaacgtacaacgttctacggacgggtaacctcggaggaacgggtcctaaccttcccaacccctcgaagaacgaacaaccgaacgaaacaacaacctactatatactacgaanaaacgttacgaaacctagtactaaggaacgacggtaacgaacggacgtaacggtcgtaacgtttacacgtttaacgttgacgaagaagggtgtaacgtactaacctagtacggttagtttagggtttataacgttacggtagtaccggggtaacgtaaacgggtanaacgttccggtaccgttaacccg

SEQ ID NO: 191630 - DNA, 800 bp, Homo sapiens
  misc_feature: GYAE6OF01BNC74.35.44.D11.1.454.CMB.1.raw
  modified_base (275)..(275): a, c, t, g, unknown or other
  misc_feature (275)..(275): n is a, c, g, or t
  modified_base (718)..(718): a, c, t, g, unknown or other
  misc_feature (718)..(718): n is a, c, g, or t
tcagtacagatcgtcacgaccggtgctcgatttagcgcagtacgaagggggccccagccctgggactcccagctgtttctgcttgctgatcaggactgcacacagagaactcacatggagttcggctgagtcgttggttttcttgttgacctaagttttaaaaggtgtctaggtgtgaggtgcagtcgtgggtgggaggtccggggagtcttagtcgaggccggtcgggggtcctgagtctctccgtgtgcacgtcctgtggacttctaccgttntagtagtcagtggatcgcctacgtcgggtacctacgaacggttacggaaggggtaagggtcgttgggttacggttacggtttacgtaacgtttaagttaacggtaggtaggaacgttacgggaaccttaaggaaacctaaccgttaacgtaccgtaaaccgggaccggtaccggtacggttaacggggaaaccgggtaccgttaacccttaccccggaacccctacgaaggaaaccgaaccgtaaccgaaccaaacgaacctaactactaagttacacgtacgaaataaacgtaagaacccgtaagttccaagggaacgaccggtaaccggaaaggaccctacgggttaacctaggttaacccttagtttaaacgtgggaacaaggaaacgggttgtacgaaaaccgttacctaaagttacgggttagttttcggggtttaanaaaccgttccgggttaaacgggacgggggtaaaaccctaaacggggtaaagtaccggttttccgggaccttaaaccccgggg

SEQ ID NO: 191631 - DNA, 877 bp, Homo sapiens
  misc_feature: GYAE6OF01D887S.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgacctaattttaaaaggtgtccagtgtgaggtgcagcgtggtggaggtccgggggaggtcttagttcagccggtcgggggtccctgacgactctcctgtgcacgtcctacgtggtactttcctaccttacgtaaggttacgtactaaccgtggtatcgacctacgtcgggttacccgtacgtaacggttaccggaagggggtaacgggtcgttgggttacggtttcggggtttaccgtaacggtttaacgttaacggtaggtttacggaaggttacgggtaactacgaactaacgtaacgtaccgtacggaccggtaccgtaccggtaggaaacgggtcccgtaaccgttaccccgaacccccgtacgaacggaacgaaacccgtaaaccgaaccccgaaaaggtaaacccctaaacccgtaacgttaacttaaccgttaaccgtaagtaaacctaaaaacggttaccggaaaaccgttaggtttaccgaacggtaaacgggtaaccggaacccgggtaaacggaacccgggtaacggttaccgtttaacggtttaacctttaaacggtttaccggttaacggtaccgggttaaacgtaaacgggtcgggttaacgaaccgtttaaacaaacgtttaccgttaagggtttttacggtttaacgtcgttccggtaacgggtaccggggaaccctaaagggtaacctaacgggttcgtaacccgttacccg

SEQ ID NO: 191632 - DNA, 794 bp, Homo sapiens
  misc_feature: GYAE6OF01AVJXY.35.44.D11.1.454.CMB.1.raw
  modified_base (678)..(678): a, c, t, g, unknown or other
  misc_feature (678)..(678): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgcctaattttaaaaggtgtccagtgtgaggtgcagcgtggtgggacggtccgggggaggtcgttagttccgacggtccggtcgggggtccctggacgtaccttccgtccgtgtcgaccgaccgtcccgtcgttggtactttcctaccttacgaaggttacgtacgaaccgtggtaactcggtaccgtaccggttcgggttaccccgtaacgtaacgggttaccggaacggggggtaacgggggtccgttggggttagggtttcggggttttaccgtaacggtttacgttaacggtagggtacggtaggttacgggacttacgaacgtaacgtacgttccggtaccggtaccggtaccgtaccggtaggaaccggtccctaacgttccccaccccgtacgaacgaacgaaccgaaccgaaccaaacgtacccaacgttacctaatacttaccgtagaaacctaagtacgaacctagtacgaggaacgccggaaccgacggaccgtacgtcgttacttaacttaccgttagnggtaacgaccggtaggtacggtacgtaactaaacgtatttacggtaggttttcggttacgagttcccgggttaggacgggtaaaccgaaggtaacacggttcgtaacccgttaccg

SEQ ID NO: 191633 - DNA, 687 bp, Homo sapiens
  misc_feature: GYAE6OF01C74CD.35.44.D11.1.454.CMB.1.raw
  modified_base (268)..(268): a, c, t, g, unknown or other
  misc_feature (268)..(268): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcgttgggttttccttgttgacctattttaaaaggtgtccagtgtgaggtgcagctggtggaggtccggggagcttagtcagccgtcgggggtcctgacgactctccgtgtcgcacgtcctcgtggtacttcaccttnagtctcacgtgatgcacgtcggtctcacgtcgagggtagggctggtgtggttcacgtatacggagtagagtggactagacactacgtcgacgcgactcggtaggaacggccgtacttacccgacccctacgaacgaacgaacccgaacgaccaaaacgaacctaaccgtaacttaactactaccgtacgaaactaaacgtacgaaacttgtaccgtaggacggtaacgacccgggaagacccgtaacggtcttaggttacccttaagttaccgtaggtacgaaccggtaagggttacggtaccggtaaactaacgttaacgtcggttaaacgttttgggttttaacgccgtttacccgggtcggtaaccgggggaaacctaaacgggtacgttaaaccggtcggttacccgtaacccgg

SEQ ID NO: 191634 - DNA, 830 bp, Homo sapiens
  misc_feature: GYAE6OF01DR3ZQ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtggagttcggctgagtcgttgggttttccttgttgtacctaattttaaaaggtgtccgagtgtgaggtgcagcgtggtgggaggtccggggagtcttagttcgaggtccggtgggggtccctgacgtaccttcgtccgtgtcgcacgtccttcgtggtacttcctaccgttcgaagttagtccgtacgtggtaactcgaccgtacggttacgggttcccgtacgtaacggttcccggaagggggaacggggtcggttagggtttggttacgggtttacgacgtttaaggttaccggtaggttagtacgtcgggtaactaggaacctaacgtaacgtaccgtaccggacggtaaccgtccggttagggaaccggtacctaaccgttccccgtaacccccgtcgaaacggaacgtaaacccaaccggaaccgtaaacgaacctaacgtaactaacgtacgttacgtaacgaacgtaaatacggtaaacgtaggttacgtaacggacgtacggaaccggaggaacccgtacgtcgttaacgtttaccgttaacgttacgtaggtagtaacgtacgggtaggttaccgacgttaaaccgtaattaccggtttagtttacggggttttaatacccggtttacggttacccgggtaacggggtaacccgttaaaacggggacttaaaaccgggttccggttaacccgtttaaccccggg

SEQ ID NO: 191635 - DNA, 587 bp, Homo sapiens
  misc_feature: GYAE6OF01EKKVC.35.44.D11.1.454.CMB.1.raw
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggagcttagttcagccgtgggggtccctgagactctcctgtgcagcctctggattcaccttcagtgtcactggatgcacgtgggtcctcaagttccgagggaggggctgggtggtgggttcacgtagttacgagtgagtgggactgacactatcgtacgcgactcggtgaacggcctattccacccccgtcagganaccaacgaccaagaccacactatactcagacaaatcgaacngtctagacgacgacgaggaccacggcttacgtacttagttactgtcgaacgaagggtaggtacggactaacgaattacgtgtttaggttttagtctaccgttacggtaggggacccgtaaacgggacttaaacggttcgggtacccttaacccgg

SEQ ID NO: 191636 - DNA, 670 bp, Homo sapiens
  misc_feature: GYAE6OF01ECB89.35.44.D11.1.454.CMB.1.raw
  modified_base (251)..(251): a, c, t, g, unknown or other
  misc_feature (251)..(251): n is a, c, g, or t
  modified_base (582)..(582): a, c, t, g, unknown or other
  misc_feature (582)..(582): n is a, c, g, or t
  modified_base (608)..(608): a, c, t, g, unknown or other
  misc_feature (608)..(608): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttttccttgttgcctaattttaaaaggtgtccagtgtgaggtgcagctgggtggaggtccgggggagtcttagttcaggccgtgggggtcctgagactctcctgtgcagcctntggacttcaccttcagtagtcactggatgctacgtgggtcctacaacggttccgaaggggagggtcgtgggttggttcgggtttcaacggttagttacggagtggagtgggactagactacaatcgtacggcggtactcggtagaacgggtcctacttacccacccccgtcgaacgaacgaaccaacgaccaaacgaaccacctaactaatactacgtacgaactaaagttacgaactagttcccgagaacgaacggacccgggaaggaccgaaccgggtcttagttaccttaattacggtagtacgacgtaaggtcggacggtaactaanaacgttcgtaagttttgggtttaacncgtttaccgtcggggtaaccggggaacgaaaggggtacctaaaggttcgtacccgtaacccg

SEQ ID NO: 191637 - DNA, 692 bp, Homo sapiens
  misc_feature: GYAE6OF01DBOSH.35.44.D11.1.454.CMB.1.raw
  modified_base (297)..(297): a, c, t, g, unknown or other
  misc_feature (297)..(297): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
  modified_base (583)..(583): a, c, t, g, unknown or other
  misc_feature (583)..(583): n is a, c, g, or t
  modified_base (598)..(598): a, c, t, g, unknown or other
  misc_feature (598)..(598): n is a, c, g, or t
  modified_base (626)..(626): a, c, t, g, unknown or other
  misc_feature (626)..(626): n is a, c, g, or t
tcagtacagatcgtcacgaccggtgctcgatttagcgcagtacgaagggggccccagccctgggactcccagctgtttctgcttgctgatcaggactgcacacagagaactcacatggagttcgggctgagtcgttcgggttttccttgttcgtcctaaagttttaaaagggtcgtcctaggttgtggaggttgcaggtcgtaggggtcgggaacgggtccggggggagtcgtttaacggttcgacgggtccgggttcggggggtccctggacggtacctccgttccgtggtcgacncggtccttcgtgtacttctaccttcgagtactcacgtgatcgcgtacggttcggtccgtagtacggttaccggaggggagggtcgttcgggttgttcgggtttacacggttagtacgtaggtggtacgtgggtacacgacaactaacgtcgtaccggacgtacgtcggtaggaacggccgtactaccctaccccgacgaaggaacaaccgaacgaacaacgaactactactacttanccaagaaccgtataacganagtgacganacgggtcgaaggacctaggtntacggtatacgttcnggtacgacgtaaggcgtacgtacctaancgttacggttgttaggttctacggtcaacggggtcggaacggtaagacgttacgtcgtacgttccg

SEQ ID NO: 191638 - DNA, 841 bp, Homo sapiens
  misc_feature: GYAE6OF01DF0BI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgaggtcgttgggttttccttgttcgaccttaagtttttaaaggtcgtaccgagtggtaggtaggtgcgaggtcgtgggtcgggtacgggtccgggggagtcgtttagttcgacggtccggttcgggggtccctggacgtaccttccgtccgtgtcgactcgtccttcgtggtacctttcctacccttagtagttacgtactacggtggactcgaccgtacggtcggtaccgtacgtacggttacgggaagggggtacggggtcgttggggttaggtttcggttactacggttaacgttcggaggtagtacgggtacggtactacgaacctaacgtacgttaccggtaacggcccggttaaccgtccgggtacggggtaaacccggtcccgttaacccttacccccgaacccccgtacgaacggtaacccgaaacccgaaccggaaacccgaaaccgtaaaccaaccttaaccgttaacgttaccgttaccgtaacgaaaccgtaaaaggttcccgaaacgttcgttaccggaagaaaccggggtcccaacgggaacgtaccgtacgttaacgttcgtttaaccttaacggttgacgtaggaacggtaggttacggtacctataacgtagttcggtttagtttggttactcggttccgggtacggtaacgggggtaacaacgggttaagttcccgggaacgtcgtttaaccccg

SEQ ID NO: 191639 - DNA, 807 bp, Homo sapiens
  misc_feature: GYAE6OF01E5QB3.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggtttttccttgttgcctaattttaaaaggtgtccagtgtgaggtgcagctgggtggaggtccgggggaggtcttagttcgaggccgtggggggtccctggacgactctcctgtgcacgcctcgtggtacttccacctttcgagtagtcacgtggatcgcgtacgtcgggttccgtacgtaacggttccggaagggggtaacgggggtccgttagggttcggtttcggggtttacctaacgggtttaacgtttaaccggaagggttaggtaaggttacggggaaccttagggaaaccctaacgtaaacgttaccggtaacccgggtaccgggtaaccgttacccgggtagggaaacccggggtcccgttaactttacccccgaacccccccgtacggaaacggaaccgtaaacccgaaaccgaacccgaaagaaacccaactaacgttaacttactaccgtacgaaacctaaagtaacgaaccgtagttaccgtaggaacgacggaccggaacggaccgacggtctaggttacttaacgtttacgtaggtacgaacgtaacgggtaggtcggtaactaaacgtaacgttacgttagtttagggttttacacgtttccggtacgggtaccggggaccgtaaacgggaactaacgggttcgacccgttacccg

SEQ ID NO: 191640 - DNA, 613 bp, Homo sapiens
  misc_feature: GYAE6OF01EQEL1.35.44.D11.1.454.CMB.1.raw
  modified_base (245)..(245): a, c, t, g, unknown or other
  misc_feature (245)..(245): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggaggcttagttcagccgtgggggtccctgagactctcctgtgcagcctntggtattccaccttcagtagtcactggatgcacgtcgggtcctcaagttccgagggagggcgtggtggtgggttcacgtattacgagtgagtggactgacacaatctacgcgactcggtagaacggcctatccaccccctcagacgaacacgacaacgaacacactatatctagactaatacgaactagtactagaagacggaccgaaggaaccacggtactacgtaccttaagttacgtaggtacgacgtaacgggtggtacgggtaccttaaacgaacgttacgtaacgtttgggttttacgacgttccgtacgggtacggggtacccgtaaagggtaaccgtaaaggttcggtacccgtacccgg

SEQ ID NO: 191641 - DNA, 792 bp, Homo sapiens
  misc_feature: GYAE6OF01CTWHS.35.44.D11.1.454.CMB.1.raw
  modified_base (271)..(271): a, c, t, g, unknown or other
  misc_feature (271)..(271): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaattttaaaaggtgtccaagtgtgaggtgcagctggtggaggtccgggggaggtcttagttcgagccgtgggggtccctgagtactctcctgtgcagcctgtcggtattcctaccttnagttacgtcacgtggatgccacgttcgggtacctacgtaacggttccggaaggggtacggggtcgttgggttggttcgggtttacacggtttagttacgaggttagtaggtagggacctaggaaccaactaacgttcgaccggtaccggtaccgtacggttacggaaccggggcctaccttacccgaccccccgtagaacggaacgaaccaaccgaccaaacgtacccaacgtactaacgtactaactcgaaacctaaagtcggaaactacggtaccgtaggaaccggacggaaccccggaaggtaaccgaccgggtacctttaccgttaacgtttaacccggtttgtaacggttacgtaaccggaacggttcgggtaacggtacccttaaacgtaaaccgttgtttaaacgggtttgggtttttaacggtacctttacccggttccgggggtaaacggggtacccggtaaaaacgggggtactttaaaacccgggtcgggttaacccccgtttaccccgg

SEQ ID NO: 191642 - DNA, 749 bp, Homo sapiens
  misc_feature: GYAE6OF01B0J90.35.44.D11.1.454.CMB.1.raw
  modified_base (664)..(664): a, c, t, g, unknown or other
  misc_feature (664)..(664): n is a, c, g, or t
tcagtacagatcgtcacgaccggtgctcgatttagcgcagtacgaagggggccccagccctgggactcccagctgtttctgcttgctgatcaggactgcacacagagaactcaccagtggaggttcggctgagtcgttgggttttccttgttgacctaagttttaaaaggtgtccaggtgtgaggtgcagcgtgggtgggacgggtccgggggaggtcgttagttcgacggtccgggtcggggggtcctaggacgtaccttccgtccgtgtcgtaccgtacgtccgttcgtgggttacttccgtaacccgttcgtagttacgtacgtacgtaggatcgtaccgtacggttcggggtaccgtacgtaaccggttaccgggaaggggtacggggtcggttgggttcgggtttcggttacggtaagttagttacggtaggtggtaggtcgggacgtacgaactaactaacgtacggtaacgacggtacgtacggtacgggaccggaccgtacctaccccgacccgtacgaacggaaccaaccgaaccgacaaaccgtacaactactaactactacgacctaagtaaacacgtaactacggttacaaggacggaccgacggacgtacgcggtactacgttatacgtgttacgacgtaagagtacgggntaacgtacgtaacttgttaagttggtttacgacgttcggtaacgggtacgggtaacgtacggtaatcgggttaccgtccgttacg

SEQ ID NO: 191643 - DNA, 806 bp, Homo sapiens
  misc_feature: GYAE6OF01EFJ7Y.35.44.D11.1.454.CMB.1.raw
  modified_base (183)..(183): a, c, t, g, unknown or other
  misc_feature (183)..(183): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgagtcgttgggttttccttgttgtacctaattttaaaaggtgtccagtgtgaggtncagcgtggtggaggtccggggagtcgttagttcgaggtccgtggggtccctgacgtacctcctcctgtcgccacgtcctcgtggtacttacctaccgttacgtacgttaacgtctaacgtggtaacgtcgacgtacggttacgggttacccgttaacggtaaaccggttaccgggtaagggggtaacgggggttccgtaggggtttacggttaacgggtttaccgtaacggttaacggttacggtaggttaggacgttgggtacgtaacgaacgtaacgtaactacccggtacggtaccggtacgtaccggtacggaaccgggtaccctacctacccgtaccccgtacgaacgtaaacgaaccgaaaccgtaaccgaaacgtaaccctaacgtaacctaacgtttaacttaccgaacgtaaacgtaaactaaccgaagtccgtagtaacggaacgtacggacgaacggtaccgacgtcgttagtaaccgttagttaccggtaggtactaacggtacgtacggtagtacgtaactaaagtttccgtagttttacgggtacttcgttacggttaccgggaacgggtaactaacgggtaaccctaggttcccgtacccggttaccg

SEQ ID NO: 191644 - DNA, 1037 bp, Homo sapiens
  misc_feature: GYAE6OF01EC85M.35.44.D11.1.454.CMB.1.raw
  modified_base (863)..(863): a, c, t, g, unknown or other
  misc_feature (863)..(863): n is a, c, g, or t
tcagtacagatcgtcacgaccggtgctcgatttagcgcagtacgaagggggccccagccctgggactcccagctgtttctgcttgctgatcaggaatgcacacagagaactcacagtggagttcggctggagtcgttgggtttttccttaggttcgtaccttaaagtttttaaaagggtcgtaccgtaaggttggtaggtaggtagccgaggtccggttggggtacggggtaacggggtcccggggggaggttacgtttaaggttccgacggtcccggggttggggggtaccctggaacgtcctcgtccgtagtcgaccacggtccttacgtggtacttccgtaaccttagtagtacgtacgtacggtgtagtccggccgtacggttccgggtaccgttaaccggtaaccggttaccggggaaagggggtacggggttccggttaggggtttcgggtttaccgggttaccgttaaccggtttaaggttaacggtacggtagggtaacgggtttacgggaacttaacgaaccgttaaaccgtaacgttaacccggtaaccgggtaacccggtacccggttaaccgggtaacgggtaaccccgggggttaccccttaacccggttaccccccctaaaccccccgttaaccggaaaccgggtaacccgaaacccggaaaccccgtaaacccggtaaaaccgaaacccttaaccgtaacctaacgttaacgttaccgtaaacgtaaaccgtaaagttaaccggaacgttaacggtaccggtaaacggtacgggaacccggacgggtaacccggtaacggttacccggtaccgtttacggtttaaccgtttaacgggttttaaaccgngggttaaccgttaacggaaacgggttacggtacgttaaaccgtaaaccgttaacgtttaacggttttagtttacgggttttacgtaccggtttaccgggttacccgggaccgggggttaaaaccggtaacgggttaaaccgtaccgggtttaccgttcccccgggttaaacccg

SEQ ID NO: 191645 - DNA, 684 bp, Homo sapiens
  misc_feature: GYAE6OF01CNDKS.35.44.D11.1.454.CMB.1.raw
  modified_base (125)..(125): a, c, t, g, unknown or other
  misc_feature (125)..(125): n is a, c, g, or t
  modified_base (213)..(213): a, c, t, g, unknown or other
  misc_feature (213)..(213): n is a, c, g, or t
  modified_base (397)..(397): a, c, t, g, unknown or other
  misc_feature (397)..(397): n is a, c, g, or t
  modified_base (533)..(533): a, c, t, g, unknown or other
  misc_feature (533)..(533): n is a, c, g, or t
  modified_base (605)..(605): a, c, t, g, unknown or other
  misc_feature (605)..(605): n is a, c, g, or t
  modified_base (635)..(635): a, c, t, g, unknown or other
  misc_feature (635)..(635): n is a, c, g, or t
tcagtacagatcgtcacgaccggtgctcgatttagcgcagtacgaagggggccccagccctgggactcccagctgtttctgcttgctgatcaggactgcacacagagactcacatggagttcggntgagtcgttggttttccttgttgtaccttaaagttttaaaggtcgtctaggtgtggaggtgcgagcgtggtgggacgggtccgggggngtacttagtcgacggtccggtgggggtccctaggacgtccttcgtccgtgtcgcgacgtcctacgtggtacttcctaccttgacgtacgttcacgtggactcgtacgtacggtcgggtacctacgtaacggtaccgggaaggggacgggtcgttgggtggttcggttacgtacgttagtacggngtagaggtcggactagaacagaccttacgacggaccgtcgacggtaggaacccggtacgtaccgttcccccgacccctaagaacggaacgaccaccgaacgtaacaacactactactactcaacgaactaaagtanaacttagactaggacgtaaccgacggaacgaacgtcgtactacgtacttaagttccgtagtacgacgtaagngtacgaactagtatgtttaaggtgtttacncgtttacggacccgggaggtaaccgtaagaccgtacgttggcccttacg

SEQ ID NO: 191646 - DNA, 709 bp, Homo sapiens
  misc_feature: GYAE6OF01DTIFR.35.44.D11.1.454.CMB.1.raw
  modified_base (201)..(201): a, c, t, g, unknown or other
  misc_feature (201)..(201): n is a, c, g, or t
  modified_base (444)..(444): a, c, t, g, unknown or other
  misc_feature (444)..(444): n is a, c, g, or t
  modified_base (560)..(560): a, c, t, g, unknown or other
  misc_feature (560)..(560): n is a, c, g, or t
tcagtacagatcgtcacgaccggtgctcgatttagcgcagtacgaaggggccccagccctgggactcccagctgtttctgcttgctgatcaggactgcacacagagaactcaccagtggagttcggctgagtcgtttcgggttttccttgttcgaccttaagttttaaaggtgtcctaggtgtgaggtgcgagtcgtgggnggacgggtccgggggagttcgttagttcgaggtccggtcggggtcctggacgtaccgttcctacgtgtcgtaccgaccgtccgtcgtagtactttacctaaccgttcgtaacggttacgtaccgtacgtaggtacgtcgtacggtaccggttcggtaccgtagttaacggtccgggaaggggtacgggtcgttgggttcggttacggttacgtacggttacgtacggagttagacgtgtacgnacacgtacgtacgtaccgacgtcgtaccggtaaggaccggacctacctccctacccgacaagaccgaaccgacgaaccacaacctactacgtatgtactagaactaactagtaacncgtacgtagacgtacgacggacgacgtcgtacgttactacttcgtacgtgtacgacggagtaccggataccgtagagttcgtagtttagttacgtacggttcggtaccggtcgggtaaaccgtggaaccgtttgccgtccgttacccgg

SEQ ID NO: 191647 - DNA, 680 bp, Homo sapiens
  misc_feature: GYAE6OF01A7KP0.35.44.D11.1.454.CMB.1.raw
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagctggtggaggtccgggggagcttagttcagccgtgggggtccctgagactctcctgtgcagtcctctggtacttccaccttcaggtagtcacgtggatgaccacgttcgggtccgtataacggttccggaagggggaacggggtctggggttggtgggttttcaacggtttattacggtagtggtagtgggacttagaactacaagtcgtaccgcggaccgtaccggtagggaaacggcccgtacgtcccctacccccgtcgaaaggaccaaccgaaccgaccaaacgaaccactaacttatactctagaacaaatcgaacncgttagacgacgacgacccggaagaccgacggcttacgttacttaagtttacgnggttacgaggtaagtacgggtacgtactaacgaacttacgtaggtttacggttttacgcgtttaccggtacggtacgggggtacccgtaaaggggtaacctaggttccgggtactaccccggg

SEQ ID NO: 191648 - DNA, 968 bp, Homo sapiens
  misc_feature: GYAE6OF01CSM52.35.44.D11.1.454.CMB.1.raw
  modified_base (107)..(107): a, c, t, g, unknown or other
  misc_feature (107)..(107): n is a, c, g, or t
  modified_base (128)..(128): a, c, t, g, unknown or other
  misc_feature (128)..(128): n is a, c, g, or t
  modified_base (899)..(899): a, c, t, g, unknown or other
  misc_feature (899)..(899): n is a, c, g, or t
  modified_base (933)..(933): a, c, t, g, unknown or other
  misc_feature (933)..(933): n is a, c, g, or t
tcagtacagatcgtcacgaccggtgctcgatttagcgcagtacgaagggggccccagccctgggactcccagctgtttctgcttgctgatcaggactgcacacaganaactcaccagtggagttcggntgagtcgttgggtttttccttgttgtaccttaaagttttaaaaggtcgtacctaggttggtaggtaggtgaccgtaggtcggttagggtacgggtacggggttaccgggggtagtacgtttacggtaccggtacgggtcccgggtcggggggttccctaggaccgtaccgttccgttccggtggttcgccgtacgtcccgttagtcggttactttaccgtacccgtttaacgtacggtttacgtaccgtaacgtacgggtactacggtacccggtaccggtttaccggggtaacccgtaaccggttaaccgggttaccgggaaacgggggttaacggggtccgttttaggggtttaccggtttacgggttttacccgtaaaccggttttaaggtttaaccgggtaggtttaacggtacgggttaccgggttaaccgaacgtaacccgtaaacgttaccgttaaccggtaaccgggtacccgtttacccgggtaccggttaacgggaacccggtacccggttaccctttacccccgaaaccccgtagaaacggaacccgttaaacccgaaaccgtacccgaaaaggtaacccctacggaaaccttttaaccaacggtttaccgtaagtaaaccgttaaacgtaaccggtaaccgttggttaacgacggggtaacgaacccgggttaaccgaacgggttacccgtacggtttacctagggttaaccttaagtccggtacggtacgaagtacggtaagtacgtaccttaaagtnttacgttaagttgtactaacggttcggtaacggnggaaccgtaaggtacgttagccggtaccttaccgg

SEQ ID NO: 191649 - DNA, 783 bp, Homo sapiens
  misc_feature: GYAE6OF01BBD5W.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgacctaattttaaaggtgtccagtgtgaggtgcgagcgtgggtgggagggtccgggggaggtcgtttaggttccgacggtcccggtcggggggttccctaggacgtacctccttccgttggtcgccgaccgtccttcgtggtacttacctacctttacgaggtacgtcacgttggatgctacgttcgggtaccgtacgtaacggttaccggaagggggtaacgggggtcgttggggttggtttacggggtttttaccgacggtttaaggttaaccgggtagggttaggtaacggttacggggtacgttacggaacgtaacctaacgttaccggtaaccggcgggtaacccgtcccggtaaggaaccggggtccctaaccgttccccaaccccccgtcgaacggaccgaaccgaacccgaaccaaacggaaacctaacaccgttaatacgtactacgaaacaaagtacgtaacgacgttacgtacggaacggaccggacggaacggaccgtacgggcctttagtacctttagttacgtacggtagacgagggtaggtacggactacgtagttacgtaggtttgttaggacttggtacggacgggtaacgaggtaagtcgtcggtccgttacccg

SEQ ID NO: 191650 - DNA, 818 bp, Homo sapiens
  misc_feature: GYAE6OF01DFKHF.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccagtggagttcgggctgagtcgtttgggtttttcctttgttcgtaccgttaaagtttttaaaggtcgtaccgtaggttggtggtaggtgtcgtacggtcgtggggtagggtacggggttccggggggtacggtacgtttacggttccgacgggtcccgggttcgggggttccctaggtacggtaccttccgtccgtgttcgcctacgtccttgtcggttacttcctaccttacgtacgttacgtctcgtaggtacgcgtaccgtcggttcggtccgttaccgtaacggtccgggaaggggtacgggttcggttgggttagggtttcggtttacgtacggtagttacggacgttagaggtggtactagactaactacgtaccgtaaccggacgtaccggtccggtacgggtaaaccggtcccgttaacccgttacccccgacccccgtacgaacggaaccgaaccccgtaacgaacccgaaacgtaccaacttaacctagtactaccgaacgaactaaacgtcgaactgaacgtcgaaggaccgtacgacggacgtcggtcctttagtactttacgtaggtcgtacgaacggtaggaacgttaacgtagttaaacgtgtttacgttagtttagtaccttcgggaccgggttaacgggaacggtaacgggtaacgttacggtcccgttaacccgggtcttaacccgg

SEQ ID NO: 191651 - DNA, 752 bp, Homo sapiens
  misc_feature: GYAE6OF01C5K3L.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgcctaattttaaaaggtgtccagtgtgaggtgcagcgtgggtgggaggtccgggggaggtcttagtcgaggccgtgggggtccctgacgaccttctcctgtgcacgcctcgtggattcctaccttcaagtacgtcacgtggatgacacgtcgggtccgtacgaacggttccggaagggggtaacggggtcgttggggttcggttaggggtttaccgaacggttagtttaacggtaggtagtacggtacgggtactaggaaccaataacttcgtaaccgggcgtaaccgtccggtagggaacgggtccgaccgttaccccacccccgttagaacggaacgaaccgaaaccgaccgaaacgaaacaccgtaacttactaactcgtaacgaactaaaagtcgaaacgtagttacctaggaacgaaccggaccgggaacggaccgaacggtctacggttacttaagttacgtaggtacggaacgtaagggaggttacgggacctaaacgtacgttacggttaagtttaggttttacgtacgttccggttacgggacgggtaaaccggtaaaggtaccgtaaaggttccgggtaaccgttaaccccg

SEQ ID NO: 191652 - DNA, 632 bp, Homo sapiens
  misc_feature: GYAE6OF01DDZ4D.35.44.D11.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
tcagtacagatcgtcacgaccggtgctcgatttagcgcagtacgaaggggccccagccctgggactcccagctgtttctgcttgctgagtcaggactgcacacagagaactcaccatggagttcgggctgaggcgttgggttttccttgttgccattttaaaaggtgtccagtgtgaggtgcagctggtggaggtccgggggagcttagtcagtccgtgggggtcctgagaccttctcctgtncagcctntggattcncttnagtatcacgtggactgcactggtactatcaaggttccgagggggtacggnttgggtgttacgggttcacggttagttcgagtgagtggactgaacactagtcacgcgctcgtaggacggctactccnccccgtnagacaccgaacacaaacgactaacgactatactcgtacgaactaagtacgaactacggtcgtaggaccggacgaccggaacgggaccgtccggtacgttacttcgttaacgttacgtggtacgacgaaggttacggtacgacttaaggtaaactttcgtaggttttaggtttacgtacgttccgttacggggtacgggttacccgaaagggtaacctaacgggttcggtaaccccg

SEQ ID NO: 191653 - DNA, 600 bp, Homo sapiens
  misc_feature: GYAE6OF01AJEKR.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgtagcctctggattcaccttcaatatgtatagcatgacctgggtcccgccaggcctccgtggggaaggggctggagtgggtctcatctagttggaagtagttgttgtttatactattattagtggagacggcggggtggggggccagttcacctatcctccagacgacaacgaccaagaacactctagtcctctcgcactatagaaccaggttccgtagggtacctaggacggaccgacgggtctcgttacttacgtttacgtggtacgaggagtagtagtaacgtaaagttacgttaggtacgtacgttaggtacgcgttacggtttacgtacgtttaccggtttcttttttcgtaacgg

SEQ ID NO: 191654 - DNA, 835 bp, Homo sapiens
  misc_feature: GYAE6OF01C4EIR.35.44.D11.1.454.CMB.1.raw
  modified_base (431)..(431): a, c, t, g, unknown or other
  misc_feature (431)..(431): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttctgtgctatttaaagtgtcagtgtgaggtgcagcgtggtaggcggtccgggggagtcttagtcgaggccggtgggggtcctgacgctctctgtcgcagtcctgtgtacttacaccttagaggtactcagtggatgcgtacgtcggtacctacgtaacggtcggaaggggtacgggtgttggttcgggttggtttaccgacggttaagttacggaggttaggaggttacgggactaggaacaacgtacgttacggtaccggaccggtacgtacggtagggaaccgggtaccnccgttaccccgaccccgacgtaacggaaccaaccgaaacccggaccaaaacgttaaccaaccgtaaccgttataacttacccgtaaagaaacccgggtaaataccggtaaaacccgtggttacccgggtaaagacccgggaaaccgggtttacccgggaaagggaacccgggtaacccggttaacctttagggtttaacccttaaaggttttccggtaagggtaacccggtaacgggaagggtttacggggtaaccgttaactaaacccgggtaaatttcgggttttaaacggtttacggttttaaacgcccggtttaaccgggttaccggggggaaacccgggtaaacgggtaaaacccggtaggtttaaaccccggtcggggtttaaaaccccgttcccccg

SEQ ID NO: 191655 - DNA, 917 bp, Homo sapiens
  misc_feature: GYAE6OF01BHU3W.35.44.D11.1.454.CMB.1.raw
  modified_base (250)..(250): a, c, t, g, unknown or other
  misc_feature (250)..(250): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagtcgttgggttttccttgttcgtacctaagttttaaaggtgtctagtgtgaggtgcagcgtggtggacgggtccggggagtcttagtcgacgcggtcggggtcctgacgactctcgtgtncgacgcctgtcgtacttccgtaccttcgtagtacgtacgacgtaggagtcgtaccgtacggtcgggttaccgttacggtaaccggttaccgggaagggggtaacgggggttcggttgggggtttcggttcggttttaccggtaacgtttaacggtttacggtagttaggtaacggtcgggtaacgtacgtaaccgaacgtaccgtaccggtaaccgggtacggtacccggttacggtaacgggaaccgggtcccgttaacccgttaacccccgtaccccccgttaaccggaaaccggaaccgtaaacccgtaaaccgaacccgtaaaaccgtaaaccaaacccgttaacttaaacgtaaccttacgaacgaaaccgttaaaagaccgttaaacgtaacggttaccgaacgggtaaccggaaacggtcccgggtaaaagggaccccggttaagtccccgtttaaaggtttaacccttaacggtttaccggttacgtacggtaaccgggttaaaggggtacccgggttaaagaacccgttaaccgttaaaccggtttaggttaaaccgtttttgggtttaccgtttacgttacccggggttacgggtaaccggggtaaccgttaaaaggggttaccgaacgggtttttaaccgcccccggttaacccgg

SEQ ID NO: 191656 - DNA, 567 bp, Homo sapiens
  misc_feature: GYAE6OF01EBSXS.35.44.D11.1.454.CMB.1.raw
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtcagtgtgagtgcagctggtggagtccgggggaggcttagttcagccgtgggggtccctgagactctcctgtgcagtcctctggtattccaccgtttcagtagtcacgtggatgcatggtcctanagtccagggaggctgggtgtgggttcagtattacgngtgatgggactgacacaatcagcggactcgtagaaggccaatcacccctnagagacaacgccaagaacacactatactctgacaaatgaactagttcagagacgaccgaggacgacggcgtagtctaacttactagtcgacaaggtaggtcggaactacgaaagttcctaagtttaggttttggacttcgtacggtacggggtaaccgaaagggtaaccctaaggttccggtcctacccggg

SEQ ID NO: 191657 - DNA, 610 bp, Homo sapiens
  misc_feature: GYAE6OF01DZ99A.35.44.D11.1.454.CMB.1.raw
  modified_base (348)..(348): a, c, t, g, unknown or other
  misc_feature (348)..(348): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagccgtgggggtccctgagactctcctgtgcagcctctggacttcaccttcagtacgtcacgtggatgcacgtggtcctcaagttccgagggaagggctgggtgtgggtttcacgtattacgagtgagtgggactgacanaatcgacgcggactccgtaggaacggcctacttcccacccctcgaagacgaaccaacgaccaaagaccaacaactatactactagactaaagtacgaactagtactagacgacgccggaaggaccaacgggctacgttacgttaagttaccgtaggtacacgtaaggtggtacgtactaacaagttcgtagtttgggttttacacgttccgttcggacggggtacccgaaaggggtacctacggttgggtcccttaacccgg

SEQ ID NO: 191658 - DNA, 704 bp, Homo sapiens
  misc_feature: GYAE6OF01EHRQE.35.44.D11.1.454.CMB.1.raw
  modified_base (190)..(190): a, c, t, g, unknown or other
  misc_feature (190)..(190): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgccaattttaaaggtgtccagtgtgaggtgcagctggtggngtccgagggagcttagttcagccgtgggggtcctgagactctcctgtgcagcctctggattcaccttcagtacgtcacgtggatcgcacgttcgggtcctacgaacggtttcccggaagggggaacgggggtcgttaggggttgggttggggttttaccgaacggtttagttacggtagttggagttggggaactggaacactaatccgacggcgacgtcccgtaggaacgggccctattaccccgacccccgttcgaacgtaacgaaccgaaccgaccccgaaagaaacccaaccaaccgttaatacttaccgtagaacctaaacgtacggaaaccgttaagtaccgtaggaaccggaggtaacccggaacgggtaacgaccgggttcttaggttaccttaagttaccgtgtaacgtacggaaagtggtagtacctaataacgttctagtttaggttttgacgttcgtacgggttacgggaacccgaaagggtacctaaagttcggtaacccg

SEQ ID NO: 191659 - DNA, 871 bp, Homo sapiens
  misc_feature: GYAE6OF01E46VH.35.44.D11.1.454.CMB.1.raw
  modified_base (588)..(588): a, c, t, g, unknown or other
  misc_feature (588)..(588): n is a, c, g, or t
tcagtacagatcgtcacgaccggtgctcgatttagcgcagtacgaagggggccccagccctgggactcccagctgtttctgcttgctgatcaggactgcacacagagaactcaccagtggagttcggctgagtcgttggttttccttgttgacctaagttttaaaggtgtcctagtgtgaggtgcagtcgtgggtgggagggtccgggggagtcgttagttcgacggtccggtcgggggtccctagacgaccgttcctccgtgtacgccacgtccttcgtacggtaccttaccgttacccttcgaacgttacgttaccctaggtcggtatcggtaccgtaccggttccgggttaccggttaaccggtacggggttaaccccggggggtaaggggttcggttggggttcggtttacgggtttaccgtaacggtttacgttaacggtaggtaggtaggtacgggtaacgtaccgaaactacgtacgtaccggtacgacggtaccggttacggacggaccggtaccgtacctaccccgtacccaccgtagaacgaccgaacccgacaacgaacaccgtaacttaacacgtnaacgtaaactaacgtaataaacccgtggttagaacgtaacgggacccggacgggtaacgtaaccgggtaaccgtccgttaagttaaccccttagtttaaccgtcggttaaggaacggaacggggttaccgttaacggaccttaacgtaaacggttaccgttttaaacggggttttcggtttaaccgttccggttaacccgggttaccgggtacccggggggtaaaccgtaacggggtttaaactaccgggtttccggtaaaccccgttccgttttaaccccgg

SEQ ID NO: 191660 - DNA, 623 bp, Homo sapiens
  misc_feature: GYAE6OF01CLKA0.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgcctaatttttaaaaggtgtccagtgtgaggtgcagctggtggaggtccgggggagtcttagttcagccgtgggggtccctgagtactctcctgtgcacgtcctcgtggtacttcctaccttcagttacgtcactggatgctacgtcggtccgtacgaacgttccggaggggagggtcgtgggtgttgggttcacgttatacgagtgagtgggactgacactacgtcacgcgtacgtcgtaggacggcctacttcccacccctacgagaacgaccaacgaccaaagaaccactactaatactctacgaactaaatcgaactagtaccgagacgacgaccggtaaggaccgacggtcttagtactaagttacgtgacgaacgtaggtaggtcgactaacgtaattcgttagtttggtttacacgttcgtacggtacgggaaccaaagggttactaacggttcggtcctacccgg

SEQ ID NO: 191661 - DNA, 771 bp, Homo sapiens
  misc_feature: GYAE6OF01CH6EK.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccggggagcttagttcgagcgtgggggtccctgagactctcctgtgcagtcctcgtggacttcgaccttcagtagtcactggatgccacgtcgggtccgtacgaacggttccgaacggggaaggggtcgtggttggttcgggtttactaaccggttagttaacgaggttagagtacgggtactaggacaacgtaactacgtaacggacggtaccgtaccggtaggaaaccgggtccgtaccttaccccgacccccctacgaaggaaccgaacccgtaaccggaacccaaaacgtaaccaaccgtaacttaactaacttaccgtaacgaacctaaaacgttaacgaaacggtaacgttaccgtaaggaacggaaccgggaacccgggaaggaacccggacggtaccgttaggttaacctttaaggttacccgttaggtacgtaaaccgggtaagtaccggggtacgaacccttaaacgtaaacttcgtaaagttttgggttttaacgtaccgttccgttaccgggacgggggtaaccgtaaacgggtaacttaacgggtccggttacccgttaaccccgg

SEQ ID NO: 191662 - DNA, 813 bp, Homo sapiens
  misc_feature: GYAE6OF01BPG0E.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtggagttcgggctgagtcgttcgggtttttccttgttcgaccttaaagtttttaaaaggtcgtaccgaggttggtggtaggtgcgagtcgtgggtgggacgggtcgggggagtcgtttaggtcgacggtccgggtccgggggtcctggacgtaccttcgtccgtggtcgacgtcgtccgtgtcgtactttcgtacttcgtagttacgtctacgtgatcggcgtacggttcggtacgtacgtacggtacgggaggggtagggtcgttgggttggtcggttctacggttagtacggtagtgaggtcggacgagaactagtaccgtacggacgtaccgggtacgttaccggaacgggtaccggtaaccgtacccttaccccgaaccccgtacgaaacggtaaccgaaccgaacccgaacgaaacgaacccgtaactaccgtaacgttaactaacgtaacggaactaaacggtaccgttaacgtacgtaacggtaagggaacgtaaccgggaccggaaaccggacgtaaccgggttctaaccgtttaccgtacgtttaccggtagtaacgggaacgggtaggtaacgggttactaacgttaaacttaacggtttcgttagggttttcggttaagtaccggtcgggtaacggtaccgggtaaaccgaacggttaacggtacgtccggttaaccgtccccgg

SEQ ID NO: 191663 - DNA, 752 bp, Homo sapiens
  misc_feature: GYAE6OF01ENAE7.35.44.D11.1.454.CMB.1.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (622)..(622): a, c, t, g, unknown or other
  misc_feature (622)..(622): n is a, c, g, or t
tcagtacagatcgtcacgaccggtgctcgatttagcgcagtacgaagggggccccagccctgggactcccagctgttctgcttgctgatcaggactgcacacagagaactcaccatggagttcggctgagtcgttgggtttttccttgttcgacctaattttaaaggtgtccgagttgtgaggtgcagcgtggtggacgggtccggggaggtcttagtcgagccggtcggggtcctgacgctctcgtgngcncgtctgngtactcctccgtnagtacgtcagtgatcgctacggtcggtaccgtactacggtaccggaggggtacgggtcgttgggttcggttacggttaccgtacgttacgtacggtagtaggtacggtacgggtaacgtacgaacgacgtacgttccgacggtaccggtaaccgtacggacggacggtacccgtacctaccccgtacccccgtacgtaaggaaccgaaccgaaccggacaaacgaacctacgtaacgtaacttacctgtaacgtaactaaacgggttacaacgtaacgtacgacgaacgacggacccggaacgtaccgtcggtacgtttggtaacgtttagttacgcggtaaaccggtanaaacggttactaagttaccgtaccggttaaccgttaacgttacgtttaccggtaggttaaccgttaaccgggaaattttaacgttaaacgtccgttaaggttaccgttaacgttccgggtaaacccgggg

SEQ ID NO: 191664 - DNA, 691 bp, Homo sapiens
  misc_feature: GYAE6OF01AYBSR.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccatggagttcggctgagctgggttttccttgttcgcctaagttttaaaaggtcgtccagtgtggaggtgcagcgtgggtggaggtccggggaggtcgttagttcgaggtccggtcgggggtccctgacgtactcgtccgtgtgcacgtcctacgtgtacttccaccgttcgagttacgtctacgtggatcgctacgtcggtcctacgtacgttaccggagggacgggtgtcggttcggttaggtttcgtaagttacgtacgaggtcgtaggtacgggtactagtaacaactacgtacgtacggtacggtactccggacgtacgggtccgtaccgttacccaccccgtacgaggtaccgaaccgaaccgaaccgaacgaaccaactactacgtactcgtacgtaacgaactacgaacgtacgtacgtagacggacgacggacgaccgcggtactgtacttacgttaaccgtgaacggactaggcggttacggtactaaacgtagtacgttcgtttaggttcgacgttcggtacggttacggggaaccgtaacggtaccgtaggtccgttaccgtaccgg

SEQ ID NO: 191665 - DNA, 593 bp, Homo sapiens
  misc_feature: GYAE6OF01DL3IN.35.44.D11.1.454.CMB.1.raw
  modified_base (366)..(366): a, c, t, g, unknown or other
  misc_feature (366)..(366): n is a, c, g, or t
  modified_base (440)..(440): a, c, t, g, unknown or other
  misc_feature (440)..(440): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggggctgagcttgggttttccttgttgcctattttaaaaggtgtccagtgtgaggtgcagctggtgggaggtccgggggaggcttagtcagccgtgggggtccctgacgactctcctgtgcacgcctctggacttccaccttcagtgtcacgtggatcgcacgtgggtctgtacacggttccgaggggaggggcgtgggtggttgggtttacacgttagtacggagtgagtggactgacanatcgacgcgactcgagacgggctactccacccctcgacgacgacaacgaccaacgaccaactactatactctanacaatacgaactagtacgagacgacggaccgaggacgacggctacgttacttattacgtgtagacgtaaggtagggtacgactaacgtaatcgtagtttggttttcacgttcgtacggtcggggaacgtaacgggactacggttcggtacccg

SEQ ID NO: 191666 - DNA, 904 bp, Homo sapiens
  misc_feature: GYAE6OF01DP6WK.35.44.D11.1.454.CMB.1.raw
tcagtacagatcgtcacgaccggtgctcgatttagcgcagtacgaagggggccccagccctgggactcccagctgtttctgcttgctgatcgaggactgcacacagagaactcacagtggagtcggctgagtcgtttggttttccttgttcgtaccttaagttttaaaggtcgtaccgtaggtgtggaggtgcgtacggtcggttgggtacgggtacggggttccgggggagttcgtttaacggtcggtacggggtcccggggttcgggggtcctaggtaccgtaccgttccgtcgtgtcgaccgtaccgtccttcgttacggtaccttcccttaaccgttagtaaacggttaccgttactacggttacggtaactccgtaccggttccgggtacgggttacccgtaaccggttaacggttaccgggggaaaggggtacgggttcggttaggggtttacccgggtttacggtttaaccgtaacggtttaaggttacggtagttaggtaacgtacggtaacggtactaaccgtaactaccgtaacggttacccgaccggtacgggtaaccgtcgggtaaccggtaccgggtacccttacccgtacccctaaacccggagaaacgaacccgtaaccgaccgtaacaaacgtacccgtactaactaccgttaatacgaacgaactaaagacgtacgtaagtcgaaggacggttaacggaccggtagtaaccgtcgtaacgtttacttacggttacgttacgttacggacggtaaggtaaacgggtctacggttaaaccctaagtacggtttcgttttgggtttaaacgttcggttaaccggtccgggttaccggggaaaaccgggtaacggttaacttacggggttacccgtaccgggttttacccc

SEQ ID NO: 191667 - DNA, 869 bp, Homo sapiens
  misc_feature: GYAE6OF01B9E6K.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagtcggctgagcgttggttttccttgttgcctaagttttaaaggtgtcagtgtgaggtgcagtcgtgggtggagggtccgggggaggtctttaggttcgacggtccggttcgggggtccctggacgtaccttccgttccgttgtcgccgacgtccttcgtggtactttccgtaccctttacgacgttacgtactacgtaggtactcgccgtaccggttcgggttacccgtacgtaacggttccggaaagggggtaacgggggtcgttagggttcgggtttacgggtttacgtaacggttagttaacgggtacgttaggtaacggtacgggtacgtacggaaacgaacgtaaacgttccgtaacggtaccggtaccgttacccgggtaaggtaacccgggtacccgtaaccgttcccctaaccccccggtacgtaaaccggaacgaaacccgaaccgtaacccgaaacgtaaacccaaccgttaactaacgttacgtacctaacgaacgtaaaacttaccgaacgtacgtacgtaagaaccggaacggaccggaacggtaaccgtacggtccgttacgttacgttaacgtttacggacgttaacggattaacggggacgttacgtaacgtaacgttaaagttccgggtttaagttttcgggttttaatccgtttaccggttaaccggggtaccggggtaaaccggtaaacgggtaaccggttacggttacccggttacccgtttaccccgg

SEQ ID NO: 191668 - DNA, 949 bp, Homo sapiens
  misc_feature: GYAE6OF01ELNGJ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagcgtggtggaggtccgggggagtcttagttcgagccggtgggggtccctgacgactctcctgtcgcacgcctcgtggtacttccaccttcgaagttacgtcacgttggatcgactacgtcggggttccctacgtaacggttccgaaggggggtaacggggtcgttggggtttgggtttacggggttttaccgtaacgggtttaacgtttaaccggggtaaggttacggtaagggttacggggtaaccttacggaaccgtaaaccgtaaacgttaccggtaaccgggtaccggggtaacccgttacccggggtaacgggaaaccgggggtaccccgttaaccgtttaccccccgaaccccccccgttaacgaaacgggtaaacccggaaacccgaaaacccgggtaaccccgtaaaaacggaaaccctaaccgtaaaccgtttaacgtttaaccgtaaccgttaaccggtaaacgttaaaacgtaacggtaaaccgttaaccggttaccgtaaggtaaccggaaccggacccgggtaaacggaacccggaccggttcgttaacggtttaccttaagtttaaccgttgggttaacggaaccggtaaaggggtacgggttacgaacccgtttaaaacgtaacgtttaccggttaaagggttttttcgggttttaaacggtaccgtttaccgggtttaacccggggtaccgggggtaaaaccgtaaacgggggttaacctaaacggggtttcggtaccccgtttaaacccccgg

SEQ ID NO: 191669 - DNA, 877 bp, Homo sapiens
  misc_feature: GYAE6OF01AQHU6.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagctggtggaggtccgggggagtcttagttcgacggtccggtcgggggtccctgacggtacctccgtccgtgtcgcgacgcccttcgtggtactttcctaacctttcgaggttacgtactacgtagggtactgccgtaaccgtcgggttccgtacgtaacggttccggaagggggacgggggtcgttgggttggtttcgggttttaccgtaaccggtttaagttaccgggtaaggttacggtaggtacggggtacgtaacgggaacctaaaccgtaaccggttaccggttaaccccggaccggggttaacccgttacccgggtaacgggggttaaaacccgggtcccggtaaccttttacccccccgaaccccccggtttaccggaaacggaaaccccgtaaaccaaaccccggtaaaccgtaaaccgaaactaaccccttaacgtaacttaactcggtaaacaacgtaaacgttacggaaccgtaacgtcgtacggacgaacgggcccggaaggaaccggtaccgtacgtacgttacgttaacgttacggtacggttaagaaccggttagggtaaacggtacggtaactaaaacgttcggttagttttacggtttaggtaccgtacggttccgggaaccgggtaaccggtaaacggtacgttaaacccggtcgggttaacccgtaccgtttacccgg

SEQ ID NO: 191670 - DNA, 742 bp, Homo sapiens
  misc_feature: GYAE6OF01DEHI7.35.44.D11.1.454.CMB.1.raw
  modified_base (547)..(547): a, c, t, g, unknown or other
  misc_feature (547)..(547): n is a, c, g, or t
tcagtacagatcgtcacgaccggtgctcgatttagcgcagtacgaagggggccccagccctgggactcccagctgtttctgcttgctgatcaggactgcacacagagaactcacatggagttcggctgagcttgggttttccttgttgcctaagttttaaaggtgtccagtgtgaggtgcagcgtggtggaggtccgggggaggtcttagttcaggccgtgggggtccctgacgtctctccgtgtgcagcctgtggtacttcaccctttgagttagtcacgtggatcgctacgtcgggtaccgtactaacggttccggaaggggtaacggggtcttggggttacggttacgggtttaccaacggtttagttacggaggttagtaaggttgggactcggaactaacgtaactaccgtacggaccggtaccgtaccggtaggaaaccgggtccgtaacttccccgaaccccctacgaagaaccggaaccaaaccggaacctaaacgaaccaacctaactaactactacgtaacaactaaagtagaaacnggtacaggaacgacggtaccgaggaccgacggtcttacggtaccttaacgttgacggtacgtaaccggaagggttacggttacggacccttaaactaacgtacgttacgttagttaacgttttcggaactttccggtacccgggttacggggtaaacccgaaagggtaccgttaaaccggttcgggttaaacccc

SEQ ID NO: 191671 - DNA, 643 bp, Homo sapiens
  misc_feature: GYAE6OF01BSCCK.35.44.D11.1.454.CMB.1.raw
  modified_base (377)..(377): a, c, t, g, unknown or other
  misc_feature (377)..(377): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttcctgtgccatttaaagtgtccagtgtgaggtgcagctggtggagtccgggggagtcttagttcagccgtgggggtccctgagactctcctgtgcacgcctctggacttcaccttcagtgtcactggatgctacgtgggtcctacgtaacgttccgaagggggtacgggtcgtgggttggttcgggtttcacgttattacggagtgagtcgggctagacacaatcgtacgcgactcgngaacgggcctactcccacccctagagacgaccaacgccaaagaccacactatacgtctagaacaaagtacgaacngtacgagacgacgtacggaacggaccncggcttacgttacgtaactttacgnggttaccgaacgtaagggtaccggttgaaaccttactaacgttaccgttgttttacgggttttacgaccggtttcgtaccgggtaaccggggtaaaccggaaagggttacctaaacgggttcggtacccgtaaccccgg

SEQ ID NO: 191672 - DNA, 783 bp, Homo sapiens
  misc_feature: GYAE6OF01APRZI.35.44.D11.1.454.CMB.1.raw
  modified_base (715)..(715): a, c, t, g, unknown or other
  misc_feature (715)..(715): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtcgttgggttttccttgttgacctaagttttaaaggtgtccgtagtgtggaggtgcgaggtcgtgggtgggacgggtccgggggaggtcgttaggttcgacggtccggtcgggggtccgtgacgccttctccgtgtgcgcgtcctacgtgtacttcctaccttacgtacgttacgtccgtaacgtggtaagtcgacgtaccggttccgggttacccgtacgtaacgggttccggaagggggtaacggggtcggtttagggttcgggtttcgggttttacgtacggtttaacggttacgggtaggttaggtaggtacgggtacgtacgaactacgtacgtaccgtacggaccggtacgtccggtaacggaccggtaccgttaccgtacccctaccccgtacgaacggtaaccgtaaccgaacccggaaccctaaacgaaccctaacgtaaactaaccgttatacccgtacgaaactaaagttaacgaagttacgttcggaagaccgacgggtaccggaacgtaccgacgttccgttagtacctttagtacgtggtacgtaagtaggtacggtacgactaacgtntacgttggtttattgacgttcggtaaggtccgggtaaacgtaaggtctaacggtcgtaccggtacccg

SEQ ID NO: 191673 - DNA, 762 bp, Homo sapiens
  misc_feature: GYAE6OF01CAINP.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttggtttccttgttgctaagttttaaaggtgtcaggtgtgaggtgcagcgtgggtggacggtccgggggagtcgttagtcgacggccggtcgggggtccctgacgtactccttccgtgtcgcgacgtcctcgtggacttcctaccttctagtagtctacgtgactcgcgtacgtcggtaccgtacggtaacggggtccgggggaagggtcggtggttacgggttcgggtttacgaccggtttaagttaccggaggttacgtaaggtcgggtacttacgaactaaccgtacgttaccgaaccggtccggtaccgtaccgggtacggtacgggtacccgtacgttacccccgtaaccccgtcgtaacggaaaccgaacccgaacccgaacccgtaaaacgacctaacgtaacttaactacgttactacggtaaactaaacgtacgaaacgtacgtacgtaggacgacgacggaacgcgtaaccggtcttagttacttacgtacgtagtacgacgaaggtaccggtggaacctaagttaccgtagttacggttttacggttacgtacgttcggtacggtacggggtaacgtaaaccgggtaagtacccggttacgtcccgtaccggttacccg

SEQ ID NO: 191674 - DNA, 638 bp, Homo sapiens
  misc_feature: GYAE6OF01D4OM6.35.44.D11.1.454.CMB.1.raw
  modified_base (276)..(276): a, c, t, g, unknown or other
  misc_feature (276)..(276): n is a, c, g, or t
  modified_base (543)..(543): a, c, t, g, unknown or other
  misc_feature (543)..(543): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggtttttccttgttgcctaagtttttaaaaggtgtccagtgtgaggtgcagctggtggacggtccgggggagtcttagttcaggccgtgggggtccctgacgacttcctccgtgtgcacgcctctaggtacttcaccttnagtagtcacgtgatgctacgtcggtccatcgaacgttccgaaggggacgggcgttggtggttggtttacacgttattacggagtgagtggaactgaacacaatccgtacgcggtaacgtcggtacgaacgggtcctaacttcccacccctacgagaacgaaccgaaccgtacaaacgaacaactacgtaatactacgtacaacgaaatcgaacgtagtcgaggaacgacgacgtaaggaccgtaggtctacgtacttaagttaccgngtacgagtaaggtgtcggtaactagaacttcgttaagttggtttacgacttcccggtaggacgggtaacgaaaaggtacgtaagtcggtaacccg

SEQ ID NO: 191675 - DNA, 856 bp, Homo sapiens
  misc_feature: GYAE6OF01C6MPE.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtggagttcgggctgagcgttgggttttccttgttgacctaattttaaaggtgtccagtgtggaggtgctagtcgtggtgggtacgggtccgggggaggtcttagtcgacggtcccggtcgggggtccctaggacgtaccttccgttccgtaggtcgcctacgtccgttcgtggtaacttcctaccgttatacgttgtcctacgtggtactccgacgtacggttcgggtaccgtacggtaacggggttccggggggaaggttcggttagggtttacgggttagggtttaccgaacggtttaacgtttaccgggaaggttcggtaaggttacggtacgtacgaacctaacgtaacgttaccggtaacggtccggtaccggttaccggtaacgggtaaccggggtacccttaacccgttaccccccgaaccccccgtcgaaaacgggaacccgaacccggaaacccgaaacccgttaacgaaaaccgcctaaacccgtttaattaaccttacgaacgtaaacgtaaacgtaacgacggtactcggtacggaaacgccggtaaccggacggacggtccgtcgtttacgtaacctttacgttagttcgaggtaacgtacgggttcggttacgaaccccgtttaaaagccgtttacgtaagggtttttcggtatttacggttccgtaacggggttccggaaacggttaacgggaacttcgggttaccacccgttcccggttaacg

SEQ ID NO: 191676 - DNA, 941 bp, Homo sapiens
  misc_feature: GYAE6OF01EOYZH.35.44.D11.1.454.CMB.1.raw
  modified_base (737)..(737): a, c, t, g, unknown or other
  misc_feature (737)..(737): n is a, c, g, or t
  modified_base (931)..(931): a, c, t, g, unknown or other
  misc_feature (931)..(931): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgaggtccgttgggtttttccttgttcgtacccgttaaagtttttaaaaacgggtgttacccgtaggttggtacggtaaggtgtacgtaggtcggtgggttcggggtaacggggttcccggggggaaggttaccgtttaacggtttaccggaaccgggtcccgggtttccgggggggttccccgtacggtaaccggtacccgttacccggttccccgttggttcgacccgtaccgtcccgttacggtacgggttaccttaccccgtaacccgtttaccgtaacggttacgtaaccgtaaccggttaggtaacctacggacccgttaaccggttccggggttaccccgtacgggttaaccggggtttaccgggggggtaacggggtcggttcggggtttacggggtttaccggggttttaccgtaacggtttacgttaacggtaggttcggtaaggtacgggtactacggtaaacgaacgtaacgtaccgtaacggccggtaaccgtcgggtaacggaaccggtaccgtacccgttacccgtaacccccgtacgaacggaacgaacccgaaccgaaccgaacgaccaacgtacgtaatacgtacgaacgaanaaacgtcgaaaccgtgtcggtaagacgggacaacggaacgtaccgaggttacttggtaccttagtacgagtgaacgtaggaacggtcgtaactaacgttactcggttaaggttttcgttaggtacctcgggtttaacccggggagggtaaaccgggtaaacggtacgttaaaccgtcgggttaacccccggttntaacccccgg

SEQ ID NO: 191677 - DNA, 834 bp, Homo sapiens
  misc_feature: GYAE6OF01CZU1P.35.44.D11.1.454.CMB.1.raw
  modified_base (107)..(107): a, c, t, g, unknown or other
  misc_feature (107)..(107): n is a, c, g, or t
  modified_base (127)..(127): a, c, t, g, unknown or other
  misc_feature (127)..(127): n is a, c, g, or t
  modified_base (684)..(684): a, c, t, g, unknown or other
  misc_feature (684)..(684): n is a, c, g, or t
  modified_base (781)..(781): a, c, t, g, unknown or other
  misc_feature (781)..(781): n is a, c, g, or t
  modified_base (814)..(814): a, c, t, g, unknown or other
  misc_feature (814)..(814): n is a, c, g, or t
tcagtacagatcgtcacgaccggtgctcgatttagcgcagtacgaagggggccccagccctgggactcccagctgtttctgcttgctgatcaggactgcacacaganaactcaccatggagttcggntgagcgttgggttttcctgttgtcctaagttttaaaaggtcgtacagtacgtgaggtgacaggtcgtgggtagggagggtaccgggggagtacttaggttacgacggtaccggtggggggtccctaggacgtaccttcctaccgtgtacgacgtacgcccgttacgtcggtaacttaccctaccttacaacgttacgtacgaaccgttaggagtaccgaccgtaacggttccgggtaacccgttacggtaaacggggttaccgggggtaacgggttcggttacggggttacggttacggtttaccgaacgtttaaggtaccggtaaggtggaaggtacggtacgtacgaaacgaaacgtaacgttcggaaccggtacggtaccgttaacgggtaccggtaacgggaccctacccggttacccaccccctagtaacggtaaacgaaacccaaacggtaacccaaagtaaacccaactaacgttaactaacgttaacgtacgaaaacctaaaaggtaaccgtacgtaattaccgaagggaaccggacgtaaacccgggngggtaacccctacgggtaccttaaggtaccttaaggttaactggtacgaacgtaagggtacgtcgtaaagtactaacgtacgtagggttctttaacngttcgttaaagtacggacgtaacgaaaacggtntaacggccgtacttaacccg

SEQ ID NO: 191678 - DNA, 668 bp, Homo sapiens
  misc_feature: GYAE6OF01E03D4.35.44.D11.1.454.CMB.1.raw
  modified_base (490)..(490): a, c, t, g, unknown or other
  misc_feature (490)..(490): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtcgttgggttttccttgttcgccttaagttttaaaaggtgtccgagtgtagaggtgcagcgtgggtggagggtccgggggagtcgttaggttcacggtccggtcgggggtccctggacgtaccttccgtccgtgtcgctacgcctcgtcggtacttccgtaccttcgaggtactacacgtggatgctacggttcggtacctacgacggttacggagggggaggtcgttgggttggttcgggttactacggtacttcgggagttgtagtcgggtactacgacgtaactaagtcgtacggcggtactcggaggtacggcctactccccgacccgacgtacgacgacctaacgaccgaaanacccgaataccgttataccgtactagaacctaagtacagtagtcgagacgaacggccgaagccgagtcttacgtcttattcggagtcgaagacggtagtcagtaaactgttacgttgtttaggtatacgtccgttaggggcggtaaaccgaaggtaccgttagtcccggtccgttacg

SEQ ID NO: 191679 - DNA, 863 bp, Homo sapiens
  misc_feature: GYAE6OF01AHCIQ.35.44.D11.1.454.CMB.1.raw
tcagtacagatcgtcacgaccggtgctcgatttagcgcagtacgaagggggccccagccctgggactcccagctgttctgcttgctgatcaggactgcacacagagaactcaccatggaggtcgggctgacggtcgttgggttttcttgttcgtaccttaagttttaaaaggtcgtaccgtaggtggtggtaggtgcgtacggtcggtgggtgggtacggggtccggggggaggttccgtttacggttcgtacgggtccgggttccgggggtcccgtagggaccgtacgttcccgttcgtggtacgtacgtccgtccgtcgttcggtacgtttccgtaccgttacgtacggttacgtaccgtacggtggtactacgtaccgtaccgggttccggggttaccgttaccgttacgggttaaccgggaggggtacgggtcgttgggttggtttacggttacgtacgtttacggtacggtaaggtacggtaggtacggtactacggtacgtaacgtacgtaccggtaccggtaccgtaccggtaccgggtaacggtaacgggtcccttaaccgtaccccgttaacccccggtaacgaaccggaaaccgtaacccgaaaccgtaaccggaaccgtaacctaaccgtaacttaaactaccggtaacgtaaacaacggtaactaacggaacgttcgtaacgacgggtaacgtccgggaacgacggaccgtacgttcgttacgtaattacgtcggtaagtcgtaagggtcgtaacgggtccgtataaccggtgtaaagttcggttttactacggtcctaccgggttaccggagggtaaaccggtacgtaagtcggttaacggtcctttccg

SEQ ID NO: 191680 - DNA, 725 bp, Homo sapiens
  misc_feature: GYAE6OF01BU4MQ.35.44.D11.1.454.CMB.1.raw
  modified_base (178)..(178): a, c, t, g, unknown or other
  misc_feature (178)..(178): n is a, c, g, or t
  modified_base (415)..(415): a, c, t, g, unknown or other
  misc_feature (415)..(415): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcgtggtttctgtgctatttaaagtgtcagtgtgaggtgcagcgtggnggaggtccgggggagtcttagttcgacggtccggtgggggtccctggacgtacctccgttcctgtggaccacggcccttgtacggtacttccaaccctttgagttacggtacctaagtcggtatcgtaccgtacgttcggggttacccgtacgtaaacggtttccggaaacggggggtaggggtccggttgggtttcgggtttcggggttttaccgtaacggttagtttaaccgggnggttacggtaggttacgggacttacgaaccgacgtaaacgtccgtaacggccggtaacgtcggtaagggaaccggtccgttaacttccccgtacccccgtagaacgacgaaccgaaccgacaacgaacaactaactatacgtacaacgtactaaatacgaactagtactaggacgacgaccgaggaccgacgtcgttagtacttagtacgttacgacgtaagtacggaggtacggtactacgtaacttcgttagtttggttacttgttcgtacggtaggggtaccaggtaatcggttacggccgttaccg

SEQ ID NO: 191681 - DNA, 798 bp, Homo sapiens
  misc_feature: GYAE6OF01DXSWG.35.44.D11.1.454.CMB.1.raw
  modified_base (187)..(187): a, c, t, g, unknown or other
  misc_feature (187)..(187): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (693)..(693): a, c, t, g, unknown or other
  misc_feature (693)..(693): n is a, c, g, or t
  modified_base (713)..(713): a, c, t, g, unknown or other
  misc_feature (713)..(713): n is a, c, g, or t
tcagtacagatcgtcacgaccggtgctcgatttagcgcagtacgaagggggccccagccctgggactcccagcttgtttctgcttgctgatcaggactgcacacagagaactcacagtggagtcggctgagtcgttggtttcttgttgtaccttaagtttaaggtcgtcgtagttgtgaggtgacgngtcggtgggtcgggacggtcggggtacgttcttggtacgnggtccggtcggggtaccngacgtctcgtcgtgtcncgacgtccgtgtcggttacttccgtacgttacgtaggttcgccgtagtgtagtccgtaccggtcggtccggtacgtaccgtacggggtacggaacgggggttagcggtttagggtttcggttacggttaacgtacggttaggtaacgggtgtagggtaacgtggaacttacgaaacttaccgtacgtacccggtaacgtcggtaccgttacgggaaccgggtaccgttaccgacccttacccgaccccgagtaacggacaaaccgtaaccaacgtaaacaacctaaacgttacttaaacgtcgtttaaccagtaaaaaccgtacggtaacaacggtttacgaacggacgaaccggaacgggacggtaacggtaaccgaaggtcccgtttaatacggtttacgtaacggtaggtaacgaacgggtttacggngtaacctagtaaacccgttntaccggtttaggtttacggacgtcggttcccggtaaggtacccggtaaacggtgtaacgtttaccccggtagtcccccgtaacgg

SEQ ID NO: 191682 - DNA, 821 bp, Homo sapiens
  misc_feature: GYAE6OF01CI0Z9.35.44.D11.1.454.CMB.1.raw
  modified_base (288)..(288): a, c, t, g, unknown or other
  misc_feature (288)..(288): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctagagcgttgggtttcctgttgctattttaaagtgtcagtgtgaggtgcacgcgtgggtgggaggtcccggggggaggtccgttaaggttccacggtccgttcggggggtccctggacggaccttcgtcctgtcgccagcctcgtaggtacttcaccttnagttacggtaccacgtggtaacgtcgtaccgtacgttacgggtcccgttaccgtaacggttaccccggaagggggtaaacgggtccggttaggggttacgggtttacgggttttaccgtaaccggtttaacgtttaaccgggtaaggttacggtaaggttacgggaaccgttaggaacccgtacgtaaacgttccgtaaccggtacccgggtaaccgttaccggttacggaaaccgggcccgaaccgtttaccccgacccccgtaacacggaaccgaccgtaaaccgaccaaacgaacgtactaacgtactactacgtacgaacgtaaactcggaaactacgttcgaaagacggaacggaacccggtagggaaccgtaccgggtacgttacgtacgttaacgttacgtacgttagaacgtagggtacgtacggtaccaaacgtactaccggttattaccgggttttgaacgtttccggtaacgggttacggtaccggtaaacggtaagtaacggttcccggtcttaacccggg

SEQ ID NO: 191683 - DNA, 820 bp, Homo sapiens
  misc_feature: GYAE6OF01BGFMN.35.44.D11.1.454.CMB.1.raw
  modified_base (568)..(568): a, c, t, g, unknown or other
  misc_feature (568)..(568): n is a, c, g, or t
  modified_base (661)..(661): a, c, t, g, unknown or other
  misc_feature (661)..(661): n is a, c, g, or t
tcagtacagatcgtcacgaccggtgctcgatttagcgcagtacgaaggggccccagccctgggactcccagctgtttctgcttgctgatcaggactgcacacagagaactcacatggagttcggctgagtcgttcggttttcttgttcgtaccttaaagttttaaacggtcgtaccgtagtgtaggtaggtcgacgtggtcggttgggtcgggtacggggtccgggggtaaggttccgtttacggttccgacgggtccgggtcgggggttcccgtaggtacgtaccgtccgttccgtggtcgccgtcgtccgtacgtcgtaccttcctaccgttacgtacgttacgtcgtacggtgtacgtcggtaccgtacggttccggttaccgtaccgggttaacggggttaccggggtacgggtggtttagggttcggtttacggttacgtacggttacggttaggtacggtagtaggtacgtacgtacgaactaacgacgttcgaccgtcgtacgtacggtacgtaccggccttactcccacccgtagacgtacgaaccgaacgtaaccgaanaaccgaactaacgttacacgtaacgaacgaaactaacgtaacgaacgtacgtacgtaaggacgtaaccggacggaccggtaacgtaccggttntacggtttaaccttcgttacggtaggtaaccgaaggtaacgggttacggtaaccgtaattaccgtagtttaccgttggttttacggttaacgccggttacggtcgggtaaaccggtaacggtacgttaactaaccgggtcgttaacccgttccgtaccg

SEQ ID NO: 191684 - DNA, 732 bp, Homo sapiens
  misc_feature: GYAE6OF01E2LQ5.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagtcttggttttccttgttgacctattttaaaggtcgtaccagtgtgaggtgcagcgtgggtgggaggtccgggggaggtctttaggttacgcggtccggttcgggggtccctaggacgaccttcgtccgtggtcgacgcgtccgttcgtcggtacttacctaccgtttcgagtacgtacctacgtggtacgtcgtacgtacgttccgggtccgttaaccgtaacggttacccggaagggggtacgggtcgttggttcggtttacggtttaccgtacgtaacgtttacggtagtggtacgtacggtacgtacgactaacgtacgtcgtaccggacgtaccgtcggtacggaacggtcccgtaaccttccccacccctacgaacgacgtaccgaccgaacgaaacgtacaccgtagtatccttacgtaacgactaagttaacgaccgttgtcgagtacggacgaacggctacggacgtcgttcctaagttccttaagtacggacgtcggtaaggtggtacgactaaccgtagttacgttacgtttggttctaaacgtccggttacgggaggtaaacccgtaggaccttggtccggcccttaccg

SEQ ID NO: 191685 - DNA, 884 bp, Homo sapiens
  misc_feature: GYAE6OF01CA9EZ.35.44.D11.1.454.CMB.1.raw
  modified_base (161)..(161): a, c, t, g, unknown or other
  misc_feature (161)..(161): n is a, c, g, or t
  modified_base (744)..(744): a, c, t, g, unknown or other
  misc_feature (744)..(744): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcttggtttccttgtgcctaattttaaaggngtcagtgtgaggtgcagctgggtggaggtccgggggagtcttagtcgagtccggtcgggggtccctgacgtaccttcgtcctgtcgccgacgtcctcgtggtacttctacccttacgtagtacgtactacgtggaactggtccacgggttccgggtaccgttaccgtaacggttcccgggaagggggtaacggggtccgtttgggggttcgtttacgggggttaccttacggttaagttaccgggtaagttgggtaaggtacggggtactacggaaaccctagtaacgttaccggtaacggtacccgggtaccgttaccgggtacggaacccggggtacctaacctttcccccgaaaccccccgtcggaaaacggtaaaccgaaacccgaaaccccggaaccgtaaaacccggaaaccttaaacccaaaccgtttaacttaccgttaaccgtaaccggtaaacctaaaaagtaccggtaaaacttaccgggtaacgttaaccgggaaacgaaccggggacccgttaaaccgggggaaccgtaaccgggtcccgttaacgtttaccgtaaacccgggtttttanaccggtacgggtaaaccggtagggtaccggttagtaacccgttaaagtacttaacggtggttttaggtttaccgtacggttaccggtcgggtaacgggtaaccgttaacgggaccgttaaggttccgtacccggttaccc

SEQ ID NO: 191686 - DNA, 616 bp, Homo sapiens
  misc_feature: GYAE6OF01EYKKN.35.44.D11.1.454.CMB.1.raw
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (470)..(470): a, c, t, g, unknown or other
  misc_feature (470)..(470): n is a, c, g, or t
  modified_base (539)..(539): a, c, t, g, unknown or other
  misc_feature (539)..(539): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttccttgttgcctattttaaaaggtgtccagtgtgaggtgctagctgggtggaggtccgggggaggtcttagttcaggccgtggggggtccctgagacctctcctgtgccagtcctcgtggntttcaacccttttcagtagttcactggangcactgggtccgtcaaaggttccgtagggaagggcnggtgtgggtttcgacgttattacgagttgagtgggacgtgacgacaatctacgcggacgtccgtggaacggccgtacgttccgaccccctccacgacgacaacgaccaacgaaccacaactataactactcgactaatacgaacntacgtcgtacgacgacgcggaacggaccgaccggcgtacgtctacttactgtgtacgaaggtaggtcgnaccgtaacgtaactacgtacgtttagggttttacgttactttccgttaccggttccgggtaccggtaacgggtaacg

SEQ ID NO: 191687 - DNA, 923 bp, Homo sapiens
  misc_feature: GYAE6OF01BC1TH.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccagtggagttcggctgagtcgttgggtttttccttgttgtaccttaagttttaaaaggtcgtcctagttggtggtaggtgcgaggtcggttgggtgggtacgggttccggggggtaggttacgtttacggttcgtacgggtccgggttcgggggttccctggaacgtcttccgtccgtggtcgacctacgtccttacgtggtactttccgtaccgttacgtaacggttacgtaccgtacgttaggacttacggccgttaaccggttcggggttacccgtacggttaaacggttccggggaagggggtaacggggttcgttgggtttacgggtttaccgggttttacgtaacgttacggttacggtaggttaggtacggttagggtacgtaaggtaaccacgtaacgtcgtaaccggaccggttacgtacggaggtacccggtacctaccgtcccccgtaacccgtacgaacggacccgtaacgaacccgtaaccgaaacggtaaccctaaacctaaacgttaacgttaccgttaacgaacggtaaccttaaagacgttaaaccgtcgttaaacggtacggacggtaaacccgggaccgtaacggtaaccccggtaacgttcggttaactttaccggttaactttagggtaccggtaacgaacggtaaaggggtcttaaccgggaacttaaaccttaacggttacgtttaaccggtttaggttttacgtacgggtttaacccgttcggggttaaaccgggaacggttaaacgggtaacttaacccgggttaccggtacccgttaaccccgg

SEQ ID NO: 191688 - DNA, 746 bp, Homo sapiens
  misc_feature: GYAE6OF01CDXH2.35.44.D11.1.454.CMB.1.raw
  modified_base (293)..(293): a, c, t, g, unknown or other
  misc_feature (293)..(293): n is a, c, g, or t
tcagtacagatcgtcacgaccggtgctcgatttagcgcagtacgaagggggccccagccctgggactcccagctgtttctgcttgctgatcaggactgcacacagagaactcaccagtggagttcggctgagtcgttgggttttccttgttcgaccttaagttttaaaaggtcgtaccgagtgtaggaggtgcaggtcgtagggtgggtacgggtcgggggagttcgttacgtcgcggtccggtcggggtcctgacgtcctctcgtgtgctcgtctcgtgtacttctaccgtntacgtatcacgtgagtgtcgcgtcggtacgtacgtaccggtcggaggggtacggtcgttagggtggttcggttacgtacgttagttcggagttgaggtacggactacgaactaacgtaacgtcgtaccgtacggtaccgtacggtaacgggaaccggtcccgtaccgttacccccgtaccccgaacgaacgtaaccgaaaccgaaccgtaaccgaaaccgtaactaaccttaacgtaacgttacctaacgtaacgaactaaaaggtacctaaagtccgtaacgacggaacgaaccggtacggaaacggtacgtcggtacttaccggttacttacggttacgtcgtagaacggtaggttacggtagtactaacgtacgttcggttaagttttcggtacgtccgttacggtacgggtacgtaaacgggtagtacgacgggttacgtccgttaccg

SEQ ID NO: 191689 - DNA, 725 bp, Homo sapiens
  misc_feature: GYAE6OF01DH8GL.35.44.D11.1.454.CMB.1.raw
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
  modified_base (615)..(615): a, c, t, g, unknown or other
  misc_feature (615)..(615): n is a, c, g, or t
  modified_base (666)..(666): a, c, t, g, unknown or other
  misc_feature (666)..(666): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgagcgttggttttcctgttgacctaattttaaaggtgtccagtgtagaggtgcagcgtggtggacgggtccgggggagtcttagttcaggccggtcggggtccngacgacctcgtcgtgtcgcgacgtcctcgtgtacttcctaccgttnaggtactacgacgtaggatcgaccgtacgttccgggtaccttacggaacggttcccggggaagggggtaacggggtcgttggggttcggtttacgggttaccgtaacgttacggtttaacgggaggttaggtacggtacgggtaaccgtagaaacctacgtaacgtcccggtaacggaccgggtacccgtcggtaacgggaacgggtccctaaccgttaccccacccccgtagaacgaacgtaccgaacccgtacaaacgaacctaacaacttnaacttanacgaagtaaatcgaactgtacgagacgacgacgacgacgtcgctgttactattacgngtacgaacgaggtaggtactacgtaagttactggttacggtttaggttacncgttacggccgggtaacggtaaaccggaaggtacttaacggtcggttacccgtacccgg

SEQ ID NO: 191690 - DNA, 714 bp, Homo sapiens
  misc_feature: GYAE6OF01A9BMH.35.44.D11.1.454.CMB.1.raw
tcagtacagatcgtcacgaccggtgctcgatttagcgcagtacgaagggggcccccagccctgggactcccagctgtttctgcttgctgatcaggactgcacacagagaactcaccatggagttcggctgagtcgttgggttttccttgttgtcctaagttttaaaggtgtcctagtgtgaggtgcgagtcgtgggtggacggtccgggggagtcgttagttcgacggtccggtcgggggtccctggacgtacctccgtccgtgtaggaacggtcgtcgtaggtacttcattccttacaaattaactagtgtctagtcgcctacggtcggtccccgaccgtaggcctaccggaacggtaccgaaagggtccgtaggtaggttcgggttaggtcgtagttggtagttaggtagtaggagtacggtaagtaagtagtatactagtcgacgagactacggtagaacggctactacactactacgcgagaacgtacctaataccgaaataccttactttgtaccagtaacaaagtcgaaccgagaccgtgaacggacgacctaaggaccgtaagtaccgttaaattacgttaccgttaagtcgtaaggggacctaaaggaacgggtcgaagggttacccgggaaacccggttaccccccctacggggaaattacgggaacccgtaaggtcccggggaccggggtaacccgtacccggg

SEQ ID NO: 191691 - DNA, 944 bp, Homo sapiens
  misc_feature: GYAE6OF01DVN4K.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtggagttcgggctgagtcgttgggttttccttgttgtaccttaagttttaaaagggtgtccgtaggttgtggaggtgcaggtcgttgggtgggtagggtcccggggggagtcttaggttcgacgggtcccggtcggggggttccctaggacgtaccttcctcgtgtcgctacgtcctgtggtaacttcctaccttacgtaaggttacgtaccgtaacgttggaactcggtaccgtacggttcggggtacccgtagttaaccgggtcccggaaggggggtaacgggggtcgttaggggtttgggttcggggttttaccgtaacggtttacgtttaacgggtaggttaggtaacggtacgggtaaccgtaacggtaacaaccgttaacgttccggtaacggaccggtaccgtccgggtaacgggaaacccggggtaccctaacccgtttacccccgaacccccgttacgaacgggtaaccgaaaaccgaaaccggtaacccaaaaacggtaaccctaacgtaaacctttacgttaataccccgtaagaaacctaaaaggtcgtaaaccgtaggtaccgtagaaccgggtaaccggaccgggaacggtaccctacggggttaccttttacggtaaccgtttagttaccggtaggtacgtaacgggtaagggtaccgggttactaaacccgttaaacgtaacgtttacggttaacgggttttttaggttttaccggacttttacccgggggtacccgggttaacgggggtaaaccccggttaaaacgggtaccgttttaaccgggcgggtttaaccccgtttaacccccgg

SEQ ID NO: 191692 - DNA, 882 bp, Homo sapiens
  misc_feature: GYAE6OF01D8FWS.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtggaggttcggctgagtcgttgggtttttccttgttcgtaccttaagttttaaaaggtcgtcgtagttggtggtaggtgacgagtcgtgggtgggtacgggtccgggggtagtcgtttagttccgacggtccgggttcgggggtccctaggtaccgtaccttccgtccgtaggtcgaccgtacgtcccttcgtcggttacgttcctaccgttacgtagtacgtcctacggtgtacgtcgacgtacgggtcggttccgtacgtaaccggtccggaaggggtacgggtcgttagggttcggtttcggttaccgtacgtacgttacggaggttacgtaggtacggtacgtaacgaaccgtacgtaacgtccggtaaccggtaccgggtacccgttaccgggtaacgggtacccggtacccgttaacccgtaccccgaaccccgtaacgaacgtaaacccgaaccgaaaccgaaacccgtaaacgtaacctaacccgttaaacgttaacttacgtaaaccgtaccgtaaaacgttaaagtaaaccgtaactacgggttaacgaacggtacggaacccgggtacggaacggaacccgtacggtccgtttacgttaaccgttacgttaacggttacggaagttaaccgggaaggttaccggtacttaacgtaacgttacgtcggttttagggtttccggttaacgtcggttacccgggttacgggaccggtaaacgaacggtagttaaccgggtccggtccctttaaccgg

SEQ ID NO: 191693 - DNA, 685 bp, Homo sapiens
  misc_feature: GYAE6OF01BGNBQ.35.44.D11.1.454.CMB.1.raw
  modified_base (172)..(172): a, c, t, g, unknown or other
  misc_feature (172)..(172): n is a, c, g, or t
  modified_base (275)..(275): a, c, t, g, unknown or other
  misc_feature (275)..(275): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagtacagatcgtcacgaccggtgctcgatttagcgcagtacgaagggggcccccagcccctgggactcccagctgtttctgcttgctgatcaggactgcacacagagaactcaccatggagttcggctgagcgtggttcgtgtagcctattaaagtgtctagtgtgagtncagcgtggtaggaggtccgggggagtcgttacggttccacggtccggtcgggggtcctaggacgtctcgtcctggtgcagtcctcgtggtacttaccaccttnagttagctacgtgatcgcgtagtccggtacctagtacgtcggaggggtacggtcggttggtcgggttcggtttacgtacggttactttagggntgtagtggtaacngaacgtacgactacggtaccgtcggtaacccgttccggtagggaaccgtcccgtaaccgtacccccgtacccccgtagacggtaaccaaccggaaacgaccgtaaaccgtaaccactaacgttaatctaatcgaaactaaggtactatacgagtagaacggtacgtaccggcgaaccgtcggtctacgttacacgttacgtagtacgacgtaggaccgttagacttaacgtaccttagtcgggtttagttacgtcggacgttcccggaggtaccggaaacggtagtcggtacgtccgtaacccg

SEQ ID NO: 191694 - DNA, 847 bp, Homo sapiens
  misc_feature: GYAE6OF01C48BM.35.44.D11.1.454.CMB.1.raw
  modified_base (108)..(108): a, c, t, g, unknown or other
  misc_feature (108)..(108): n is a, c, g, or t
  modified_base (276)..(276): a, c, t, g, unknown or other
  misc_feature (276)..(276): n is a, c, g, or t
tcagtacagatcgtcacgaccggtgctcgatttagcgcagtacgaaggggccccgagcccgtgggactcccagctgtttctgcttgctgatcgagactgcacacaganactcaccatggagttcggctgagtcgttggtttccttgtgcctaagttttaaaggtcgtaccgtagtgtaggaggtcgacgtgtcgttgggtaggtacgggtccggggtagtcgttagtcgaggtcccggtcggggtccctaggaccgtactccgtccgtggtacgcncgtccgtacgtcggtaactcctacgttacggtatccgtagaccgtgtacgtcgtacggtacgttaccggtaccgtagtacggttaccggaaggggtaccggtgttagggtcgtttacgggttacctaaggtttacgacgggttgtaacggttacggtaccggtaacgtacggttaaacacgtaaaccgtttccggtaaaccggtacgggtaacccgttaacggttaacggggtaccgggtaacctttaccccgtttacccccccgaccggttaaaccggaacggaaacccggtaccggaaaccctaaaggtaaacctaccgtaaacgttaccgtattaaccgaacgtaacgtaacgtaaacgtaaccgtagtaaccgtacgtaacgtacggaacgtaacgtaccggacgttacccgtattaccgttacgttaacgtacgtacggtactaagggtacgggtacgtaacgttaaacaggtttaacgttcgggtaaacgtttcgggtaacctttcggaacgggtacggtaacggtacggttaaacggtccgttaaccggtcgttccgttaaccg

SEQ ID NO: 191695 - DNA, 880 bp, Homo sapiens
  misc_feature: GYAE6OF01C2DIT.35.44.D11.1.454.CMB.1.raw
  modified_base (858)..(858): a, c, t, g, unknown or other
  misc_feature (858)..(858): n is a, c, g, or t
tcagtacagatcgtcacgaccggtgctcgatttagcgcagtacgaaggggcccagccctgggactcccagctgtttctgcttgctgatcaggactgcacacagagaactcacagtggaggttcggcgtgaggtcgttgggttttccttggttacgtaccgttaaagtttttaaaacgggtcgtaccgtaggtggtaggaggtgcgaggtcgtggggtggacggggtccgggggaagtcgttacggttcgagggtccgggttcgggggtccctggaacgtccgttcgtccgtggtcgaccgtcgccttgtggtacttaccgtccttagacgtacttacgacggtagtagtcggtccgtacgggtccggttaccgtaacgtaacgggttaccgggaagggggtacgggttcgtttaggggttcggtttaccgggtttactacggtttacggttaacggtaggttaggtaggtacgggtaccgtaacgtacgtaaacgttaaccggtaccggtaccgggtaccggtacccgtaccggggtaacgggtaaccccgggtacccttaccgttaccccccgtaaaccccggagtaaaccgggaaccaaaaccggaccgtaaacccgaaacgttaaccaacttaacgttacggttaacaaggtaaccgtaaaactaaaccggtagaaccgtacgtacggaacggaacgtaccgggaccgtaacgtaccggacgttagttacgtagtttaccgttaaggcgtaacgtaacggtacgggacgttaagtacctaacggttaactaggtttaggttacgttacgtccggtttaccggaaggggtacccggtaagggaaacgggttaaccncggttacgtcccgttacccggg

SEQ ID NO: 191696 - DNA, 744 bp, Homo sapiens
  misc_feature: GYAE6OF01BX4AV.35.44.D11.1.454.CMB.1.raw
  modified_base (180)..(180): a, c, t, g, unknown or other
  misc_feature (180)..(180): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcngctggtggaggtccgggggagcttagttcagccgtgggggtccctgagactctcctgtgcagcctcgtggattcaccttcagtagtcacgtggactgctagtcgggtccgtactaacggttccgaaggggagggtcgtgggttggttgggtttcgtacggttagttacggtacggtgacggtagggacgtgaaccgaactaacgttccgtaacggtccggtacgttacccggtaggaaacggggtccgtaaccgtttccccaacccccgttaccgaacggaacgaaccaaccggtaccaaacgtaacaaccctaaccttaagttacgtcctaacgaacctaaaagtcgaaacgtagtttcgaggaacggaaccggacgaacgggaccgtaccgggtacttaggttaccgttaactttacgtacggttcgaacggtaacgggtagggttccgtaactccgtaaaagtccgtttaagttttagggttttaacgtaacgtttccgggttacggttacccgggggtaacgtaacggggaacctttacgggtcggtacccgttacccgg

SEQ ID NO: 191697 - DNA, 825 bp, Homo sapiens
  misc_feature: GYAE6OF01EQS32.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactccacagtggagttcgaggctgagtcgttcggttttccttgttgtacctaattttaaaaggtcgtccgtagtgtgtaggtgcgagtcgtggtggacgggtccggggagtcgttagtcgacggtcccggttcgggggtcctggacgtaccttccgtccgtgtcgcgaccgtcctcgtggttacttaccgtaccttacgaacgttacgtccgtaacgtggtacgtacggaccgtcggttccgggtacccgtaccggtaacggttacgggaagggggtacgggtcggttgggttacggtttacgggtttacgtaacggtttacggttacggttaggtaggtacgtaggtaacgtacgaaccgtaacgtaacgtacggtaaccggtacgtacccgtcggtaacggtacgggtacctaccgttaccccgaccccgtacgtaacgaaccgaaccgaaccgtaaccgaaacgaaccgtaactaactaacgtactaacgtacgaaactaagtacgtaaaccgtagtaccgtagtaacggacgaaccggacgaaccgtcgttaccgtagttactaacgtttacgtaggtaccgtaagtaacgggtacggtacgtaaccgtaaccgtaagttccggtttagtttaacggttttacgaacggttccggtaccggggtaaaccggggttaacgaaagggttacccttaaacggggttcccgtaacccg

SEQ ID NO: 191698 - DNA, 795 bp, Homo sapiens
  misc_feature: GYAE6OF01DR5SG.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgcctattttaaaaggtgtccagtgtgaggtgcagcgtggtggaggtccgggggaggctttagttcacgccgtcgggggtccctgagactctcctgtgcacgcctgtaggacttcctaccttcgtaagttacgtccgtacgtggactcgacgtacgttcgggttcccgtacgtaacggttaccggaaggggaacggggtcgttggggttcggtttcggggtttacgtaacggttacgttaaggtcggtagtaggtacgggactacgaactaacgtaacgtcgtaaccggcggtaacgtccggtacggaaacgggtcccgtaaccttccccgacccccgttaccgaacggaaaccgaaccgaaaacccgtacccgaaaaacgtaaaccctacctaaaacctttaacgtaaactttccgaacgtaaaccgtaaaaacgttccggtaaacttacggttaacccgtaggtaaccggaaccggaaccgggtaacggaaccgtacggtactttcggttaaacctttagttaccgttggaacgacggtaacgggacggttaccggaataaaccggtaagttccgtaagtttggttttacgagttccgttacggtacgggaacgtaaaggtcttaaacgggtccgtacgttaacccg

SEQ ID NO: 191699 - DNA, 948 bp, Homo sapiens
  misc_feature: GYAE6OF01CYGEC.35.44.D11.1.454.CMB.1.raw
tcagtacagatcgtcacgaccggtgctcgatttagcgcagtacgaagggggccccagccctgggactcccagctgtttctgcttgctgatcaggactgacacacagagaacctcaccagtggaggttcggctacgagtcgtttgggttttccttgttacgacctaagttttaaaggcgttacctaggtggtagaggtcacgaggtcggtaggggtacgggacggggtaccgggggattcgtttaacggtcgcgggtccgggtacggggtccctaggaacgtcctcttcgtagcgtacgaccgtccttagtaggtacttccctaccgttaggtacgttagtaccgtaaccggtaggtacgttaccggaccgttaccggggttccggtacccgttaacggtaaccgggtttaccggggaaagggggttaccggggttcgtttagggggttacggtttacggtttaaccgttaacgggttaacggttaacgggtggttaacggggacgttacggggtaactacgggaaaccttacgaaaccgtttccggtacggggaacccgtttacgaacccggggttaaagggaccccggtaccgttaccgtttaaccccccgccccgaaacgtaaaaccggaacaaaccccgggtaacaaaccgtaaacccgtaaccgtaacctaacgtttaaaccgtaccgtaacgttaacccgtaaagaaaccggttaacgtaacggtaaacgggtaccttaaggaacgggtaacggccgggtaaacggaccggttaccggttaagttaacgtcccggttaagtttacccggtaggaacccggtttaacgggacggttaacggtaaccgttaacgtaacggtactttagggtacccgtttagggtttacgaccgttacgggtacggtaaccgggagttaaacgtaccgttacggcggtacttcccg

SEQ ID NO: 191700 - DNA, 766 bp, Homo sapiens
  misc_feature: GYAE6OF01CGJDH.35.44.D11.1.454.CMB.1.raw
  modified_base (188)..(188): a, c, t, g, unknown or other
  misc_feature (188)..(188): n is a, c, g, or t
  modified_base (676)..(676): a, c, t, g, unknown or other
  misc_feature (676)..(676): n is a, c, g, or t
tcagtacagatcgtcacgaccggtgctcgatttagcgcagtacgaaggggccccagccctggactcccagctgtttctgcttgctgatcaggactgcacacagagaactcaccagtggagttcggctgagcgttggttttccgttgttgccgtaagttttaaaggtgtccgtagtgtgaggtgcgagngtaggtggacgggtccgggggacgtcgttagttcgacggtccggtcggggtccgtgaccgacgttccgtccgtgtccgtaccgcgtccgttcgtcggtaccttccgtaccgttactaacggttctaccgtacgtggtaacgtcgtacgtacgttccggtaccgtaccggtaacggggtccgggggtaacggtccggtttgggttacggtttcgggttaccgttaacgttcggttaacggtaggtcggtaaggttcggtaacgtacggaactaaccgtacgtaccgtaacggccgtaccgtaacggtacggtacccggtacgtcccgttaccccgacccgtacccgaagaaccgtaaccaaccgaccgtaaacgaacctacgtaacgttataaccgttccgtaataaacgaacgttaacgaacgtacgtaacgtacgacggacgtacggacgaccgacgtacgtagttaacgtacgtacgtgacggtanaaggtacgagtggtacccggcgttaaccccgaggcgttacacgggcacggtccggcgaccggtcccgaggttcccgtcgtccgttacccg

SEQ ID NO: 191701 - DNA, 741 bp, Homo sapiens
  misc_feature: GYAE6OF01AU18W.35.44.D11.1.454.CMB.1.raw
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (336)..(336): a, c, t, g, unknown or other
  misc_feature (336)..(336): n is a, c, g, or t
  modified_base (406)..(406): a, c, t, g, unknown or other
  misc_feature (406)..(406): n is a, c, g, or t
  modified_base (538)..(538): a, c, t, g, unknown or other
  misc_feature (538)..(538): n is a, c, g, or t
  modified_base (580)..(580): a, c, t, g, unknown or other
  misc_feature (580)..(580): n is a, c, g, or t
tcagtacagatcgtcacgaccggtgctcgatttagcgcagtacgaagggggccccagccctgggactcccagctgtttctgcttgctgatcaggactgcacacagagaactcaccatgggagttcgggctgacgtcgttcgggttttcgtgtacgacctaattttaaaggtgtcctaggtgtgaggtncgtcgcgtgggtcgggtaggtcgggggntcgttagttcgacggtccgggtcgggggttccagtaacgtccgttccgtcgttcggtagccgcgtccccgtttgtacggtactttcccgtaccttacgaacgttcgtactaacgtcggtnacgtccgtacgtcggtacgtacggtacggtacgagggacggtcgtggtgttcgtaactcgtagcggtagngagtacggtctagacgtaacgtacttaccggacggtacgtaccgtaacggttccgggaaacggttcacccgttacccgtacccgacgaacgttaaccgaaccgacccgtaagaacgaacctacggtaaactntttaaccgcgaacgtactaaacgtacgaactgtacgcggtanaacggaccgtaacgcgtacgtatacgttacttactaggtcaagggacctagggtacggttataccggtatacgttacggttgttacggttacgttcccggtacgtcgggttaaaccgggaacgttaacccggttataccggttacgggttaccttccccgg

SEQ ID NO: 191702 - DNA, 868 bp, Homo sapiens
  misc_feature: GYAE6OF01BY83R.35.44.D11.1.454.CMB.1.raw
  modified_base (704)..(704): a, c, t, g, unknown or other
  misc_feature (704)..(704): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgcctaattttaaaaggtgtccagtgtgaggtgtcagcgtgggtggtacgggtccgggggaggtcttagttcgacggtccggtcggggggtccctgacgtactctccgtgtcgcaggtcctcgtggtacttcctaccttacgaagttacgtactacgtgggtactgtaccgtacgttcggggtacccgtacgtaacggttccgggaagggggtaacgggggtccgttaggggttacgggtttacggggttttaccctaacgggtttaacgtttaacggggaacggtttacgggaacggttaacgggggtaaccttacggaaacctaaacccgtaaacgttcccgtaaaccgggtccggggttaaacccgttacccgggttaagggaaccggggttaccccgtaactttaacccccgtaaccccccgtacggaaacggtaaccgaaaccgtaaccggaaccgtaaaacgaaccctaacgtaactaacgtactaccgtaacggaactaaacgtacggaacctaagtcgtaacggaacgaccggaaccgagggaaccnggtacctacggttactacggtttacgaggttaacgaaccgtaagggtaggtaaccggtacttaaaccgtaaattcgttaacggttttagggttactacggttcgtaaccgggtacggggtaaacccgaaggtaaacccgtaggttaccgggtccccttaaccgg

SEQ ID NO: 191703 - DNA, 887 bp, Homo sapiens
  misc_feature: GYAE6OF01B8URM.35.44.D11.1.454.CMB.1.raw
  modified_base (108)..(108): a, c, t, g, unknown or other
  misc_feature (108)..(108): n is a, c, g, or t
tcagtacagatcgtcacgaccggtgctcgatttagcgcagtacgaagggggcccccagccctgggactcccagctgtttctgcttgctgatcaggactgcacacaganaactcaccagtggtagttcggctgacgtcttgggtttttccttgttcgtccttaaagtttttaaaaggtcgtcctaggttgtggaggtgcagtcgtgggtgggtacgggtccggggggtaggtcgtttaggtcgacggtcccggtcggggggtccctggacgtaccttcctccgtgtcgccacgtcctcgtaggtacttcctaccgttcaacggttcgtaccgtacgtcggtactcggtacgtaccggttcgggtaccgttacgtaacggtaccgggaggggtaacggggtcgtttggggttcggtttcgggttaaccgttaacggttacgttaacgggtagtacggtaaggtacgggtaactagtaaaccgtaacgtaacgtaccggtaccggacggttacgtaccggggtaacggaccgggtacccgtaacccttaccccacccccgttacgaaccggtaaccgaaacccgtaacccgaaccgtaaaccgaacctaaactaccgttaaactacttacccgtaacgtaaaccgtaaacgttaaccggtaacggtacgttaaccgggacggtaacggaaccgggtacccgaacggggtaacccgtacggttaacgttaccggttttacgtaaaccgtttggtaaccgtagggtaacccgttaagggacggttaccggtaactaaaccgtattacggtttacggttagttacgttacgggttcccggttaaggggaaccggtaccggtaacgggtaagttccggtcggttacccgtaccg

SEQ ID NO: 191704 - DNA, 786 bp, Homo sapiens
  misc_feature: GYAE6OF01D1MXR.35.44.D11.1.454.CMB.1.raw
tcagtacagatcgtcacgaccggtgctcgatttagcgcagtacgaaggggcccagccctggactcccagctgtttctgcttgctgatcaggactgcacacagagaactcaccagtggagttcggctgagtcgttcgggtttttccttgttcgtaccttaaagtttttaaaaggtcgtacctagttgttaggaggttgacagtcgtggtggacggtccggggagtcgttagttcgacgtccggtcggggtcctagagtacctcgtccgtgtacgctacgtcctgtgtacttcctacttgagtacgtcgacgtggacgtcgacgtacggtcggttaccgtacgtaggtaccggaggggtaacggtcgttgggtttacggttcggtttactaacgttagtttacggagttagtacgtacgggtactacggtaacctaacgtaacgtcggttaaccggccggttaaccgttacccgggtacgggtaaccgggtaacccttacccgtttaccccgacccccgttaagaacggaaacgaacccgaaaccgtaccgaaacaaccgtactaaacttataccgtacgtaacgtaacgaaagtaccgtaacgtgttaacgaggaactaccgggacgtaacggaccgtacgttcttacgttaccgttaacgttcgtacgtacgtacgaggttaccggttacgaccttaatacgtttacgttacggttttgttaacgtcgttacccggtcggtaaacgggtaactaacggttacctaaggttcgtaacccgttacccg

SEQ ID NO: 191705 - DNA, 726 bp, Homo sapiens
  misc_feature: GYAE6OF01AFFMP.35.44.D11.1.454.CMB.1.raw
  modified_base (266)..(266): a, c, t, g, unknown or other
  misc_feature (266)..(266): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagtctgggttttccttgttgcctaattttaaaaggtgtccagtgtgaggtgcagcgtggtggaggtccgggggagcttagtcaggccgtgggggtccctgagactctctgtgcagcctcgtggtacttcgaccttnagtacgtcacgtggactcgactacggttcgggtccgtacgtaacggttaccgagggggtaacgggtcgttgggtggttgggtttactacggttagttacggtagttagtaggtcgggaactcgaactacgtaacgtcgtaccggacggtacgtccggtaggaccggaccgtacttccccgacccccttacgaacggtaccgaaccgaaccgaccgaacgaacccactaacgtaactacgtacgtaacgtaactaaagtacggaaaccgttagttccgaacggaaggtaaccggaccggaacggtaccgccgggttacttacgttaccttacgttaacggtgtaacgtacggtaaggaccggttcggtaacctacgtaaacgttcgttaggtttcggttaacggtcgttccggtagggtaccggaaccgaaggtaacctaggttccgtcccggttaacccg

SEQ ID NO: 191706 - DNA, 727 bp, Homo sapiens
  misc_feature: GYAE6OF01DP4HX.35.44.D11.1.454.CMB.1.raw
  modified_base (191)..(191): a, c, t, g, unknown or other
  misc_feature (191)..(191): n is a, c, g, or t
  modified_base (304)..(304): a, c, t, g, unknown or other
  misc_feature (304)..(304): n is a, c, g, or t
  modified_base (569)..(569): a, c, t, g, unknown or other
  misc_feature (569)..(569): n is a, c, g, or t
  modified_base (650)..(650): a, c, t, g, unknown or other
  misc_feature (650)..(650): n is a, c, g, or t
  modified_base (704)..(704): a, c, t, g, unknown or other
  misc_feature (704)..(704): n is a, c, g, or t
  modified_base (714)..(714): a, c, t, g, unknown or other
  misc_feature (714)..(714): n is a, c, g, or t
tcagtacagatcgtcacgaccggtgctcgatttagcgcagtacgaagggggtccccgagccctgggactcccagctgtttctgcttgctgatcaggactgcacacagaagactcaccagtcggtgttcggctgacgtcgttcgggtttcttcgtcggacctaacttttaaaggtggtccagtgtagagtcncagtcgtgggtaggacgggtcggggtatcgttacgtcgcgtccggtcggggtacctcgtacgtacttcctcgttcgcgctcgtcctcgtagtacttcctaccgtatacgttcnctagtcgaatcgtgtacggtcggtctacgtacggtccggtagggacgggtattgggtcggttacggttcggtacgtaaggtaccggtagtacggtaggtcgggtactacggtacctaacgttactacggttaaccgacggtaagttcggtaacggacggtcctacgtacccctacctcggaacggacgttaacgaacccggtaacaaacgtaccactaacgttatacgtgtaacaacgtacgacgtaacaccttcgtaaggtacnccggtaccgtaggaccgttacgtccgtaacttacgttaacgtcgtaagttcgaacttaggggacggtacctgttaaaaccnggttaaccgtgtttacgttctaccggttcgaccgggtaaccctgtaaacccggngtttaaccgngttacgggtaccc

SEQ ID NO: 191707 - DNA, 934 bp, Homo sapiens
  misc_feature: GYAE6OF01DJPJA.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccagtggagttcggctgagtcgttggttttccttgttgacctaagttttaaaggtgtcctaggtgtggaggtgcgtagcgtggggtaggacgggtccgggggagtcttaggtccgtacggtccggtcgggggtccctaggacgtaccttcctccgtgtcgactcgtccgtcgttggtaacttccgtacccttagtaacgtacgttacgacgtaggtacgtcggtcgttacggttcgggttacccgtaacggttaaccggttaccggggaagggggtaacggggttcgttaggggttaccgggttttcgggttaaccgttaacggtttaggttaaccgggtagggtttaccggaaggttacggggtaaccgtaacgtacccgtaaaccgtaaccgttcccggtaaaccgggtcccgggttaaacccggttacccgggtaaccggggttaaacccgggttaccccggtaacccgtttacccccggtaaccccccggttaagaaccgggtaaacccaaacccggtaaccggaaaccccggtaaagaaaacccgtaccctaaacgttacgttaaccgttaccgtaccgtaaaaccgttaaacgtaaccggtaacttaacggttaccggaacggtaacgaacccggacccggtaacggtaccgggtaccgttacgttagtttacccgttaacgtttacggttaaccggtagtaaccggtaacggtcgggtaaccttacgggtacttaacgttcggttaacgtttccgggttaggtccgtaaccgtcgggaccggtaacgtaacggtagtaacggtcctacgttcccg

SEQ ID NO: 191708 - DNA, 806 bp, Homo sapiens
  misc_feature: GYAE6OF01C3ZUT.35.44.D11.1.454.CMB.1.raw
  modified_base (107)..(107): a, c, t, g, unknown or other
  misc_feature (107)..(107): n is a, c, g, or t
tcagtacagatcgtcacgaccggtgctcgatttagcgcagtacgaagggggccccagccctgggactcccagctgtttctgcttgctgatcaggactgcacacaganaactcaccagtggtagtcggctgagtcgttggttttccttgttcgtaccttaagttttaaaacggtgtacctagtgtggaggtgcaggtcgttagggtgggtacggggtcccgggggtagttcgtttacgtcgaccgggtccgggtcgggggtccctaggacgtacccttcctccgttgtcgccgacgtcctcgtcgtacttaccttccgttagtagtacgtcctacgtggtactcgtacgtacggttacggtaccgtaacgtacggtaccgggaaggggtaacgggggtcttgggtttcggttacggttaccgttacggttagtacggtagtaggtaggtacggacgtacgaactacgtaacctacggtaccgacggtaccgttcggtaacggtaccggacctaccttaccccgacccgtacgacgtaacgaaccgacgaaccaacgtaactacctaacttactacgtaactacgaaacgttaaacgtacgaactacgtacgtaacgaacggtaccggaaccggtacggtaaacccgtcggtacgttagttaccgtttaacgttagacgtacgaaggtacggtaccgtacgtaacctaatacgttacggtttacgtttaggtttacgtaccggttcggttaccgggtaagggtaccccgaaagggttacctacggttacccggttcccggttaacccg

SEQ ID NO: 191709 - DNA, 873 bp, Homo sapiens
  misc_feature: GYAE6OF01B30SQ.35.44.D11.1.454.CMB.1.raw
  modified_base (322)..(322): a, c, t, g, unknown or other
  misc_feature (322)..(322): n is a, c, g, or t
  modified_base (464)..(464): a, c, t, g, unknown or other
  misc_feature (464)..(464): n is a, c, g, or t
tcagtacagatcgtcacgaccggtgctcgatttagcgcagtacgaaggggcccccagccctgggactcccagctgtttctgcttgctgatcgaggactgcacacagagaacctcaccatggagtttcgggctgaggtccgtttcgggttttttcccgttacgtttcgaccctttaaagtttttttaaaaacgggttcgtaccgtaaggttggtaggtaggtcgaccgaggtcgttggggtacggacgggttaccggggggagttcgtttaaggttcgacggtcccggttcgggggtccctaggacgtacttccgtccgtgtncacgtctcgtgtactcctacttgatagtcctagtcgatcgcgtacgttacggtcgtacgttacggtaccggtaaggggacgggttgtgggtttggtttccgggtttactaggttacgttacggtagtaggtaggtggtaacncgtaacctaactacggttcgtaccggtacgttacgggtccggtaggaacccgggtacctaccgtcccccttaacccgacgaacgaaacgtacccgaaccgaacccgaaacgacccaacttactacgttactacgtaacaacgttaaacgtccgtaaacgttcgttacggaaacgaaccgggccgtaaccgggaacggtaaccgtacggggttcctttaaccgttaacgttaacggtttttacgcgggttaacgtaaggtacggggttaaaccgtcgttaacccgaatttaaacccgggtttagttacggttttttaccggtagtcccgtttaacccgggtacggggttaccccgggaaagggttaaccccgttaaacgtccggtttccgggtaaacccccgttttcccg

SEQ ID NO: 191710 - DNA, 870 bp, Homo sapiens
  misc_feature: GYAE6OF01EN8D0.35.44.D11.1.454.CMB.1.raw
tcagtacagatcgtcacgaccggtgctcgatttagcgcagtacgaaggggccccagccctgggactcccagctgtttctgcttgcgtgatcaggactgcacacagtagaactcaccatggagttcggctgagtctgggttttcctgttgcctatttaaaggtgtccagtgtgagtgcagtctggtggacggtccgggggagtcttagttcgagtccgtgggggtccctgacgacttctccgtgtcgactagtccttacgtggacttccgtaacctttctaaggttacggttacctaccgttaggtacttcggtacctaccgttcgggggttacccgttaacgtaacgggttcccgggaaacggggttaacgggggtcggttcgggttaggtttaccgggtttaccgtaacgtttaacgtttacggaaggttgtacggtacgggtacgtacgtaacaccgttaatcccggtaacgtacggtacccttacggtaccggtaagggtccccgtaaacgtttccccgcccccggttaaccgaacggtacgaaacccgtaaccgacccgtaaagacccgaaccgtaaccttaacgttacgtacgttaacgtaacgtaaacgttaccgtaacgttaacggttaaccgtagggtaaccggaacgttacccggaacggttaccgaacggggtttccgttaacggttaccgtaacgttttaaccccgtagggttaccgtaacggttacgggtaacgggttcggtaacgttaaccctaaacggttccggttaacgttcggttttacggtaaccttaccggtacccgttacggggtaacccgaacgggttacccaaaggttttcccggtaacccgtacccgg

SEQ ID NO: 191711 - DNA, 721 bp, Homo sapiens
  misc_feature: GYAE6OF01BHYGH.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagtcgttgggtttttccttgttcgaccttaagttttaaaggtcgtcctaggtgtgaggtgcgagtcgtgggtgggtacgggtccgggggagtcgtttaggttccacggtccggttcgggggtccctggacgtcctcctccgtgtcgcacgtcctgtgtacttcctaccttgaagttagtcctaagtcggtatcgcgtacggttcgggtacctacgtaacggttccggaaggggtacgggtcgttggggttcggtttggtttacgtacgtttacgttacgggtaggtggtacggtacgggtactacggtaacacgtaacgtccggtaccggtaccgtacccgtacggtaacggacccgggtcctacctaccccgacccctacgacgaacgaaccgaacgaccaaagaccactactactatccgtagaactaaagtactaacgcgttagaaccggtacgaaccgaccggtaaggaacccgtggtccttagttacttaacgttcgtgtacgaagacggtcgaggtactagtacttggtcgttagttacgtgtccgtaggacgggttaaccaggtactacggttccgaccgtaccg

SEQ ID NO: 191712 - DNA, 523 bp, Homo sapiens
  misc_feature: GYAE6OF02GUQWC.35.44.D11.1.454.CMB.1.raw
  modified_base (457)..(457): a, c, t, g, unknown or other
  misc_feature (457)..(457): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtcctcaagttccagggaggggctggtgtgggttcacgtatacgagtgatgggactgacacaatctacgcggactccgtgaagggccattccacccctcagacgacaacgccaagacacactatatctgacaaatgaacagtctagacgagccgaggacacggctgtctattactgtncaagaggtgactacaatcattggtttgattcgtcgtcggggaccaagggacaagtcggtactaccg

SEQ ID NO: 191713 - DNA, 539 bp, Homo sapiens
  misc_feature: GYAE6OF02I2G2E.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctgggggtccctgagactctcctgtgcagcctctggattcaccttcagtagtcactggatgcactgggtcctcaagttccgaggggaagggctggtgtgggttcacgtattacgagtgagtgggactgacacaatctacgcgactccgtgaacggcatccacccctcagagacaacgccaagaacacactatatctgacaaatgaacagtctagagacgccgaggacgacggctagtactattactgtgacaaggaggtgactacgaatcaagttggttttagattcgtcggtacggggaccaaagggacaagttcggtactaccgg

SEQ ID NO: 191714 - DNA, 531 bp, Homo sapiens
  misc_feature: GYAE6OF02IBYFD.35.44.D11.1.454.CMB.1.raw
  modified_base (246)..(246): a, c, t, g, unknown or other
  misc_feature (246)..(246): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctntggattcaccttcagtagtcactggatgcactgggtcctcaagttccagggaggggctggtgtgggtttcacgtattacgagtgatgggactgacacaatctacgcggactccgtgaacgggccattccacccctcaganacaacgcaaagacacactanatctgcaaatgaaacagtctagagagcgaggacacggctgtctattacngtgcaagnggtggactacaatcattggtttnattcgtgttcggggaccaaaggggacaagttcgggtctaacccgg

SEQ ID NO: 191715 - DNA, 622 bp, Homo sapiens
  misc_feature: GYAE6OF02H8WF0.35.44.D11.1.454.CMB.1.raw
  modified_base (305)..(305): a, c, t, g, unknown or other
  misc_feature (305)..(305): n is a, c, g, or t
tcagtacagatcgtcacgaccggtgctcgatttagcgcagtacgaagggcccagccctggactccagctgttctgcttgctgatcaggactgcacacagagaactcaccatgagttcggctgagctggtttcctgtgccatttaaaggtgtccagtcgtgaggtgcagctggtgagtccgggagcttagttcagctggggtcctgagactctctgtgcagcctctggacttcacttcagtacgtcactggatgcacgtggtacctcgagttccggaaggcttggtgttcgggttcacgtatacgngtgacgtggactgacacatcgtacgcgtactccgtagacggctagttccgaccccgttcgacgtacgacgtaaccgtccaaggtaaccacgtaacgtttagtaaccgtcgttagtaccaaacgttcgaaccgtacgttctaggaacgtacggaccccgtaaggacctacgggtaccttacggttacttaacgttaccgtggtaaccgtacgtaacggtacggttcgaccgttaactacgttccgtaagtttggtttacgacttccgttacgtaccgggactaacgggtccgtaagttccggtacccgtagtttaccg

SEQ ID NO: 191716 - DNA, 526 bp, Homo sapiens
  misc_feature: GYAE6OF02FGXRZ.35.44.D11.1.454.CMB.1.raw
  modified_base (466)..(466): a, c, t, g, unknown or other
  misc_feature (466)..(466): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccaggggaaggggctggtgtgggtttcacgtattacgagtgatgggactgacacaatctacgcggactccgtgaagggccgattcacccctcagacgacaacgccaagaacacactatatctgcaaatgaaacagtctagagagccgagacacggctgtctattactgtgcaagnggtggactacaatctaatggttttgattctcgtcggggccaagggacaagtggtctaccg

SEQ ID NO: 191717 - DNA, 640 bp, Homo sapiens
  misc_feature: GYAE6OF02GYKAG.35.44.D11.1.454.CMB.1.raw
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtcctcaagttccaggggaaggggctggtgtgggtttcacgtattacgagtgatgggactgacacaatctagcggactccgtgaagggccgattcacccctnacagacacaccacaagacacactatactntacgaactaagtacgaaactagtcgtaggaacgacgaccggaacggaccgaccggtcgttcgttaactttaacgtttaccgtggttacgaacgtaaacgggtagggtaccggtacttaaccgtaagttaccgttaaggtttttacgggggttttataacgtttccggttaccgggttaccggggggaaaccggttaaacggggtaacttaacggggttcggttaaccccgg

SEQ ID NO: 191718 - DNA, 562 bp, Homo sapiens
  misc_feature: GYAE6OF02GV3P1.35.44.D11.1.454.CMB.1.raw
  modified_base (322)..(322): a, c, t, g, unknown or other
  misc_feature (322)..(322): n is a, c, g, or t
  modified_base (477)..(477): a, c, t, g, unknown or other
  misc_feature (477)..(477): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttcgtgtaggccatttaaagtgtcagtgtgaggtgcagctggtggagtccgggggaggcttagttcagcctgggggtccctgagactctcctgtgcagcctctggattcacctttcagtagtcatggatgcactgggtcctcaagttccagggaagggctggtgtgggtttcaggtattacggngtgagtggactgacacaatctacggcgtactcggtaggaacggctacttcccacccccgtcagacgacaacgaccaagaacacactatatctacgacaaatgaactagtcagagacgcgaggacgacgctgtactagttacgtgtagacgaaggnggtgactacgatacgtagtttacggtttagacgttcgttacggtacggggtaaccgaaagggtactaaggttcggtacctaccgg

SEQ ID NO: 191719 - DNA, 555 bp, Homo sapiens
  misc_feature: GYAE6OF02GVJ59.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggagcttagttcagccgtgggggtccctgagactctcctgtgcagcctctggattcaccttcagtagtcactggatgcacgtgggtcctcaagttccaggggagggctggtgtgggttcacgtattacgagtgagtgggactggacacaatctacgcggactccggtagaacgggccattccaccccctcgaagacgaccaacgccaagaaccacactaatactctagacaatacgaacagtacagagagaccgagaccacggctgtactattactgtgacgaagaggtcgactacatacgtagttaggttttgaacttcgtagtacgggaccgaagggactaagtcggtactaccgg

SEQ ID NO: 191720 - DNA, 525 bp, Homo sapiens
  misc_feature: GYAE6OF02F3L3I.35.44.D11.1.454.CMB.1.raw
  modified_base (464)..(464): a, c, t, g, unknown or other
  misc_feature (464)..(464): n is a, c, g, or t
  modified_base (485)..(485): a, c, t, g, unknown or other
  misc_feature (485)..(485): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagcctggggggtccctgagactctcctgtgcagcctctggattcaccttcagtagtcactggatgcactgggtcctcaagttccagggaagggctggtgtgggttcacgtattacgagtgatgggactgacacaatctacgcggactccggtgaacgggccgattccacccctcagagacaacgcaagaacacactatatctgacaaatgaacagtctgagacgccgaggacacggctgtctattactgtgcaagnggtgctacatcattggtttanacttcgtcgtcggggaccaagggacaagtcggtctaccgg

SEQ ID NO: 191721 - DNA, 559 bp, Homo sapiens
  misc_feature: GYAE6OF02I1BXR.35.44.D11.1.454.CMB.1.raw
  modified_base (431)..(431): a, c, t, g, unknown or other
  misc_feature (431)..(431): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtggggggtccctgagctctcctgtgcagcctctggattcaccttcagtagtcactggatgcacgtgggtccgtacaagttccgaggggaaggggcgtgggtggttgggtttcacgtattacggagtgagtgggactgacacatctacgcgactccgtgacggcattccacccctcagacgacaacgcaagaacacactatatctgacaaatgaacngtcagagacgccgaggaccacggctgtacttattactgtagacgaaggtaggtgactacaagttcgtagtttggtttagattccgtcggtacgggaccgtaagggactaacggttcggtaccgtaccg

SEQ ID NO: 191722 - DNA, 546 bp, Homo sapiens
  misc_feature: GYAE6OF02FTGQ1.35.44.D11.1.454.CMB.1.raw
  modified_base (414)..(414): a, c, t, g, unknown or other
  misc_feature (414)..(414): n is a, c, g, or t
  modified_base (496)..(496): a, c, t, g, unknown or other
  misc_feature (496)..(496): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccagggaagggctggtgtgggtttcacgtattacgagtgatgggactgacacaatctacgcggactccgtgaagggccgattccaccccctcagacgacaacgccaagaacacactatatcngacaaatgaacagtctgagagcgaggacacggctgtctattacgtgtgacaagaggtgactacaatcgtaagttggttttanattcgtacgtcgggggaccctaaaggggaccaagttcggtacctacccgg

SEQ ID NO: 191723 - DNA, 586 bp, Homo sapiens
  misc_feature: GYAE6OF02HN8VG.35.44.D11.1.454.CMB.1.raw
  modified_base (431)..(431): a, c, t, g, unknown or other
  misc_feature (431)..(431): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccgtcaagttccagggaaggggctggtgtgggtttcacgtatacggagtgatgggactgacacaatctacgcggactccggtgaagggccattccaccccctcagacacaacgaccaagaaccacactatatctagacaaatgaaacngttactgagacgaccgaggaccacggctgtactagttacctgtagacgaaaggagggtcggactaacgaattccgtaaagtttgggtttttagaactttccgtacggtcgggggtacccgaaaggggtaactaacggttcgggtaccctacccgg

SEQ ID NO: 191724 - DNA, 542 bp, Homo sapiens
  misc_feature: GYAE6OF02H2BYK.35.44.D11.1.454.CMB.1.raw
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (499)..(499): a, c, t, g, unknown or other
  misc_feature (499)..(499): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccgtcaagttccagggaggggctggtggtgggttcacgtattacgagtgatgggactgacacaatctacgcggactccgngaaggcacttcacccctcagagacaacgccaagaacacactanatctgacaaatgaaccagtctagagagccgaggacacggctacgtactattactgtgcgaagagggtggactacgaatctattagggttttanattcgtcgtcggggaccaagggacaagttcgggtactacccgg

SEQ ID NO: 191725 - DNA, 561 bp, Homo sapiens
  misc_feature: GYAE6OF02I79K8.35.44.D11.1.454.CMB.1.raw
  modified_base (510)..(510): a, c, t, g, unknown or other
  misc_feature (510)..(510): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtccgtcaagttccaggggaaggggctgggtggtgggttcacgtattacgagtgatgggactgacacaatctacgcgactccgtagaacggcgactccacccctcacgagacaacgccaagaacacactatatctagacaaatgaacagtctagagacgccgaggaccacggtctgtctattactgtagacgaaaggtggtagactacaatccgtaagtttggttttnaacgttcgtacggttggggacctaaagggactaaggttcggtacctaccgg

SEQ ID NO: 191726 - DNA, 543 bp, Homo sapiens
  misc_feature: GYAE6OF02IKMMF.35.44.D11.1.454.CMB.1.raw
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (498)..(498): a, c, t, g, unknown or other
  misc_feature (498)..(498): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtcctcaagttccgaggggaaggggctgggtgtgggttcacgtattacgagtgatgggactgacacaatctacgcgactccgtagaacgggccattccacccctcagacacaacgccaaagaacacactatatctagacaaatgaaacagtctagagagccgaggacacggctgtctattcngtncgaagnggtgactacaatcgaattggtttanacttcgtacggtggggaccaagggactaagtcgggtacctaccgg

SEQ ID NO: 191727 - DNA, 601 bp, Homo sapiens
  misc_feature: GYAE6OF02G2ZEG.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccgtcaagttcccaggggaaggggctgggtgtgggtttcacgtattacggagtgatgggactgacacatcacgcggactccgtgaagggccgattccaccccctcagacgacaacgccaagaaccacactatatctacgacaaaatgaacacgtctagacgagccgaaggaacgacggctacgtctaactttacgtcgtgtaccgaaagtacgggtcgacgttacgtaagtaccgtaattacgggtttttacacgttaccgttccgttacggggggaccctaaaggggtaacctaaagttcgggtaccttaaccccgg

SEQ ID NO: 191728 - DNA, 569 bp, Homo sapiens
  misc_feature: GYAE6OF02G88N0.35.44.D11.1.454.CMB.1.raw
  modified_base (414)..(414): a, c, t, g, unknown or other
  misc_feature (414)..(414): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggtaggcttagttcagccgtgggggtccctgagactctcctgtgcagcctctggattcaccttcagtagtcactggatgcacgtgggtccgtcaagttccgaggggaaggggctggtgtgggttcacgtattacgagtgagtgggactgacacaatctacgcgactccgtagaggccattccacccctcagacgacaacgcaagaacacactatatcngacaaatgaaacagtacctagacgacgccgaaggtaccacggctagtctaattacgtggtgacgaagagggtgacttacaagtcgtagtttaggttttagacttccgtacggtacggggaccgtaaagggtactaaggttcggtacctaacccgg

SEQ ID NO: 191729 - DNA, 606 bp, Homo sapiens
  misc_feature: GYAE6OF02JEYAS.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtccgtcaacgttccgaggggaaggggtctgggtggtgggtttcacggtattacgagtgagtgggactgacacaatctacgcgactcgagaaggccatccacccctcagacgacaacgccaaagacacactatatctagacaaatcgaacagtctagacgacgcgacggacacgggctaggttacctaagttaccgtgtacgaccaaagggtagggtcgtactaacgaattccgtaaggtttacgggttttacgacttaccggttccggtacggggggtaaccctaaagggggtacctaacggttacgggtacccttaacccggg

SEQ ID NO: 191730 - DNA, 519 bp, Homo sapiens
  misc_feature: GYAE6OF02FRCRL.35.44.D11.1.454.CMB.1.raw
  modified_base (487)..(487): a, c, t, g, unknown or other
  misc_feature (487)..(487): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctgggggtccctgagactctcctgtgcagcctctggattcaccttcagtagtcactggatgcactgggtccgtcaagttccagggaaggggctggtgtgggttcacgtattacgagtgatgggactgacacaatctacgcggactccgtgaagggccatccacccctcagagacaacgccaagaacacactatatctgacaaatgaacagtctagagagccgaggacacggctagtctattactgtagcaagagtgctacaatcaattggtttanatctcgtgggaccaagggacaagtgtctaccg

SEQ ID NO: 191731 - DNA, 544 bp, Homo sapiens
  misc_feature: GYAE6OF02GP4A9.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtcctcaagttccagggaagggctgggtgtgggtttcacggtattacgagtgatgggactgacacaatctacgcgactccgtgaagggccattccaccccctcagacgaccaacgccaagaaccacactatatctagacaaatgaaacagtctagagacgccgaggacacggctgtactattactgtagcaaggtaggtgctacaatctaagttggttttagattcgttcgtacggggccaaagggacaagttcggtactaccg

SEQ ID NO: 191732 - DNA, 570 bp, Homo sapiens
  misc_feature: GYAE6OF02F4HL6.35.44.D11.1.454.CMB.1.raw
  modified_base (334)..(334): a, c, t, g, unknown or other
  misc_feature (334)..(334): n is a, c, g, or t
  modified_base (438)..(438): a, c, t, g, unknown or other
  misc_feature (438)..(438): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagccgtggggggtccctgagactctcctgtgcagcctctggacttcaccttcagtagtcactggatgcacgtgggtccgtcaacgttccgaggggaggggctgggtgtgggttcacggtattacgngtgagtgggactgacacatctacggcgtactccggtaggaacgggccgtacttccacccctcacgagaccaacgccaagaaccacactaatactactgacaaangaacagtctagagacgccgaggaccacggctgtactagttactgtcgacaaggtaggtgacctanaatcgtagtttgtttagnttcgtggtacggggacctaaagggtactaacggttcggtacctacccgg

SEQ ID NO: 191733 - DNA, 597 bp, Homo sapiens
  misc_feature: GYAE6OF02HFTJ8.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtgggagtcccgggggaggcttagttcagccgtcggggggtcccgtcgagacgtctcctgtgcagcctctggattctaccttcagtagtcactggatgcactgggtccgtcaagtccagggaaggggcgtggtgtgggttcgacgtattacgagtgagtgggacgtgacacaatctacgcggactcggtggaacgggcgatccacccctcagacgacaacgaccaagaacacactaatatactgacaaatgaacagtcgtagagacgcgtagacgacgggtctacgtactacttacgtcgtggaacaaggtacgggtaggacctacgaacttacgtagtttacgggtttttgacttaccggttcggtaggggcccggtaaagggtaccgtaagttcgggtacctaaccccggg

SEQ ID NO: 191734 - DNA, 577 bp, Homo sapiens
  misc_feature: GYAE6OF02I08IV.35.44.D11.1.454.CMB.1.raw
  modified_base (463)..(463): a, c, t, g, unknown or other
  misc_feature (463)..(463): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctgggggtccctgagactctcctgtgcagcctctggattcaccttcagtagtcactggatgcactgggtccgtcaagttccagggaagggctggtgtgggttcacgtatacgagtgatgggactgacacaatctacgcggactccgtgaaggccattccacccctcagagacaacgccaaagaacacaactatatctagacaaatgaaacagttctagaagacgccgaggaccacggctgtactatttacngtagacaaaggtagggtagactaacaagttccgtaagtttcgggtttttagaactttccgtacggttagggggaccctaaagggggacctaaaggttcgggtaccctaacccgg

SEQ ID NO: 191735 - DNA, 543 bp, Homo sapiens
  misc_feature: GYAE6OF02IJQW2.35.44.D11.1.454.CMB.1.raw
  modified_base (363)..(363): a, c, t, g, unknown or other
  misc_feature (363)..(363): n is a, c, g, or t
  modified_base (501)..(501): a, c, t, g, unknown or other
  misc_feature (501)..(501): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagccgtggggggtccctgagactctcctgtgcagcctctggattcaccttcagtagtcactggatgcacgtgggtccgtcaagttccgaggggaggggctgggtgtgggttcacgtattacgagtgagtgggactgacacatctacgcgactcgngaaggccattccacccctcacgacgacaacgccaagaacacactatactctagacaaatgaaactagtctagagacgcgaggacaggctagtctattacgtgtagacaaggaggtgactacaatcgtagttggtttanacttctcggtcgggaccaagggtacaggttcggtactaccgg

SEQ ID NO: 191736 - DNA, 734 bp, Homo sapiens
  misc_feature: GYAE6OF02IJ55V.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgtttgcctaatttttaaaggtgtaccagtgtgaggtgcagctgggtggaggtccggggggaggcgtttagttcgaggccgtcggggggtccctggagactcgttccgtgtggcgacgccttcgtggtacttccgtacctttcagttacgtcacgttgggattcggcacgttcggggtcccgtagtaacgttccgaagggggaggggtctgggttggtgggtttacacggttagttacggaaggttgaagttggggactaggtaacaactaagtcgtaccggcggtacctccggtaggaaacgggcccgtattccccgacccctgaacggacgtaaccaacgaccgaaagaaccaactaaacctaactactacgtacgaactaaaagtcgaaacacgttacaggaagtacggaccgtaaggaccgacgggtccttagttacctaagttactagggttacgaaccgtaaagggtacgggtgaacgttacgaagttccgtaaagtttgggtttttaacgacttttaccggtaccgggttacggggaacccgtaaaggggtaaccttaaaggttccgggtaaccttacccgg

SEQ ID NO: 191737 - DNA, 551 bp, Homo sapiens
  misc_feature: GYAE6OF02F2UPS.35.44.D11.1.454.CMB.1.raw
  modified_base (330)..(330): a, c, t, g, unknown or other
  misc_feature (330)..(330): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccgtcaagttccgaggggaagggctggtgtgggttcaggtattacgngtgatgggactgacacaatctacgcggactccgtggaacggcctatccaccccctcagacgacaacgccaagaacacactatatctgacaaatgaacagtcagagacgcgagacacggntgtcttaattctgtgacaaaggnggtggactacaagttcaagtttggttttacgatttccgtacggtcggggaccaagggaactaagttcggtactacccgg

SEQ ID NO: 191738 - DNA, 553 bp, Homo sapiens
  misc_feature: GYAE6OF02F5V40.35.44.D11.1.454.CMB.1.raw
  modified_base (365)..(365): a, c, t, g, unknown or other
  misc_feature (365)..(365): n is a, c, g, or t
  modified_base (428)..(428): a, c, t, g, unknown or other
  misc_feature (428)..(428): n is a, c, g, or t
  modified_base (504)..(504): a, c, t, g, unknown or other
  misc_feature (504)..(504): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagccgtgggggtccctgagactctcctgtgcagcctctggattcaccttcagtagtcactggatgcactgggtcctcaagttccgagggaaggggctgggtgtgggtttcacggtattacgagtgagtgggactgacacaatctacgcggactccgngacggccgatccacccctcagacgacaacgccaagaacacactatatctagacaaatgaaacngtcagagagccgaggacacggctgtactattactgtagcaaggaggtcgacttacgaatcgtagttcgggttttanactttcgtcggtacggggaccaaaggggtacaaggttcggtactacccg

SEQ ID NO: 191739 - DNA, 610 bp, Homo sapiens
  misc_feature: GYAE6OF02GK3Z7.35.44.D11.1.454.CMB.1.raw
  modified_base (548)..(548): a, c, t, g, unknown or other
  misc_feature (548)..(548): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccgggggaggcttagttcagccgtgggggtccctgagactctcctgtgcagcctcgtggattcaccttcagttagtccactggatcgcacgtcgggtcccgtacgtaacggttccgaagggggaaggggtctgggttggttcggggtttccacggttagttacggagttgagtgggactgaacacgaatcgtacggcggacctccggtaggaacgggtccgacttcccaccccctcgaacgacgaccaacgccaacgaacacactatactctagacaaactcgaacacgttctagacgacgacgaggacacggtctacgttactacttacgtgtacgacgaaggaggtgacctanagtctagttggttttacagttccgtagtcggggaccaagggacctaagtcggtactacccgg

SEQ ID NO: 191740 - DNA, 704 bp, Homo sapiens
  misc_feature: GYAE6OF02JXR73.35.44.D11.1.454.CMB.1.raw
tcagtacagatcgtcacgaccggtgctcgatttagcgcagtacgaagggggccccgagccctgggactcccagctgtttctgcttgctgatcaggactgcacacagagaactcaccatggagttcgggctgagctgggttttccttgttgcctattttaaaaggtgtccagtgtgaggtgcagctggtggagtccggggaggcttagttcagccgtgggggtccctgagactcgtccgtgtcgacaggcctcgtgggacttcgaccttcagtagtcacgtggatgcacgtcggggtccgtcgaacggttccgaaggggaacgggggtctgggttggtgggtttcgaacggttatacggagtcggagtacgggactagaacgtactaagtccgtaacgcggtactaccggtagaacgggcgtacttcccgaacccctaccgaagacgaaccaacgaccgaaacgaaccactaacgtaactatctagactaaagtacgaaacctaggtacctaggaacggtaacgccggtaaacggaccgaaggtcttaggttacttaagtaacccgttgggtacgaaccggaaaggtacgggttacgaccgttaacgtaacttccgttaaaggtttggttttacgaacgtttacggtcccgggttaggggtacccgtaaaggggtaactaacggtttccgggtacccgtacccgg

SEQ ID NO: 191741 - DNA, 565 bp, Homo sapiens
  misc_feature: GYAE6OF02JDJNG.35.44.D11.1.454.CMB.1.raw
  modified_base (423)..(423): a, c, t, g, unknown or other
  misc_feature (423)..(423): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggaggtccgggggaggctagttcagccgtgggggtccctgagactctcctgtgcagcctctggacttcaccttcagtagtcactggatgcacgtgggtccgtcaagttccgagggagggctggtgtgggttcacgtatacgagtgagtgggactgacacaatctacgcgactcgtgaggccgatccacccctcagacgacaacgccaagaaccacactatactcagacaaatcgaacngtctagacgagccgaggaccacggctagtactattacgtgtagacaaggaggtcgacttacgaatccgtaagtttgggttttagaacgtttcgttacggtcggggacctaaaggggtacctaaggttcgggtaccctaccgg

SEQ ID NO: 191742 - DNA, 547 bp, Homo sapiens
  misc_feature: GYAE6OF02JG4HK.35.44.D11.1.454.CMB.1.raw
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggaggcttagttcagcctggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaacgggccgattccacccctcagagacaacgccaagacacactatatctagacaaatgaaacagtctgagacgccgaggacacggctgtactattacngtagcaaggnggtgactacaatctaagttcggttttgacttcgtacgtcggggaccaaggggactaaggttcggtacctaacccgg

SEQ ID NO: 191743 - DNA, 565 bp, Homo sapiens
  misc_feature: GYAE6OF02IFJR8.35.44.D11.1.454.CMB.1.raw
  modified_base (395)..(395): a, c, t, g, unknown or other
  misc_feature (395)..(395): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctctggattccaccttcagtagtcactggatgcacgtgggtccgtcaagttccgaggggaaggggctgggtggttgggtttcacgttattacgagtgagtgggactgacacaatctacgcggactcggtagaagggccatccacccctcagngacacgacaagaacacactatatctagacaaatgaaactagttctaggagacgaccgaggaccacggtctagtctattctgtcganaaggnggtgactacaatcgtagtttacggtttnaacttcgtacggtcggggacctaaaggggactaaggttcggtactacccgg

SEQ ID NO: 191744 - DNA, 521 bp, Homo sapiens
  misc_feature: GYAE6OF02JFV2G.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagagactatttcatgacctggatccgccagactccagggaaggctggagtgggtctcacacatcagcagtactggcaatcccatgtacctacgcagactctgtagaagggccattcacctattttaggacaacgccaagggttcgctgtatctgcaaatgaacagcctagagagtcgaggacgacggaccatctaattactgtgacagagtcgtgtagtggtggcgtagttggtggtcgtacggtacgtacggtaggtacgg

SEQ ID NO: 191745 - DNA, 628 bp, Homo sapiens
  misc_feature: GYAE6OF02G1N85.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtggggggtccctgagactctcctgtgcagcctctggattcaccttcagtagtcactggatgcacgtgggtccgtcaagttccgaggggaaggggctgggtgtgggtttcacgtattacgagtgagttgggactggacacaatcgtacgcggactccggaggaacgggccgtaacttcccaccccctaccagacgacaaaccgacaaaacgaacacaactaatactctagactaaatacgaacagttctagacggagacccggaaggaaccgtcggacgttcgtacttaacttacgtgttacgacgaaaggcgggtagacttacgaagtaccgtaggtttacggttttagaactttccgttacggtacggggtacccgaaagggtacctaaacggttcgggtaccctaacccgg

SEQ ID NO: 191746 - DNA, 550 bp, Homo sapiens
  misc_feature: GYAE6OF02IH4O3.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgccatttttaaaaggtgtccagtgtgaggtgcagctgttggagtcgtgggggaggcttggcacagccgtgggggtccctgagactctcctgtgcagcctctggattcacctttagcacctatggcatgagctgggtccgccgggctccgaggggaggggctgggagtgggtctcgaactattgatggtagtgctcaataacactatcggtacgcagactcggtggacggggtccggttacaccatcctccagacgaacaattccgaaggaacacgctagtactactaacaaatggacagtctagagagccgagacacggtcttatatactgtagacgtaagttcgaagtgtcggactggacaaggtacgggtacgggaattacgagtaccgtaggtaccgggg

SEQ ID NO: 191747 - DNA, 566 bp, Homo sapiens
  misc_feature: GYAE6OF02FPB16.35.44.D11.1.454.CMB.1.raw
  modified_base (257)..(257): a, c, t, g, unknown or other
  misc_feature (257)..(257): n is a, c, g, or t
  modified_base (472)..(472): a, c, t, g, unknown or other
  misc_feature (472)..(472): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggaggtccgggggagcttagtcagccgtgggggtccctgagactctcctgtgcagcctctggattcaccttnagtagtcactggatgcacgtgggtccgtacaacggttccgaaggggaaggggtcttgggtggttggggtttaccacggttattacggagtgagtgggactgacaactaatcgtaacgcggtactccggtagaacgggccgaacttcccgaccccctcgaacgacgaacaaccgaccaagaacacactatactctagacaaatgaacagttcaganacgcgagaccagctagtactatactgtacgacgaagagtgactagatcgtagttgtttagcttcgtcgtgggaccaagggactagtgtcctacg

SEQ ID NO: 191748 - DNA, 528 bp, Homo sapiens
  misc_feature: GYAE6OF02GWB8H.35.44.D11.1.454.CMB.1.raw
  modified_base (345)..(345): a, c, t, g, unknown or other
  misc_feature (345)..(345): n is a, c, g, or t
  modified_base (463)..(463): a, c, t, g, unknown or other
  misc_feature (463)..(463): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtcctcaagttccgagggaagggcgtggtgtgggtttcacgtattacgagtgatgggactgacanaatctacgcggactccgtgaacgggccgattccaccccctcagacgacaacgccaagaacacactatatctgacaaatgaacagtctagagagccgagacacgctgtctattactgtnacgaagtaggtgctacatcgtagttggtttagattctgtcgggaccaagggacaagtggctaccg

SEQ ID NO: 191749 - DNA, 673 bp, Homo sapiens
  misc_feature: GYAE6OF02H6X5A.35.44.D11.1.454.CMB.1.raw
  modified_base (245)..(245): a, c, t, g, unknown or other
  misc_feature (245)..(245): n is a, c, g, or t
  modified_base (602)..(602): a, c, t, g, unknown or other
  misc_feature (602)..(602): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgccattttaaaaggtgtccagtgtgaggtgcagctggtggaggtccgggggaggcttagttcagccgtgggggtcctgagactctcctgtgcagcctntggattccaccttcagtagtcactggatgcacgtgggtccgtactaacgttaccgagggaacggggcgtgggttggttgggttctacgtattacggtagtgagtgggtactaggacaacaatcgtaacgcggtacctcggtacggaacgggtccgaacttccccacccctccagacgaaccaaccgccaaagaacacaactatactcgtacactaaagcgaaactagtcgtagaaggaacgtaccgggaacggaaccgaccgggtaccttacggttaccgtttaactttacgttacggtgtaacggaaggtacggggtacgaccgttaacacgttacgtagtttacgggtttttacncgtttaccggtaccggttaccgggggaccgtaaagggtaaccgtaaggttaccggtacccgttaaccccgg

SEQ ID NO: 191750 - DNA, 636 bp, Homo sapiens
  misc_feature: GYAE6OF02F4542.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtgggggtccctgacgactctcctgtgcagcctctggacttccaccttcagtagtcaactggatgcacgtgggtccgtacaacggttccgaaggggtaaggggcgtagggtggttcggggtttcaacggttagttaacggagtggtacgttggggacttaggactacgaatccgtacggcggtactccggtaggaaggccgtattcccacccctcaacgacgaccaacgaccaagaacacactatatctagacaaatagaaactagtacagagacgaccgagaccacggctgtactattactgtcgacgaaggtaggtacggacttacgaacgttacgtagttttacgggtttacgaacgtttccgttacggtacggggtaaccggtaaagggactaacggttcgggtacccttaaccccgg

SEQ ID NO: 191751 - DNA, 544 bp, Homo sapiens
  misc_feature: GYAE6OF02GO3PN.35.44.D11.1.454.CMB.1.raw
  modified_base (413)..(413): a, c, t, g, unknown or other
  misc_feature (413)..(413): n is a, c, g, or t
  modified_base (504)..(504): a, c, t, g, unknown or other
  misc_feature (504)..(504): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctctggattcaccttcagtagtcactggatgcactggtccgtcaagttccagggaaggggctggtgtggtttcacggtattacgagtgatgggactgacacaatcacgcgactcgtagaagggcgattccacccctcagacacaacgccaagaacacactaatatcttanaaatgaaacagtactagagtagaccgagaccgacggctagtaccttattacgttgtcgacaaggaggtggacttaacatctaagtggtttnatctcgtagggaccaagggacaagtggtaccgaccttccg

SEQ ID NO: 191752 - DNA, 612 bp, Homo sapiens
  misc_feature: GYAE6OF02IJOTG.35.44.D11.1.454.CMB.1.raw
tcagtacagatcgtcacgaccggtgctcgatttagcgcagtacgaagggggcccccagccctgggactcccagctgtttctgcttgctgatcaggactgcacacagagaactcaccatggagttcgggctgagctgggttttccttgttgccatttttaaaaggtgtccagtgtgaggtgcagctggtggagtccgggggaggcttagttcagccgtggggggtccctgagactctcctgtgcagcctctggattcaccttcagtagtcacgtggatgcacgtgggtccgtacaagttccgaaggggagggggtcgtgggttggttgggtttcacggttattacggagtgagtgggactgactacaatcgtacgcggtactccggtaggaacggccgtaactttcccaaccccctaccgaaggaacgaaccgaaccgaccaaagaaccaacaactaatactctagacaaatacgaacagtctagagacgcgagacacggctgtactacttactgtacacgtaagacggtacgactacagtcgtaagtttggtttagaacgttccgtacggttacggggacctaaagggtacctaagttcggtaccgtacccg

SEQ ID NO: 191753 - DNA, 612 bp, Homo sapiens
  misc_feature: GYAE6OF02G4WKY.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctccgtgtgcagcctctggattcaccttcagtagtcactggatgcacgtgggtccgtcaagttccgaaggggacggggcgtggtggtgggtttcacggttattacggagtgagtgggactgacacaatcacgcggactcggtaggaacggcgacttccacccctcgaagacgaccaaccgcaaagaaccacaactatactcgtagaactaaatagaacagttacctaggaacgacggaccgaaggaccgaccgggtctacgttactaacgtttacgtgtacggaacgaaacgtaactatacgtacgtacgtaacttaacgtatcgtaccgttacggaacgttacttaaagttggtaacgtacgtttacgaccttacgggg

SEQ ID NO: 191754 - DNA, 537 bp, Homo sapiens
  misc_feature: GYAE6OF02JIGO2.35.44.D11.1.454.CMB.1.raw
  modified_base (364)..(364): a, c, t, g, unknown or other
  misc_feature (364)..(364): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (499)..(499): a, c, t, g, unknown or other
  misc_feature (499)..(499): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccaggggaaggggctggtgtgggttcacgtattacggagtgatgggactgacacaatctacgcggactccgngaagggccatccacccctcagacgacaacgccaagaacacactatatctgacaaatcgaaactgtctagagacgccgaaggaccacggctacgtctattaccngtnacaagaggtgctagaatctagttggtttnattcgtgacggggccaagggactaagtcggtactaccg

SEQ ID NO: 191755 - DNA, 732 bp, Homo sapiens
  misc_feature: GYAE6OF02F7AXK.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttccgtgttaggccatttaaaggtgtccagtgtgaggtgcagctggtggagtccgggggaggcttagttcagccgtggggggtccctgagactctccgtgtgcagcctctggattcaccttcagtagtcactggatgcacgtcgggtccgtcgtaagttcccgaggggaagggggcttggggtggttcggggtttacacggttagtttacggagtggagtgggactggaacctacaacgtcgtacgcgggtacttccggtaggaacggggtacccgtacttaccccgaaccccccctcgaacggtaaccgaaccgaaccgaacccgaaacgaaaccctaacccaaaccttaactaacttacccgtaggtaacaaaacgttacggaaacctaacggttccgtaggacgtacggacccggaacggacgaccgggtcgtacgttaccgtagtttacccgtggttacgtaacggaaaggtagggtacggtacctacgtaagtaccgttaaggtttacgggttttagtaacgttccggttacggtacggggggtaccctaaaggggtacctaacgggttacggtacccgttaaccccgg

SEQ ID NO: 191756 - DNA, 676 bp, Homo sapiens
  misc_feature: GYAE6OF02JS4G9.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggaggcttagttcgagccgtgggggtccctgagactctccgtgtgcagcctctggattcaccttcagtacgtcactggatgctacgtgggtccgtcgaagttcccgaggggaacggggtcgtgggtaggtcgggtttaccgacggttagttacggaggttcggtagttgggacttagaaccaacgtaagtcgtaacggccggtacgtaccgtagggaacgggccgtaacgttcccacccccgtacaacggaacggaccaaaccgccaaacgaaaccacgtaactaatactctagaactaaatacgaaactgtactaggaagtacggaccgtaaggaccgacgggccttagtacctagttacgtagtcgaaccggtaaggtaagggtaccgtactaactacgttacgtaacggtttggtttagactttccggtacggttaaggggtcccaaaagggtactaaggttccggtacttaacccgg

SEQ ID NO: 191757 - DNA, 537 bp, Homo sapiens
  misc_feature: GYAE6OF02F21QA.35.44.D11.1.454.CMB.1.raw
  modified_base (363)..(363): a, c, t, g, unknown or other
  misc_feature (363)..(363): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtcctcaagttccaggggaagggctggtgtgggtttcacgtattacgagtgatgggactgacacaatctacgcggactccgnggaagggccattccaccccctcagagacacgccaagaacacactatatcagacaaatgaacagtctgacgagccgaggaccacggctgtctattacgtgtagcaaaggtgtggctacaatcaagttggttttagacttcgtcgtaggggccaagggactagtggtactacccgg

SEQ ID NO: 191758 - DNA, 607 bp, Homo sapiens
  misc_feature: GYAE6OF02I3FHN.35.44.D11.1.454.CMB.1.raw
  modified_base (453)..(453): a, c, t, g, unknown or other
  misc_feature (453)..(453): n is a, c, g, or t
  modified_base (560)..(560): a, c, t, g, unknown or other
  misc_feature (560)..(560): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtgggggtccctgagctctcctgtgcagcctctggattcaccttcagtagtcactggatgcacgtgggtccgtcgaagttccgaaggggaacggggtcgtgggtggttgggtttcacgttagttacggagtgagtgggactgacactaatcctacggcggtacctaccggtaggaacgggccgtacttcccgaacccccctccagacgaaccaaccgaccaagaaaccacaactatacncctagactaaatgaaactgtactagaagacgaccgaggaccacggctgtactagttactggtacgacgaaaggtggtacgactaactagtacgtagtttggttttanacgtttcgtacggtcgggaccaagggaactaaggtcggtacctaccg

SEQ ID NO: 191759 - DNA, 551 bp, Homo sapiens
  misc_feature: GYAE6OF02JG4Q6.35.44.D11.1.454.CMB.1.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtggtccgtcaagttccgagggagggctggtgtggttcacgtatacgagtgagtggactgacacaatcgtacgcggactccgtagaacggcctatccacccctcagacgacaacgcaagacacactatatcagacaaatgaacngtcagagacgcgagacncggctacgtctattacgtgtagcgaaggcgtagtactactaagtcgtaagtttggttttacgacttcgttacggtcgggtacctaagggactaagttcgggtcctaacccgg

SEQ ID NO: 191760 - DNA, 614 bp, Homo sapiens
  misc_feature: GYAE6OF02GI35X.35.44.D11.1.454.CMB.1.raw
  modified_base (394)..(394): a, c, t, g, unknown or other
  misc_feature (394)..(394): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagcctggggggtccctgagactctcctgtgcagcctctggattcaccttcagtagtcactggatgcactgggtccgtcaagttccaggggaaggggctggtgttgggtttcacggtattacgagtgattgggactgacacaatcgtacgcggactccgtagaacgggccattccaccccctcaganaccaacgccaagaacacactaatatctagactaaaatgaaacaggttctagagacgccgaaggaccgacggctaggtacttatttaaccgtgttacgacaaaggtaggtagggacctaacgaagttaccgtaagtttagggttttttagaatttccgttaccggttacgggggacccgttaaaggggaaccgtaacggttacgggtacccttaaccccgg

SEQ ID NO: 191761 - DNA, 668 bp, Homo sapiens
  misc_feature: GYAE6OF02I43OY.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccatggagttcgggctgagctgggttttccttgttgcctattttaaaaggtgtccagtgtgaggtgcagctgttggagtcgtggggagcttggcacagccgtgggggtccctgagactctcctgtgcagcctctggattcaccttagctacctagtggacagtgagcgtcgggtccgccgggtctccggaaggggaacgggtcgtaggacggtgggtcctacgaacttagttcgagtggtagtgtcgtacaactaacacgtagttcggtacgctaacggtacctccgggtaggaccgggggtacccgtttaccgaaccctacgtcccgtaccgaaggtaaccgaaactaaacgttccgaaggaaaccacggtccttagtaactacgttaaacaaagtcgtaacacgttacgtaggaacgacggaccgaacggaacctaccggttaccttaagttaagttaccgtggtaccgaacgtaagttacgaacgtaggttcggacgtcggaaccgtacgtaacggggtacggttaagtacgtacgtacggtaccgtacgggg

SEQ ID NO: 191762 - DNA, 592 bp, Homo sapiens
  misc_feature: GYAE6OF02GXIXE.35.44.D11.1.454.CMB.1.raw
  modified_base (535)..(535): a, c, t, g, unknown or other
  misc_feature (535)..(535): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtccgtcaagttcccgaggggaagggctggtgtgggtttcacgtattacgagtgagtgggactggacacaatctacgcggactccggtggaacggccgattcccacccccgtcgaacgtacgaaccaaccgccgaaacgaaacgaccaactaactactactacgacaaatacgaactagtctagagacgaccgagacacggctgtactattactgtgacgaggtagtcgactacaatcgtaagttcggtttanacgttcgtcggtacggggtacccgaaaggggtacctaacggttcggtacctacccgg

SEQ ID NO: 191763 - DNA, 642 bp, Homo sapiens
  misc_feature: GYAE6OF02FJ4XV.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcgtgggtttccttgttgccattttaaaggtgtccagtgtgaggtgcagctggtggagtccgggggaggcttagttcagccgtggggggtccctgagctctcctgtgcagcctctggattcaccttcagtagtcactggatgcacgtgggtccgtcaagttccgaggggacggggcttgggtgttggggtttcacggttattacggagtgagtggggactgacacaatctacggcggactccgtaggaacgggcctattccaccccctcaggagtaccaacgccaagaccaactacctatactccagactaaacgtgaacagttactagacggacgaccggaaggaccgaacggtcgtacgttactttaacgtttacgtggttacgacgtaaagggtacgggttcggaaccttacgaattacgtaaggttttcgggttttagaactttcggtaccgggttacgggggaccgtaaacggggtaacgaacgtttacggggtacccttacccgg

SEQ ID NO: 191764 - DNA, 565 bp, Homo sapiens
  misc_feature: GYAE6OF02F9K10.35.44.D11.1.454.CMB.1.raw
  modified_base (515)..(515): a, c, t, g, unknown or other
  misc_feature (515)..(515): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtcctcagttccgagggaagggctggtgtgggttcacgtatacgagtgatgggactgacacatcgtacgcggactccggtagaacgggccgtacttccaccccctcgacgacgacaacgccaaagaacacactatactctagacaaatgaactagtctagagacgccgaggacacggctacgtctattacgtgtcgacaaggtggtagacctacgaatcgtaagttgggtttanacttcgttcggtacggggaccgaagggactaaggttcggtacctacccgg

SEQ ID NO: 191765 - DNA, 552 bp, Homo sapiens
  misc_feature: GYAE6OF02FR4KP.35.44.D11.1.454.CMB.1.raw
  modified_base (431)..(431): a, c, t, g, unknown or other
  misc_feature (431)..(431): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtcaagttccagggaaggggctggtgtgggtttcacggtattacgagtgatgggactggacacaatctacgcggactccgtgaagggccagtcaccccctcagacgacaacgccaagaacacactatatctagcaaatgaacagtcngagagcgaggacacggctagtctattactgtagcgaaagtagggtgactacaatcgtaattaggttttgaacttccgtgttacgggggccctaaaggggacctaagttcggtactacccgg

SEQ ID NO: 191766 - DNA, 651 bp, Homo sapiens
  misc_feature: GYAE6OF02I9TXU.35.44.D11.1.454.CMB.1.raw
  modified_base (461)..(461): a, c, t, g, unknown or other
  misc_feature (461)..(461): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagtcagccgtgggggtccctgagactctcctgtgcagcctctggattccaccttcagtacgtacacgtcggatgacacgtcgggtccgtactaacggttccgaggggaacggggtcgtgggttcggttgggtttccgacggttagttacggagtggagtgggtactgacacatcgtacgcgtacgtccgtaggacggcctactcccacccctcagacgacaaccgacaacgaacactactatactctagactaaancgaactagtcgtagagtacgacggaacggcgaacggtcttacgtactttagtacgtgtacgaacgtaaggtacggtacgtaactaaacgtcgttaacggtttaggttttcggaactttaccggtacggttaccgggggtaaccgtaacggggaaccgttaaggtcccggttaaccgtacccggtttaccc

SEQ ID NO: 191767 - DNA, 584 bp, Homo sapiens
  misc_feature: GYAE6OF02HYY8D.35.44.D11.1.454.CMB.1.raw
  modified_base (292)..(292): a, c, t, g, unknown or other
  misc_feature (292)..(292): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagtacagatcgtcacgaccggtgctcgatttagcgcagtacgaaggggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccggggggaggcttagttcaggccgtggggggtccctggagactctcctgtgcagcctctggattcaccttcagtagtcactggatgcactgggtcctnaagttccaggggaaggggctggtggtgggttcacgttattacggagtgagtgggactgacacaatcctacgcggactccgtgaacggcgattccaccccctcagacgacaacgccaaagaacacaactatactctgacaaatgaaacagtctagaagacgcgaaggacacggctgtctattacngtgacaaaggnggtgacttanaaactcgtaagtttgggttttacgaatttccgtcggtacgggggtaaccaaagggggtaaccaaaggttccgggtacctaaccccgg

SEQ ID NO: 191768 - DNA, 637 bp, Homo sapiens
  misc_feature: GYAE6OF02FKK6W.35.44.D11.1.454.CMB.1.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctgggggggtccctgagactctcctgtgcagcctctggattcaccttcagtagtcactggatgcactgggtccgtcaagttccagggaaggggctggtgtgggttcacgtattacgagtgagtgggactgacacaatctacgcggactcgtgaagggcgattccacccctccagacgacaacgaccaagaacacactatatctanactaaangaacagtctagagacggaccgtacggaccgaccgggtctacggttcttaagtttacgtacggttacgacgtaaacggaggttacgggaccttaacgaacgtacgttaaggtttacgggtttttaaggtaccgttacccgttagggttacccgggggtaaccgtaaaccgggggtaacccttaaggttacccgggttacccgttaacccccggg

SEQ ID NO: 191769 - DNA, 549 bp, Homo sapiens
  misc_feature: GYAE6OF02FV6UX.35.44.D11.1.454.CMB.1.raw
  modified_base (245)..(245): a, c, t, g, unknown or other
  misc_feature (245)..(245): n is a, c, g, or t
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttcgtgtagccgatttaaaggtgtcagtgtgaggtgcagctggtggagtccgggggagcttagttcagccgtggggggtccctgaggtacctctcctgtgcagcctntggattcaccttcagtacgtcactggatgcacgtgggtcctcgaacgttccgaggggaaggggtctggtgttcgggttcacggtattacgagtgacgtgggactgacanatctacgcgactcgagaacggcatccaccctnagacacacgcaagacactactatanctgacaaatcgaactgtctagagacgccgtagacacggctgtactattacgngtnacgagngtgactacagtacgttagtgttttacgagttccgttacggtcgggacaacgggtactaacgttcggtaccttacccg

SEQ ID NO: 191770 - DNA, 825 bp, Homo sapiens
  misc_feature: GYAE6OF02GBM4O.35.44.D11.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccggggagcttagttcagccgtgggggtccctgagacgtctcctgtncagcctntggattcaccttcagtagtcacgttggatgacacgtcgggtccgtctaaacggttcccgaaggggaacgggggtccttaggggttggttaggggttttccaacgggtttaatttaaccggaggttggtaagtggggtaaccttggaaccaacgtaaagttccgtaaacggccggtaacccttccggtaggaacggggacccgtaacttaccccgtaaccccccgttccgaaggaacgaacccgaaaccggacccgaaaaacggtaaacccaacgtaaccttaaacttaactacccgtacggaaactaaaaacgttacgaaaacctacggtttacgtaggaaccggtaacggaccgggtaaacgggaacccggtacggtaacctttcggttactttaaccgtttaacgtcggttaggaaaccgtaaagggttacgggtaccgggtaacttaaccgtaaacgtttacggtaacgttttagggttttttaaccgaagtttttcccggttaacggttacccggggggtaaccgttaaaacggggtaacctaaacgggttaccggttaacccgtttaaccccggg

SEQ ID NO: 191771 - DNA, 573 bp, Homo sapiens
  misc_feature: GYAE6OF02JEAQU.35.44.D11.1.454.CMB.1.raw
  modified_base (348)..(348): a, c, t, g, unknown or other
  misc_feature (348)..(348): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtgggggtccctgagactctcctgtgcagcctctggattcaccttcagtagcactggatgcactgggtcctcaagttccgaggggaaggggctggtggtggttcgacgtagttacgagtgagtgggactgacanaactctacgcgtactccgtagaacgggcattccaaccccctcgagacgacaacgccaaacgaacacacttatactctgactaaangaaacngttacctagacacggcgacggacacggctgtacttattacgngtcgacaaagaggtacgcttaacgaatcgtaagtttcggttttaggaacttctcgggtagggacccaaagggacaagttcgggtctaacccg

SEQ ID NO: 191772 - DNA, 625 bp, Homo sapiens
  misc_feature: GYAE6OF02F71JO.35.44.D11.1.454.CMB.1.raw
  modified_base (353)..(353): a, c, t, g, unknown or other
  misc_feature (353)..(353): n is a, c, g, or t
  modified_base (539)..(539): a, c, t, g, unknown or other
  misc_feature (539)..(539): n is a, c, g, or t
  modified_base (563)..(563): a, c, t, g, unknown or other
  misc_feature (563)..(563): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccgggggaggcttagttcagccgtggggggtccctgagactctcctgtgcagcctctggattcaccttcagtagtcactggatgcacgtgggtccgtcaacgttccgaggggaacgggctgggtgttgggtttcagtattacgagtgatgggactgacanaatcgtacgcggtactccggtaggaacgggcctacttcccgaccccctcgaacggaacaccaacgcccaaagaaccacaactaatactcctagactaaaatcgaaacagttctagaacgacgaccgaaggacgacggtcttacgtcttaagttacgtggtacgacgaaggtagggttggtacctanaacgtacgtagtttacgggtttanaacgttccgttacggtacgggggtacctaaaggggactaacgggttcggtaacccgtacccg

SEQ ID NO: 191773 - DNA, 556 bp, Homo sapiens
  misc_feature: GYAE6OF02G3LLH.35.44.D11.1.454.CMB.1.raw
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
tcagtacagatcgtcacgaccggtgctcgatttagcgcagtacgaagggggccccggccctgggactcccagctgtttctgcttgctgatcaggactgcacacagagaactcaccatggagttcgggctgagctgggttttccttgttgccattttaaaaggtgtccagtgtgaggtgcagctggtggaggtccggggggagtcttagttcagccgtggggggtccctgagactctcctgtgcagcctctggtattcaccttcagtagtcactggatgcactgggtcctnaagttccgaggggaagggctggtgtgggttcacggtattacgngtgagtgggactgacacatctacgcgactcgtgaacgggcattccacccctcagacgacaacgaccaagacacactatatctgacaaatgaaacagtctagagtacgccgaggaccacggctgtctattacgtgtagacaaggacggtggactacgtatctagttggttttacgcttcgtcggtagggaccgtaagggactaaggtcgtaccgtaccgttccg

SEQ ID NO: 191774 - DNA, 623 bp, Homo sapiens
  misc_feature: GYAE6OF02I5ZSO.35.44.D11.1.454.CMB.1.raw
  modified_base (359)..(359): a, c, t, g, unknown or other
  misc_feature (359)..(359): n is a, c, g, or t
  modified_base (435)..(435): a, c, t, g, unknown or other
  misc_feature (435)..(435): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctaattttaaaaggtgtccagtgtgaggtgcagctggtggagtccgggggagcttagtcagccgtgggggtccctgagactctcctgtgcagcctctggacttcaccttcagtagtcacgtggatgcacgtcgggtcctcaacgttccgaaggggaagggcgtgggttggtgggtttccacggttattacggagtgatgggactgaccanactctacgacgcctcgagaacggctactacccgcccctacagacaacacgacaaacgaaccacaactatactctanactaaactcgaactacgtactaggacgacgaaccgaacggaccgaccggtactagttacttacttaagtcggtagaacgaaggttaggcggtactacgtaacgttacgtaagtttgggttttacacgtttacgccggttacgggggaccctaaagggggtacctaacggtttcggacccgttacccgg

SEQ ID NO: 191775 - DNA, 678 bp, Homo sapiens
  misc_feature: GYAE6OF02H8T10.35.44.D11.1.454.CMB.1.raw
  modified_base (347)..(347): a, c, t, g, unknown or other
  misc_feature (347)..(347): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggttttccttgttgccattttaaaaggtgtccagtgtgaggtgcagctggtggaggtccgggggaggcttagttcaggccgtggggggtcctgagactctcctgtgcagcctcgtggattcaccttcagttacgtcacgtggatgcacgttcgggtccgtacgaagttccgaaggggacggggcgtggttggttgggttcacgtagttacgngtgagtcggtactggacacatcgacgcggtactccggtaggaacgggccgtacttcccgacccctcgacgaacgaccaacgaccaaagaaccaacctacgtatacgtctagaactaaagtacggaaactaggtactaggaacgtacggccggtaaggaacccgacggtcgttagtaccttaacgtttacctgggtacgacgtaaagggtaacgggtcgtaacgttaacgaattccggttaaggttttcgggttttacgaacgtttccggtacgggtttacggggaacccgtaaaggggaacctaacggtttccgggttaaccctaacccgg

SEQ ID NO: 191776 - DNA, 568 bp, Homo sapiens
  misc_feature: GYAE6OF02GB4M0.35.44.D11.1.454.CMB.1.raw
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (515)..(515): a, c, t, g, unknown or other
  misc_feature (515)..(515): n is a, c, g, or t
  modified_base (528)..(528): a, c, t, g, unknown or other
  misc_feature (528)..(528): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccgggggaggcttagttcagccgtggggggtccctgagactctcctgtgcagcctgtggattcaccttcagtagtcacgtggatgcacgtcgggtcctcaacgttccgaggggaggggctgggtggtgggtttcacgttagttacggagtgtagtagggactgacacaagtcgtacgcggtactccggtaggaacgggtccacttcccacccctacagacgaacaacgaccaaagaaccacaactatactctagacaaangaacngtcngagagccgagacncggctatactattacgtgtacgataaggtgcgatacaagtntaaggttggtttnagttcgtggtcgggactaaagggacaggttcgacctaccg

SEQ ID NO: 191777 - DNA, 631 bp, Homo sapiens
  misc_feature: GYAE6OF02IGXOL.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaatttttaaaaggtgtccagtgtgaggtgcagctgggtggaggtccgggggaggtcttagttcagccgtagggggtccctgagctctcctgtgcacgcctcgtggtattccaccttcagttacgtcaacgtgggatcgcacgtcgggtcctacgtaacgttccggaggggaacgggtcttgggttcggttgggtttcacggttagttacgagtgagtggactgacactatcgtacgcgctcgaggacggctactccaccctcagacacgacgacaagaccacactactactatacgacaaagtcgaaactagttacgtagacgacgaccggagacgacgtcttagttacctagttacgtgtagacggtaaaggtcggttacgacctaacgtagttcgttaaggttttcggtttagtacgttccgtacgggttacggggaacccgtaagggtaacctaaggttccggtaccgttacccg

SEQ ID NO: 191778 - DNA, 550 bp, Homo sapiens
  misc_feature: GYAE6OF02GBLJU.35.44.D11.1.454.CMB.1.raw
  modified_base (287)..(287): a, c, t, g, unknown or other
  misc_feature (287)..(287): n is a, c, g, or t
  modified_base (333)..(333): a, c, t, g, unknown or other
  misc_feature (333)..(333): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
  modified_base (507)..(507): a, c, t, g, unknown or other
  misc_feature (507)..(507): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtccgtnaacggttccgagggaggggcgtggtggtgggttcacggtattacgngtgatgggactgacacaatcgtacgcggactccgtgaacggccgatccacccctcagacgaccaacgccaagaacacaactatactcanacaaatcgaacagtctaganacgacgagacgacgctacgtctagttactgtgacaaggnggtcgactacagtctagttggtttanacttcgtacgtcgggactaacgggtatacggtggtacctaccg

SEQ ID NO: 191779 - DNA, 576 bp, Homo sapiens
  misc_feature: GYAE6OF02FXLQT.35.44.D11.1.454.CMB.1.raw
  modified_base (350)..(350): a, c, t, g, unknown or other
  misc_feature (350)..(350): n is a, c, g, or t
  modified_base (484)..(484): a, c, t, g, unknown or other
  misc_feature (484)..(484): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagccgtggggggtccctgagactctcctgtgcagcctctggattcaccttcagtagtcactggatgcacgtgggtcctcaaggttccggggaagggctgggtgttgggtttcacgttattacggagtgagtgggactgacanaatctacgcggactcgtaggaacggtcgacttccacccctcgaagacgacaaccgccaaagaacacactatactctagactaaatagaacagtctagagacgaccggagtaccgacggacgatatagttactgngacgaagaagcgagcgggacgacccgtaccccgggatacggagccgacgtacggggccgacgggtccacccggtcggtaccgccgttacccg

SEQ ID NO: 191780 - DNA, 886 bp, Homo sapiens
  misc_feature: GYAE6OF02H1LK3.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcacatgagttcggctgagctggtttccttgttgcctaagtttaaaggtgtccagtgtgaggtgcagctggtggaggtcggggagtcttagttcagccgtgggggtcctgagactctccgtgtgcacgtcctctggtacttcctaccttacgacggttaacgtctaacgtcggatcggcctaacgtcggggtaccgtaacgtaacggtttacccggaagggggtaaggggtaccgttaggggtttgggttacgggttttccgtaaaccggtttaagtttaaccgggtaaggttagggtaaccggtagggggtaaccttacgggtaacctaaacgtaaaacgtttacccgttaaccgggaccggggtaaccgttaccgggttaacgggtaaaacggggtcccggtaaaccgtttcccccgtaaacccccccgttaccgaacggtaaaccgtaaacccgaaaaccggtacccgaaaaaccggaaacccgtaaacctaaactttaaacgtaacttaccgttaacgaacctaaaaagttcggtaaaacctaacgttaccggttaagaacggacggtaaaccccggagggaaacctaccgggacttaacggttaccgttaaaactttccgtagggtaaccgtacgaaaacggtacgggttacggtaaccgtaacgtaaacgttaccggttaaagtttccgggttttaagaaccgtttccggtaaccgggtacggggtacgtaaaacgggtaacggttaaaggtccggttaccggttaaccc

SEQ ID NO: 191781 - DNA, 644 bp, Homo sapiens
  misc_feature: GYAE6OF02FIRCO.35.44.D11.1.454.CMB.1.raw
  modified_base (335)..(335): a, c, t, g, unknown or other
  misc_feature (335)..(335): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaagttgtccagtgtgaggtgcacctggtggagtcgggcggaggcttcgtaagccaggacgggtccctaagcctctcctgtcgcacgttctggtactttcccttcaatgtcgcctggatgaaccgtgggtcccgccgaggcctccgaggggacgggactgggtagtggttcgccgtnaagttaaaaggagtaattgagtgggacgggacaacgagaccgtaccgtccttccgaccccggttacacggggacacgtacttccaccgttcctaccgagagactgtacgtccagtacgtacgtacttccctgtaccttactaaacaactaggaaacctacgtaccctacggaaccctaaccggaacggacacctacggcccttactaacttacctacgtacccactcctgtaacccacactcgacctcgtaccaaccgacgtacgttcggacggggtaccgggtaactccgtaggtcccacccgttccg

SEQ ID NO: 191782 - DNA, 640 bp, Homo sapiens
  misc_feature: GYAE6OF02HAJ2E.35.44.D11.1.454.CMB.1.raw
  modified_base (135)..(135): a, c, t, g, unknown or other
  misc_feature (135)..(135): n is a, c, g, or t
  modified_base (514)..(514): a, c, t, g, unknown or other
  misc_feature (514)..(514): n is a, c, g, or t
  modified_base (550)..(550): a, c, t, g, unknown or other
  misc_feature (550)..(550): n is a, c, g, or t
  modified_base (620)..(620): a, c, t, g, unknown or other
  misc_feature (620)..(620): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgnggtttcgtgtagcattaaagtgtcagtgtgagtgcagctggtggagtccgggggaggcttagttcgagccgtggggggtccctgagactctcctgtgcacgcctctggattcaccttcaagttgctacgtggatcgctacgtgggtcctctaagttccgaaggggaaggggtcctgggttaggttcgggtttcgacgttacgtttacggagttggaagttggggaacttggaaccacgtaaagttccttaacggccggtaacgttcccggtagggaacgggcccgtaagttccccgaaccccctcgagacgaccgaacgtccaaaggtaccaccgataaatctctgacctaaatcgaactgttacgagagcgacccganaaccggcgttactggtacctagttactggtcgtaanaacggtagtagcctaacgtagtacgttaggttacggtttagacctttggtccggaacggtccgaaagggntaacggtcggtacctaccgg

SEQ ID NO: 191783 - DNA, 707 bp, Homo sapiens
  misc_feature: GYAE6OF02JHA0Q.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtgggggtccctgagactctcctgtgcagcctctggattcaccttcagtagtcactggatgccacgtgggttccgtcgaagttccgaggggaacgggggctggttggtgggtttcacggtattacggagtgagtgggactggactacaatctagcgacgtcgtggaaggcgactaccctacccctccctacgagaccaaccgaccgaacgaaaccgacaactaactaacgtcctacgtaacgtaaactaacgaaaccgtaacgtacgttagaacgggacggaacccggacgggaaccggaaccgggtcggttaccgttaccgtttaacgtttaaccgttaggtcggttacgaaaacggtaggggttaccgggtacttaacctaaaggtcccgttaaggtttacggggttttttactacgttacccgttcggttaaccggggggtacccgtaaaaggggtaaccttaacggtaccggggttaccgtaaccccgg

SEQ ID NO: 191784 - DNA, 615 bp, Homo sapiens
  misc_feature: GYAE6OF02H43DN.35.44.D11.1.454.CMB.1.raw
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggagcttagttcagccgtgggggtccctgagactctcctgtgcagcctgtggattccaccttcagttacgtcaactggatgcacgtgggtcctacgaagttccgagggaggggctgggtgttgggttcacgttattacggagtgagtgggactgacanatcacgcgactcgngaggcgatccaccctnagagacaacgcaagaacacactaatactctagaacaaagtacgaaactagtactagaagacgaccgaaggtaccacgggtctaggttacttaattaccgtgtcgataacggtaggttcggaccttaacgtaacgttctaacggtttggttttacgaacgtttccgtaaccggttacgggggaacccgtaaacgggggtaacctaaggttacccgggttacctaaaccccgg

SEQ ID NO: 191785 - DNA, 562 bp, Homo sapiens
  misc_feature: GYAE6OF02FKP54.35.44.D11.1.454.CMB.1.raw
  modified_base (458)..(458): a, c, t, g, unknown or other
  misc_feature (458)..(458): n is a, c, g, or t
  modified_base (510)..(510): a, c, t, g, unknown or other
  misc_feature (510)..(510): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcacgtgggtccgtcaagttccaggggtaaggggctggtggtggtttcacggtattacgagtgatgggactgacacaatcacgcgactccgtagaacggccagttccaccccctcagacgacaacgccaagaacacactatatctgacaaatcgaacagtactagagtagccgaaggaccacggntacgtctacttactgtgacaaggaggtgactagaatcgtaagttggttttanacgttcgtacggtacggggaccaaaggggtaccaagttcggtactaccccgg

SEQ ID NO: 191786 - DNA, 654 bp, Homo sapiens
  misc_feature: GYAE6OF02F28G3.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggagtccgggggaggcttagttcaggccgtggggggtccctgagactctccgtgtgcagcctctggattcaccttcagtagtcacgtggatgcacgtcgggtccgtactaagttcccgaaggggaaggggcgttggtggttgggtttcacgtattacgagtgagtgggactgacacgaatcgtacgcgacgtccgaggaaggccattccacccctacgacgacgaccaacgccaaagaaccgactaactaatactactacgaacaaagtacgaaactagtcgtagaacgacgaccggacgacgacgggtactagttaccgtaactttacgtgtacgaccgtaaaggtacgggtacgtacctacgtaaagtaccgttaaggtttacgggttttacgtaagttccgttaccgggttacgggggaaccgtaaacgggtaacgtaacggttccgggtaccgttaaccccgg

SEQ ID NO: 191787 - DNA, 654 bp, Homo sapiens
  misc_feature: GYAE6OF02IE188.35.44.D11.1.454.CMB.1.raw
  modified_base (505)..(505): a, c, t, g, unknown or other
  misc_feature (505)..(505): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttttccttgttgcctattttaaaaggtgtccagtgtgaggtgcagctggtggaggtccgggggaggcttagttcagccgtgggggtccctgagactctcctgtgcagcctctggattcaccttcagtagtcactggatcgcacgtcgggtccgtactaacggttaccgaaggggaacgggggtcgttggggttggttgggtttaccgacgttagttacggagtgagtgggactgacactaacgtctacggcgtactccggtaggaacggccgacttcccgaccccctcgagacgacgaaccgaccaaagaccacaactatatctagacaaatgaacgtgtctagacgacgaccgaggaccgacggtntacggttacttacgttaccgtgtacgtacgaaggtacgggtcgaccgtaacagttacgtaggttttacggttttacgactttccggtacgggttaccgggggaacccgtaaggggaacctaacgggttaccggtacccttaaccccggg

SEQ ID NO: 191788 - DNA, 572 bp, Homo sapiens
  misc_feature: GYAE6OF02GELUS.35.44.D11.1.454.CMB.1.raw
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (483)..(483): a, c, t, g, unknown or other
  misc_feature (483)..(483): n is a, c, g, or t
tcagtacagatcgtcacgaccggtgctcgatttagcgcagtacgaaggggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtgggggtccctgagactctcctgtgcagcctcgtggattccaccttcagttagtcactggatcgcacgtgggtccgtcaacggttccgaggggaaggggctgggttgtgggtttcacggtattacgngtgagtgggactgacacaatctacgcggactccggngacggcatccacccctcagagaccaacgccaagaacacactatactctagacaaatcgaactagttctagagacgaccgaggacacgctgtactattactgtacncgaaggcggtcgactacaagtctaagtttggttttacgactttcgtacggtacggggaccaaaggggactaaggtcggtacctacccgg

SEQ ID NO: 191789 - DNA, 758 bp, Homo sapiens
  misc_feature: GYAE6OF02ITO6A.35.44.D11.1.454.CMB.1.raw
  modified_base (252)..(252): a, c, t, g, unknown or other
  misc_feature (252)..(252): n is a, c, g, or t
tcagtacagatcgtcacgaccggtgctcgatttagcgcagtacgaagggggccccgagccctgggactcccagctgtttctgcttgctcgatcaggactgcacacagagaactcaccatggagttcgggctgagctgggttttccttgttgccattttaaaaggtgtccagtgtgaggtgtcagctggtggagtccgggggagcttagttcagccgtgggggtccctgagactctcctgtgcagcctctggnttcaccttcagtagtcactggatcgctacgtcgggtcctagtaacgttccggaaggggaacgggggtcgttcgggttgggttcggggttttacgtaacgggttaacgtttaaccggtaggttaggtacgttcggggtaacgttggaacgtaaccgaacgttaccgtaaccgggtcggaaccgttacccgggtaggaaacggggtccgtaacgtttaccccgaaccccctaccgaaggtaccggaaacccgaaccggtacccaaacggtaaacccaacctaaaccgttaactaacgttactacggaacctaaagtaacgtaacgtaacgttacgtaggaacggacggtacccggaacgggtccaacggttacgtacgttaccgttaacttacggtaggtcgaaccgtaaggaagggtacggtactaacgtagtacgttaggttacgttttagacgttcgttcggtacggggtaccgaaggtaacgtacggttacggtcctaacccgg

SEQ ID NO: 191790 - DNA, 700 bp, Homo sapiens
  misc_feature: GYAE6OF02ILMXL.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccggggagggcgttagttcgagccgtcgggggtccggtcgagactctcctcgtgcacgctctggatctacctctagtagtacactggtagtgcgactggtcgtctaacggttaccggggtagggacggtggtggttgggtttacgtacgtacgttacgtcgtagtagtcggacgtagacgacaactacgtacgacggacgtaccgtcggaacggtaccgacttacctacccccgtaccgtacgaacggaacgaaccgaaccgaacgtaaacaccctaactaatactacgtcgtacaaaactgaaaccgtagtacgtcgaaaggacggaccgacggtaaccgaacggtccgttagttaccttaactttacgtacggtcggaaccgtaaagggaaggttccgggacttaaaccgtaagttaccggtagtttgggtttttacggactttaccggaccggtttgggggaacccgtaaacgggacgtaaagtcgggtttacccaacccgttccg

SEQ ID NO: 191791 - DNA, 685 bp, Homo sapiens
  misc_feature: GYAE6OF02G96Z0.35.44.D11.1.454.CMB.1.raw
  modified_base (243)..(243): a, c, t, g, unknown or other
  misc_feature (243)..(243): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggactgagctgggttttccttgttgccattttaaaaggtgtccagtgtgaggtgcagctggtggagtccggggaggcttagttcagccgtgggggtccctgacgactctcctgtgcancctctggattcaccttcgagtacgtcactggattgcactgggtcctcaagttccgaagggagggctggtgtggttcacgtagtacgagtagagtggctgacacaatctacgcgtactccgaggacggccgtacttaccacccctacgaagtacgaacgaacgaccgtaaagaaccactaacgtaatactcgtagaactaaacgtgaaactgtacctagaacgacgacccgtaaggacctaccggtcgttaagttaccttaagtttaccgagggttaccgaacggaaaggtcgggttacgaaccgttaacgaacgtttccggtaacggtttttacgggttttaacaaccgtttaccggttaacccggggttaacgggggtaaccccgttaaaagggggaaaccccttttaagggttacccgggtttaaccccttaaccccggg

SEQ ID NO: 191792 - DNA, 674 bp, Homo sapiens
  misc_feature: GYAE6OF02IYX3C.35.44.D11.1.454.CMB.1.raw
  modified_base (356)..(356): a, c, t, g, unknown or other
  misc_feature (356)..(356): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgtggtttcgtgtagcatttaaagtgtcagtgtgagtgcagctggtggagtccgggggagcttagttcagccgtgggggtcctgagactctcctgtgcagcctcaggtcttctaccttcagtagtctaacgtggatggacacgtgggtccgtgtaacgtccggaggggaacggggcgtgggtacggtgggtttcacgttacgttacgagtgtagtgggactganacgtagtctacggcggactcggtgaacggctactccgtacccctacgacgacgtaccaacgaccgtaaagaacgtaacaactacgtataccgtgtaacaaattacgaactacgtactagagacgccggaaggaccggacgtcgttacggtaacttaccgtttaagtcggtaggtaaccgtaaaaggtccgggttacgacgtaaaccgttagtaaccgtttaagggtttacggtttaacggttaaggttaccgttacgggttaccgggggaacccgttaaagggtaaccggtaacgttacccgggttacgttaccccgg

SEQ ID NO: 191793 - DNA, 522 bp, Homo sapiens
  misc_feature: GYAE6OF02GGAJX.35.44.D11.1.454.CMB.1.raw
  modified_base (432)..(432): a, c, t, g, unknown or other
  misc_feature (432)..(432): n is a, c, g, or t
  modified_base (467)..(467): a, c, t, g, unknown or other
  misc_feature (467)..(467): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagcctggggggtccctgagactctcctgtgcagcctctggattcaccttcagtagtcactggatgcactgggtcctcaagttccagggagggctggtgtgggttcacgtatacgagtgatgggactgacacatctacgcgactcgtgaggcatccacccctcagagacaacgccaagaacacactatatctagacaaatcgaacagtctgagagccgaggacncggctgtctattactgtacgcaagtggtcgactanatcgtattggttttgattcgtcgtggggaccaagggacaagtcggtactacccgg

SEQ ID NO: 191794 - DNA, 641 bp, Homo sapiens
  misc_feature: GYAE6OF02INXK6.35.44.D11.1.454.CMB.1.raw
  modified_base (601)..(601): a, c, t, g, unknown or other
  misc_feature (601)..(601): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggagcttagtcagccgtgggggtccctgagactctcctgtgcagcctcgtggattccaccttcagttacgctaccgtgagtgccacgtcgggtccgtctaagttccgagggtagggctgggtgtcggttacacgtattaccgagtgtacgtggtactgaacctagtaactcgtaccggcggtaacctcccgggttagaacgggtaccgtacttacccgtaccccctcgaacgtacgtaacccaacggacccgaaacggtaacccaaccaaccttaacgtatacctacgaactaaagtacgaaacgtcgtacgttagacgtacggacgtacggaccgacggtctcgttacgtattacgtgtacgacaaggtacggtcgtactagaactgtaaggtttgttacgtntccgtaggcgggtaccagggtacgtatcggtaccgtaccg

SEQ ID NO: 191795 - DNA, 727 bp, Homo sapiens
  misc_feature: GYAE6OF02IAA1S.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgcctattttaaaggtgtccagtgtgaggtgcagctggtggaggtccgggggaggcttagttcagccgtggggggtccctgagactctcctgtgcacgcctcgtggattccaccttcagtagtcacgtggatgcacgtgggtccgtctaacggttccgagggaacgggggtcgtagggttcggttggggtttctacggttagttacggagtgagtgggtactgaaccactaagtccgtacggccggtaccgtccggtaacggaaacggggtcccgtaactttccccgaccccccttaccgaacggtaacgaacccgaaacccggtacccaaaacggtaaacccaccgtaaaccttaattacttacctacgaactaaaacgtacgaaactacgttacgtagaacggtacgaccggaggaaccgtaccgggtcttacggttccttaagtttactcggttacgaacgtaaggtaacgggtcgacttactaacgtcgtaaggttttcggttttagaccgtttaccgtcgggttacgggggaacccgtaaaggggttacctaaggttccggtacccgttacccgg

SEQ ID NO: 191796 - DNA, 696 bp, Homo sapiens
  misc_feature: GYAE6OF02JGSGD.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagctggtggaggtccggggagtcttagtcagccgtgggggtccctgagactctcctgtgcagcctcgtggtacttcaccttcagtagtcacgtggatcgctacgtcgggtcctacgtaacggttccgaggggtaacggggtctgggttcggttacggtttcgaacggttagttacggagttgagtggactagacacacgtcgtacgcggtactcggaggacggtcctattcccaccctcagacgacaacgcaaagaacacactatatcgtagaactaaatacgaacctagtacgtacggaacggtaccggaccggaaaggaccgtaaccgggtactttacgttaaccgtttaactttaccggtgggtaacgtaaccggtaaagggttacgggtacgtaaaccttactaaacgttccggtttaaggtttttacgggtttacgtaacgtttccggttaccgggtacggggaaacggttaaccggggtaactaacgggttccgttaaccccgttaacccg

SEQ ID NO: 191797 - DNA, 744 bp, Homo sapiens
  misc_feature: GYAE6OF02H16YM.35.44.D11.1.454.CMB.1.raw
  modified_base (244)..(244): a, c, t, g, unknown or other
  misc_feature (244)..(244): n is a, c, g, or t
tcagtacagatcgtcacgaccggtgctcgatttagcgcagtacgaagggggcccagccctgggactcccagctgtttctgcttgctgatcaggactgcacacagagaactcaccatggagttcgggctgagctgggttttccttgttgcctaattttaaaaggtgtccagtgtgaggtgcagctggtggaggtcgggggagcttagttcagccgtgggggtcctgacgatctctgtgcagcctntggattcctacttcagtacgtcaactggatgcacgttgggtcccgtacgtaacgttccgaaggggtaagggggtcttggggttggttcggggttttactacggttaagtttaccgggaaagttggtaggtacggggtactacgtaaccgaacgtaaagttcccgtaaccggtccgggtaaacccgttccggttacgggaaacggggtcccggtaactttaccccgaccccccgttacgaaacggaacgaaccaaacccgaccgaaagaaaccgtaactaacctaatactacgtacgaactaaagtacgaaactacgtagtacggacgacgacccggaaggacccgaacggtcgtacgttacttacgttaacgttcggttagacctaaaagggtacggtacggtactaactacgtgtaacgttggggttttacaacgttaccgttcggttacggggaaccgtaaaacgggtactaaacggtttcggtaacccgttacccgg

SEQ ID NO: 191798 - DNA, 723 bp, Homo sapiens
  misc_feature: GYAE6OF02F6HHI.35.44.D11.1.454.CMB.1.raw
  modified_base (248)..(248): a, c, t, g, unknown or other
  misc_feature (248)..(248): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaatttttaaaaggtgtccagtgtgaggtgcagctggtggaggtccgggggagcttagttcagccgtgggggtcctgagactctctgtgcagcctntggattcaccttcaggtatcactggatcgcacgtgggtcctagaacgttccgaaggggtaaggggtcttgggtggttcgggtttacacggttattacggagtacggagttgggacttacgactaacgtaaacgttcgtaacggtcggtaacctccgggtagggtaaacggggcccgttaacttacccccgacccccgtacgtaaacggaccgtaaacccaaccggaccaaaccgaaaccaaccgtaaccttaagtaacttccgtacgaactaaacgtacgtaaactacgtaccgtaggaacgacgaccggtacggaaccgtaccggacttacgttaccttaagttaacgttacggtacgtacgaaggtacggtacgggtacttaacgtaacgtacgttaagttttagggttttacgtacttcggttacggttacgggaaccgtaaagggacctaagttacggtaccgttaaccgg

SEQ ID NO: 191799 - DNA, 628 bp, Homo sapiens
  misc_feature: GYAE6OF02IH20D.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggaggtccgggggaggcttagttcagccgtggggggtccctgagactctcctgtgcagcctcgtggattccaccttcagtagtcactggatgcacgtgggtccgtctaagttccgagggaggggctgggttggtgggttcagttatacggagtgagtgggactgacacaatctacgcggactccggtagaacgggtccgacttccaccccctcgagacgacaccgacaagaccacactatactctagaacaaatcgaaactacgtacgtaggaagtacgaccggaggacccgacgggcttacggttactacgtttaccgtggttacgaacgaaaggtcggtacggactaacgaattaccggtaagttttcggtttagacgtttccgtcgggtacggggtaaccgtaacgggtacgtaacggttccggtaccgttaaccccgg

SEQ ID NO: 191800 - DNA, 756 bp, Homo sapiens
  misc_feature: GYAE6OF02HKLPI.35.44.D11.1.454.CMB.1.raw
  modified_base (162)..(162): a, c, t, g, unknown or other
  misc_feature (162)..(162): n is a, c, g, or t
  modified_base (497)..(497): a, c, t, g, unknown or other
  misc_feature (497)..(497): n is a, c, g, or t
  modified_base (519)..(519): a, c, t, g, unknown or other
  misc_feature (519)..(519): n is a, c, g, or t
  modified_base (550)..(550): a, c, t, g, unknown or other
  misc_feature (550)..(550): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcgttggttttccttgtgcctattttaaaggngtccagtgtgaggtgcagctggtggagtccggggagcttagtcgagcgtgggggtccctgacgtactcctccgtgtcgcgacgcctcgtggtacttctaccgttcaggttacgtcctacgttggtatcgaccgtaacgttcggggtaccgtacgtaaaggttccccgaagggggtaacgggggtcttggggttaggtttcggggtttaccgacgttagtttaccggagttcggagttcgggactcgaacactaactcgtaacggccgtacgtcgtaggaacggtccgtactccgacccctcgaagacgtacaacgaccgaacacacactaactanactaggtaactaaatggaaacnggtactaggaacgacgaccgtaaggaaaccnccgggtacttggttaaccgttaacgtttaaccggtggtaacgtaccggtaaaggttacggtacgggtaccttaaacccgtaagtttacccgtaagggttttttaccggggtttacaacgtttacccgggttacggtaacccggggggtaaaccggtaaagggtaacccggtttaacgggtttacccggttaccccgtaaccccggg

SEQ ID NO: 191801 - DNA, 603 bp, Homo sapiens
  misc_feature: GYAE6OF02FN6QU.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccgtcaagttccaggggaaggggctggtgttgggtttcacggtattacggagtgagtgggactggacacaatctacgcgactccgtagagggccattccacccctcagacacaacgccaagaacacactatactctagactaaagtcgaaacagttcaggagacgccgagggaccacgggtctagtccttatttacgtgttacgacaaagggtagggtcggacttacaagttccgtaagtttgggtttttacacgtttccgttcgggttacgggggacccgtaaaggggtaaccgtaacgttccgggtacctaaccccgg

SEQ ID NO: 191802 - DNA, 792 bp, Homo sapiens
  misc_feature: GYAE6OF02H2ERI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccatttaaaaggtgtccagtgtgaggtgcagctggtggaggtccgggggaggcgttagttcaggccgtgggggtccctgagactctcctgtgcagcctctggattcaccttcacgtagtcactggatgcgacgtcgggtccgtactaaggttaccgaggggaagggggtcgttggggttgggttacgggttttacgtaacggtttacgttaacggtagggtaggtacggtaggggtactaggtaacctaaactaacgtaccgtaaccgggtccggggtaacccgttacccgggtacgggaaaccgggggtcccgtaaccgtttacccccgtaaccccccgtacccgtaaaccgggtaacgaaacccgaaacccggaaaccccgtaaaaccggaaaaccccaaccgtaaaccttaaacgttaaccttacgtacggtaacctaaaagtacgaaactacggttcgtaacgaacggaaccggaccggtaaacgggacccggtacggtaccgttacgttaacgttacgttaaccgtggtacggaacgaaaggtacgggtagtaacttaaactacgtagtttaggtttcggtacttctaccgggtagggaacccgaacggtacgtaagttacggcccgtaccgttcccg

SEQ ID NO: 191803 - DNA, 551 bp, Homo sapiens
  misc_feature: GYAE6OF02FLIQA.35.44.D11.1.454.CMB.1.raw
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
tcagtacagatcgtcacgaccggtgctcgatttagcgcagtacgaagggggccccagccctgggactcccagctgtttctgcttgctgatcaggactgcacacagagaactcaccatgggagttcgggctgagctgggttttccttgttgcctattttaaaaggtgtccagtgtgaggtgcagctggtggagtccgggggaggcttagttcagccgtggggggtccctggagactctccgtgtgcagcctctggattcaccttcagtagtcactggatgcacgtgggtccgtcaagttccgaggggaaggggcgtgggtggtgggtttcaggttattacgagtgagtgggactgacacaatctacgcgactcgaggacgggccattccacccctcagacgacaacgccaagaacacactatanctagacaatanaacagtcgngagacgccgaggacgacggtctgtactattcgtgtgacaaggaggtgctacatctaagttggtttnattcgtcggtcgggaccgaagggaactagtcggtactaccgg

SEQ ID NO: 191804 - DNA, 894 bp, Homo sapiens
  misc_feature: GYAE6OF02I201R.35.44.D11.1.454.CMB.1.raw
tcagtacagatcgtcacgaccggtgctcgatttagcgcagtacgaagggggccccagccctgggactcccagctgttctgcttgctgatcaggactgcacacagagaactcaccatggagttcggctgagctgggtttcctgttgccatttaaaggtgtccagtgtgaggtgcagctggtggagtcggggaggcttagttcaggccgtgggggtccctgagactctcctgtcgcacgcctcgtggtacttccgtacctttaggcctaccttaagtcggactacgtggtacggtccgttcggggtcccggccggggtcctaccgggagggggtaacgggggtcgtaggggtacgggtcggggttccttacgtaaaccgttagttacgggtaagttcggggttacggtcggtaccttacgtaaacgtaaacccgtaaccgtaaggtaccgggttaacgacccgtaaaccgggtacccgttacccgggttaggggtaaccggggggttaccccgggttacctaacccgtaccggtcccgtacccgaacggggtaaccgtaaaccgtaaaccgtttaccgggaaacgggtaacccgtaccggtaccgttagtaaccgttaaccgttaaaccgaaaggttaccgggaacttaaccggttcgtaagggtaaccggaacggaacccggtaagggtaacccgtacccggtaccttttaaaggttaccgtttacgtacggttaacggtaaacggttaaacgggtttaccggaaacgtttcgggtaaccggggtaccggttacggtaccggggtaacccgggttaaggggttaacccgggtaagttaccggttacgggtaaacccggtcccggggttacgggggaaccccggtaacccgggggg

SEQ ID NO: 191805 - DNA, 638 bp, Homo sapiens
  misc_feature: GYAE6OF02FIPBO.35.44.D11.1.454.CMB.1.raw
  modified_base (290)..(290): a, c, t, g, unknown or other
  misc_feature (290)..(290): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagtaagccgtgggggtccctggagactctcctgtgcagcctctggattccaccttcagttagtcactggatgctactgggtccgtnaagttccgaagggacggggctgggtgtgggtttcacgtattacgagtgatgggactgacacaatctacgcgtacgtccgtaggaacgggccgtattcccacccccttcgacgtacgaaccgaaccgaccaaagaaccgaacaccgttaatacttactagacctaaagtcgaaacacggtctaggacgacgccggaaggaccacgggacttcgtacttaagttaccgtgtacgacgaacggtagggtggacgtaactacttcgtaggtttcgggttttacgacgttaccgttcggtacggggacccgtaagggggtaacctaaggttccgggtacctaccggtttcccg

SEQ ID NO: 191806 - DNA, 653 bp, Homo sapiens
  misc_feature: GYAE6OF02G7DSS.35.44.D11.1.454.CMB.1.raw
  modified_base (519)..(519): a, c, t, g, unknown or other
  misc_feature (519)..(519): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcgttgggttttccttgttgctattttaaaggtgtcctagtgtgaggtgcagcgtggtggaggtccgggggaggtcttagttcaggccgtgggggtccctgagactctcctgtgcacgccttcgtggtacttcctaccttcagtacgtccagtcggattcgcctacgtcgggtacccgtacgtaacggttaccggtaggggaaacggggtcgtgggttggttcgggtttctaacgttagtacgacgtgacgtgggactagacactatcgtacgcggtactcggtaggtaacggcctactccaccccgtcaggacgtacaacgacaacgaaccactaactagtactacagaactaactacgaactacgttacgtaggaagcgaccgganacgtcggccttaggtaccttagttactggtcaaacggtaggtacggtacgtaactactaagtacgttaggtttagtttacgagttaccgttgggtacgggaaccggtaagacggtagttccgtacgttaacccg

SEQ ID NO: 191807 - DNA, 750 bp, Homo sapiens
  misc_feature: GYAE6OF02G60JF.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccatggagttcggctgagcgtgggttttccttgttgacctattttaaaaggtgtaccagtgtgaggtgcagctggtggaggtcggggagcttagttcgagccgtggggtcctgagactcgtcctgtcgcacgcctcgtggtacttcgtaccttcgtacgttacgttcgtaacgtggtaacttcggtaccgtaacgttcggggttaccaacgttaccgtaaacggttttacccggaagggggtaaacggggtcgtttcgggttcggtttacgggtttaccgtaacggttaacgtttaacggtacgttagggtaacgtacgggtaccttacggactaacgtaacgtaccgtacggaccggtacgtaccggtacggaacggtccgtacttacccgaccccgtacgtacgaacgaacctaacgaacccgtaaaggaacctaacgtaccgttactaacgtacgtcgaaaccttaacgtcggaaactcggtttacaggtaacgacgacggtaacggacgtaccggtctagttacttaagtccgttagacgtacgaaggtcgtcgtactaacgtacgtgttaacgttagttacacgttcgtaccgggtcgggaaacctaacggtacgtacggttacgtaaccccg

SEQ ID NO: 191808 - DNA, 613 bp, Homo sapiens
  misc_feature: GYAE6OF02FYZV4.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagacctctcctgtgccagcctctggattcaccttcagtagtcactggatgcacgtgggtccgtcgaacgtccgaaggggaggggtctgggtgtgggttcacgtatacgagtgatgggactgacacatcgtacgcggctcggtagaacgggtccgtatccgaccccctacgacgacgaccaaccgaccaagaaccacactactatctacgactaaagtacgaactacgtactagaagacgaccgagggaaccacggtctacgttctaattacgtgtagacgaaggaacggtggaccgtacgaataccggtagtttacggtttcgtaattccgttacggtacggggaccggtaagggaaccggtaacgttccgggtaccttaacccgg

SEQ ID NO: 191809 - DNA, 828 bp, Homo sapiens
  misc_feature: GYAE6OF02IXXIB.35.44.D11.1.454.CMB.1.raw
  modified_base (414)..(414): a, c, t, g, unknown or other
  misc_feature (414)..(414): n is a, c, g, or t
tcagtacagatcgtcacgaccggtgctcgatttagcgcagtacgaaggggcccagcctggactccagctgttctgcttgctgatcaggactgcacacagagactcaccatcggagttcggctgacgcgttcgggtttccttgttgcctagttttaaaaggtgtccgtagtcgttcgaggttcgacgtagcgtcggtgggacgggttccgggggaggtccgttaacggttcgacggtcccggtcgggggtcctgacgtacctcgttcctgtcgcacgtcctcggtcgtacttcctaccttacgtagtacgtccacgtggtacgtcgcgttaccgtcgggttacgtcgtaacggttccggaagggtacgggtcgttgggtggttacgggtttaccgtacggtttaacgttaacggngttacggtaacgtacgggtacgtaacgtaccgtacgtaacgttccgaaccgtaccggtacggttaccggtacgggtaaccgggcccgtacgttaccccgtaccccttaacggacgtaaaccgtaccgtaaaccgaccgaaacggtaacccgaactaaccgttaacgttacttaccgtaccgtaacgtaaaccgtacgtaaacctacggttacctaacgggtacggtaaccggcccggtaaggtaccgtaccggtacgttaccggttacgttaccgtacggtacgtaacggtaacgtaacggttacggtacgttacctagtacttaccggttggtttaccggttacggtacttacccgggttagtaaccggggtaaccgtaacgggttaacgtaccggttacggtcccgttacgg

SEQ ID NO: 191810 - DNA, 860 bp, Homo sapiens
  misc_feature: GYAE6OF02JD9KN.35.44.D11.1.454.CMB.1.raw
tcagtacagatcgtcacgaccggtgctcgatttagcgcagtacgaagggggccccgagccctgggactcccagctgtttctgcttgctgatcaggactgcacacagagaactcaccatggagttcggctgagctgggttttccttgttgcctattttaaaggtgtccagtgtgaggtgcagctggtggaggtccgggggaggtcttagttcagtccgtgggggtccctggagacctctcctgtgcacgcctctggtacttctaccttcagttagtcacgtgactcgcacgtgggtcctcgtaacggttccgaagggggacgggtcgttagggttggttcgggtttctaacggtttacgttacgggtagtacggtagtaggggtactcggaaccaactaacgtccgttaccggaccgggtacgttacccggagggtaaacgggtccgtaacttaccccgacccccccgttaacgaacggtaccggaaacctaacccggtaacccgaaaggtaaacccctaacccgaaacgtttaaaccgtacgtttacctaaccggaaacctaaaaccggtacgtaaaacccgtacgggtttaccgtaagggaacgggaaccggtaacccgggtaaacgggaaacccggtaaccgggttcgttaaccgggtttaccttaaacggttttacccgtacgggtaaccggaaacggtaaacgggttaacgggggttccgtaaccctttaacggaaacgttttacgtaacgggtttttacggttttacgggttaacctttacccggttagggttaaccccgggggaaccgggtaaaacggggttaactaacgggtttccgggtacccgttacccgg

SEQ ID NO: 191811 - DNA, 724 bp, Homo sapiens
  misc_feature: GYAE6OF02IE6JE.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccgggggagcttagttcagccgtgggggtccctgagactctcgtgtgcacgcctcgtggattccaccttacagtacgtcactggatgctacgtcgggtccgtacgtaagggttcccgggggaagggtcgtgggtggtttcggggtttcgacgttacgttaacggagttacggtagtcggggactagaaccgactaagtccgtaaccggccggtaaccgtacccgggtaggaacggggtcccgtacgtttaccccacccccctacgacgaccgtaaaccgaaccgtacccaaacggtaaaccaactaaccttaacgttactaccgtagtaaacaaaagtcggtaaacacggttacttacggaacgacggacccgggtaagggaccgtaccgggtacttacgttacctttaacgttaccgttggtaccgacgtaacggaggtaccgacttaacgactaccgttagtttgggtttaccagttccgtaccggtacgggtaccgtaacgggtacgtaagtcggttacctacccgttccg

SEQ ID NO: 191812 - DNA, 668 bp, Homo sapiens
  misc_feature: GYAE6OF02FTQD1.35.44.D11.1.454.CMB.1.raw
tcagtacagatcgtcacgaccggtgctcgatttagcgcagtacgaagggggcccccagccctgggactcccagctgtttctgcttgctgatcaggactgcacacagagaactcaccatgggagttcgggctgagctgggttttccttgttgcctattttaaaaggtgtccagtgtgaggtgcagctggtggagtccgggggaggcttagttcagccgtggggggtccctggacgactctcctgtgcacgcctctggacttctaccttcagtagtcacgtggatgacacgtcgggtccgtacgtaacgttccgaagggggtaggggcttgggtggttcgggtttacgacgttagtacgtaggtgtagttgggactggacataacgtcgtaacgccggactccggtaggaacgggccgtactcccgaccccctacgaacgacaccgaaccgaccaaacgaaacacctaactaattactcgagacctaaatacgaaactgttacaggaacgacgaccggagaaccgcgggacttcgtaccttatttaccgtgtcgaacgtaaggtacggtacgtacctaagtactcgttaggttttaccggtttagaacctttccggtacgggtaccgggaaccggtaaacgggtactaagggttcccggtacctacccgg

SEQ ID NO: 191813 - DNA, 653 bp, Homo sapiens
  misc_feature: GYAE6OF02GNY2P.35.44.D11.1.454.CMB.1.raw
tcagtacagatcgtcacgaccggtgctcgatttagcgcagtacgaagggggcccccagccctgggactcccagctgtttctgcttgctgatcaggactgcacacagagaactcaccatggagttcgggctgagcttgggttttccttgttgcctattttaaaaggtgtccagtgtgagtgcagctggtggaggtccgggggagcttagttcagccgtgggggtccctgacgtactctccgtgtgaagcgtcgtggatcatcttacaaataactatgcagtcgcacgtgggtcccgcgacggcctccgaggacgaacgggacgtgggagttgggtcgcgtagttgtggtggtatgatggaataagtagtataactagtacgacaagaccgtacgtagggaaacggtccgtaacttaccaacctacgtaccctaccgaagaaactaacctaaacttacccgaaacgtaaacttaccgtttaccgttaccacggtaactaaaacgtacgaaactacgtaccctaggaacgacggaccgaaggaaccacggataataacttacttacgtgtaggacgtaacggaggtacgtaggtacgggtaaccctcccggtaacccgtagtacggactacggaccggtacgggaccgtaaccggg

SEQ ID NO: 191814 - DNA, 583 bp, Homo sapiens
  misc_feature: GYAE6OF02G2MO4.35.44.D11.1.454.CMB.1.raw
  modified_base (438)..(438): a, c, t, g, unknown or other
  misc_feature (438)..(438): n is a, c, g, or t
  modified_base (493)..(493): a, c, t, g, unknown or other
  misc_feature (493)..(493): n is a, c, g, or t
tcagtacagatcgtcacgaccggtgctcgatttagcgcagtacgaagggggccccagccctgggactcccagctgtttctgcttagctgatcaggactgcacacagagaactcaccatggagttcgggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtccgtcaaggttccggggaagggtcgtgggtggtgggtttcacggtattacgagtgagtgggactgacacaatcgtacgcggactcgtgaagggctactccacccctcagacgacaacgaccaagaacacactatactctagacaaatcgaacngtactaggacgacgaccggagacacggtctgtacttacttactgtagactaaggnggtacgactaacagtctaagtttggttttagacttccgttacggtacggggtaccgaaacgggtacctaaggtcggtacctacccgttcg

SEQ ID NO: 191815 - DNA, 870 bp, Homo sapiens
  misc_feature: GYAE6OF02J0F74.35.44.D11.1.454.CMB.1.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
tcagtacagatcgtcacgaccggtgctcgatttagcgcagtacgaaggggccccgagccctgggactcccagctgttctgcttgctgatcaggactgcacacagagaactcaccatggagttcgggctgagctgggttttccttgttgcctattttaaaggtgtcctagtgtgaggtgcagctggtgagtcggggagtcttagttcagccgtgggggtcctgagactctccgtgtgacnggcctcgtgggtattcaccttnagtacgtctactggatgcctacgtcgggtccgtacgtaagttccgaaggggaacgggtcgtgggttgttgggtttaccgtaacgttacgtttacgaaggttggtaacggttggggtaacgttacgaacccgtaacgtaaacgtcccgttaaccgggaccggggttaaacccttccgggtaacgggttaaaacggggccccggttaactttaccccgttaaacccccccccggttagaaaccgggttaaaccggtaaaaccccgaaaccggtaaccccggtaaaagggaaacccctaaacccgtaaacgtttaaactaacccgttacgttaacggaaaccctaaaaagggttctaaaaacccggtacgttaaccgttaaggggtaaactaccggggaacccgggaacggaacccggtaaccgggtacctttaaccgggtacttttaaccgttaagttcggttaaaccgaccggtaaaggtaacggggtggttaaacccttacgaaagtttaccgtaggtttacggttttaccgtaaagttccggtttaccgggtacggggtaacccgtaaagggtaaccgtaacgggtaccggttacccgttaaccccgg

SEQ ID NO: 191816 - DNA, 851 bp, Homo sapiens
  misc_feature: GYAE6OF02HDNYV.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgaggtgcagctggtggagtccggggaggcttagttcagccgtgggggtccctgagactctcctgtgcagcctctggattcgaccttcagtagtcacgtggatcggcacgtcgggtccgtacgtaacggttccgaagggggaaggggtccgttggggttcgggtttcgggggttttacccgaacggtttaacgttttaccgggagggttaggtaacggttacgggggaacctttagggaacccgtaaccgtaaacgtttaccgtaaccgggtacccgggtaacccgttacccggggtagggtaaaacgggggccccgttaacgttttacccccgaaccccccccgtttaccgaaacgggtaaacccggaacccgaaaaccccggaccctaaaacggaaaccctaacccgtaaacctttaagttaacttacccgtaacggaacctaaaacgttcgaaaacctacggttacaacgggtacgaaccgggaccggaaacgggaccgtaccgggtcttacgttacctttaacgttacgtggtaccgaacgtaaaggtcgggttagaaccgtttacaaacgtttcgtaaggttttaggtttttaacgacgtttacccggttacgggttaacggggacccggttaaaagggaaccgttaacggtttcggggttacccccttaacccgg

SEQ ID NO: 191817 - DNA, 586 bp, Homo sapiens
  misc_feature: GYAE6OF02I2NW4.35.44.D11.1.454.CMB.1.raw
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (533)..(533): a, c, t, g, unknown or other
  misc_feature (533)..(533): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaggtgtccagtgtgagtgcagctggtggagtccgggggaggcttagttcagccgtgggggtccctgacgacgtctcctgtgcacgcctctggtacttcaccttcagtagtcctaacgtggatggcacgtgggtccgtacaacggttccgaaggggaacggggtcgtgggtggttggggttactacggtattacggagtgatcgggactaggactacagtcacggcgtactcggtaggacggacgtactccacccctcagacacaacgaccaanaacacactatacactgaacaangaactgtntagagagaccgagacacggatcgtatatacgtgtacgngagagngaggcgtacgtcccggtcccgggtttancgggtaccttcgggtaggactacgggaggtacccgacccggtcacccggtccc

SEQ ID NO: 191818 - DNA, 747 bp, Homo sapiens
  misc_feature: GYAE6OF02IFG0D.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctattttaaaggtgtccagtgtgaggtgcagctgggtggagtccgggggaggtcttagttcaggtccgtcggggggttccctggacggacttcgttccgtgtcgctacgcctcgttcggattcctaccttcgagttacgtctacgtggtatcgacacggttcgggttcctacgtaacggttaccggaaggggacggggtcgtttgggttggtttcggggtttacctaggtttaacgttacggtaggttaggtaagtcgggtactacggaacctactaacgtcgtaaccggtcgaccgttccggagaacgggtccgaactttccccaacccctacgacgaaccgaaaccgaacccgaaccgaaacgaaccgtaactaaacgtaatactacgtaagaaccaaatacgaaactcgttacgtagacggacgtaccggaggaaccgacgggtcttacgtacttaagttcgtagacgtaacgtaaggacgggttacgtaacgtactaacggttacgttagtttacgggttttaactcgtttaacggtacgggtaacgggggacctaaaaggggtccgtttaacgtcccgggttacctaccccgg

SEQ ID NO: 191819 - DNA, 817 bp, Homo sapiens
  misc_feature: GYAE6OF02IP2JI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgcctaagttttaaaaggtgtccagtgtgaggtgcagcgtgggtggacggtccgggggaggtcttaggttccgaggtccggttcgggggtccctggacgactccttccgtgtgcacgcctctcggattccaccttacgtagttacgtacacgtggtactgacgtacgttcgggtcccgtacgtaacggttccggaaggggtacggggtcgttggggttggttcgggtttaccgtacggtttagttacggtaggttggaggttacgggacgttagaactaacgtaacttccgtacgtaccggtaccgtaccggtacgggaacggtccgtacttaccccgaacccccgtacgaacggtaaccgtaaaccgaaccgaacccgaaacgaaaccgtaaaccgtaactaacgttaactacgtaacgaactaaaacgtcgtaaactcgttaacgtacggaacggtaccgaaccggaacggacccgtaacgggtcttaacgtttacgtacgtttaacggtcgtacgggtaaccgtaaacgggtacgggtacccgttaactacgttaacgttaccggtttaaggtttacgggtttttaacgtaacccggtttccgttaccgggttacgggaaacggttaaaccgggaacgttaaccggtttccgtaacccgttaccccg

SEQ ID NO: 191820 - DNA, 839 bp, Homo sapiens
  misc_feature: GYAE6OF02J3HQK.35.44.D11.1.454.CMB.1.raw
tcagtacagatcgtcacgaccggtgctcgatttagcgcagtacgaaggggcccagccctgggactcccagctgtttctgcttgctgatcaggactgcacacagagaactcaccatggagttcgggctgagtctgggttttcctgttgcctatttaaaggtgtccagtgtgaggtgcagcgtggtggaggtcggggagtcttagtcgaggtccgtcgggggtccctgacgactcgtccgtgtcgcacgtccttcgtcggtacttccgtaccttcgagttacgtctacgtcggtatcgacctacgtcgggtaccgtacgtacggtaccggagggtacgggtcgttggtcggttacggttacgtacggtacgttacggtacggtacggtacggtacgggtactacggaacctaacgtacgtaccggtacggaccgggtaccgttacgggtacgggaaccgggtacccttacgttccccgaaccccgtacgaacggaaccgaaccgaacgaacccgtaaaggaaccacgttaaacttacgtacgtacctacggtaaactaaacggtcgaaaaccgtgtacccgtaacgggaacgaccgggccgtaaacggtacccggtacgttacttacggttaaccttaacgtttaccgacggttaacggtaaacgtacgggttaccggttaaccgtaaccgtttaaccgtaacgtttacccggtttaaacgggtttttacggttacccggtaaggtttaaccccgggtaccggggttaaaccggggtaaccgtaaaaccggggtttaccggttaaacgggtttacccccgggttcccgtttaaaccccggg

SEQ ID NO: 191821 - DNA, 562 bp, Homo sapiens
  misc_feature: GYAE6OF02FJSCR.35.44.D11.1.454.CMB.1.raw
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagtacagatcgtcacgaccggtgctcgatttagcgcagtacgaagggggcccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagccgtggggggtccctgagactctcctgtgcagcctctggattcaccttcagtagtcactggatgcacgtgggtccgtcaacgttccgaggggaaggggcgtggtggttgggtttcacgttattacgagtgagtgggactgacacaatctacgcggactccggtagaagggccgacttccaccccctcgacgacgaccaacgccaaagaacacaactatatctagacaaatcgaaactgtctagagacgcgaggaccacggctagtctattacgngtagcaaggngtacgactacaatctaagttggtttagattcgtggcgggtacgaaggctaagtcggtacctacccgg

SEQ ID NO: 191822 - DNA, 988 bp, Homo sapiens
  misc_feature: GYAE6OF02HARQI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcacatggagttcggctgagcgttgggttttccttgttgcctaattttaaaaggtgtccagtgtgaggtgcagctggtggaggtccggggagcttagtcgagccgtgggggtccctgacgtacctctccgtgtcgccgacgcctcgtacggtacttcctaccttcgaaggttacgtaccaccgtggtaactcggcgtaccggtcgggttcccgtacgtaacggttcccggaagggggtacggggtccgttaggggttcgggttcggggttttacctaaccggttaagtttaaccgggtaaggttcggtaacggttacggggtaaccttacggaacctaaaccgtaacggttacccgtaaccgggtacccgggtaaccgttacccgggtaagggtaaacccggggtaccccgttaacgttacccccgaacccccccggttacccgaaagggaaacccgtaaacccgaaacccggacccgtaaaacggaaaccctaaaccgtaaaccttaaagtaaccgtttacccgtaacggtaaaccctaaaagttaacccgaaaccgtacggtttaaccgtacgggaaaacggtacccggtacccggggtaaaacggaacccggtaacccgggtttacccgttaaccgggttttaaaccgttttaaccgtttaacggtaacgggttacggaaaaccggttaaacgggtaaccggggttaccggtttaaccgttaaccgttaaaccgtttaccggtttaaacgttttttcggggtttttaacgtaccgttttacccgggtttacccggggttaacccgggggtaaaccgttaaaaccggggggtaacccttttaaggggttaccccgggtttaacccgttaaccccgg

SEQ ID NO: 191823 - DNA, 654 bp, Homo sapiens
  misc_feature: GYAE6OF02G94Y7.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagctggtggagtccgggggaggcttagttcagccgtcggggggtccccgagactctcctgtcgcagcctctggattccaccttcagtagttcactggatgcacgtgggtccgtcaaggttccaggggaggggctggtggtgggttcacggtattacgagtgagtgggactgacacaatcgtacgcggacctcgtggaacggtccgacttcccaccccctcgaacgacaaccgaacgaccgaaacgaaccaccgaacctaagtatcctagaccaaatagaaccagtacgtagacgacggccgaaggacgacggtcgtagtacttacgttacgtcggtacgacgaacgggtaggttacgtaactaaaatccgtaaggtttacgggtttttaacgacgttttcggtaaccggtcggggtaaccgtaaacgggggtactaaaggtttccgggtaccgttaacccggtccgtttaacccg

SEQ ID NO: 191824 - DNA, 581 bp, Homo sapiens
  misc_feature: GYAE6OF02F272R.35.44.D11.1.454.CMB.1.raw
  modified_base (328)..(328): a, c, t, g, unknown or other
  misc_feature (328)..(328): n is a, c, g, or t
  modified_base (461)..(461): a, c, t, g, unknown or other
  misc_feature (461)..(461): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgttgccattttaaaaggtgtccagtgtgaggtgcagctggtggagtccgggggaggcttagttcagcctgggggtccctgagctctcctgtgcagcctctggatttccaccgttcagtagtcactggatgcacgtgggtccgtcaagttccagggaagggctggtgtgggtttcacgtatacgngtgagttggactgacacaatcacgcggactccgagaacgggcgatccacccccgtcacgacgacaacgaccaacgaacacactatactctagacaaacagaaccagtctagacgagaccggaggaccgacggntacgttactaatttactgttagacgaaggtagtacggtctaacaagtacgtagttaggtttttagactttacgtcggttacggggaccggaaagggaactaacgtccggtacgtaacccg

SEQ ID NO: 191825 - DNA, 833 bp, Homo sapiens
  misc_feature: GYAE6OF02FGC35.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggtttccttgtgcctaatttaaaaggtgtccagtgtgaggtgcagctggtggacggtccgggggagtcttagttcaggccggtcggggggtccctgacgtactctccttgtcgcagtccttcgtggtacttccaccttcgagtacgtcctacgtggatcgctacgttcgggttcccgttacctaacggtttcccgaagggggtaacggggtccgttgggttcggtttacggggttttaccaaccggtttaagtttaaccgggaggttaggtaaacggttcggggtaaccgttacggaaacctaaccgtaaactccggttaaccgggaccgggtaaccgttacccggtacgggaaaccggggttccccgtaaccgtttacccccaacccccccgttaccgaaaccgggtaaccgtaaacccgaacccggaacccgaaaaacggaacccaacctaaaccttaaattaccgtacccgttaacgaaccaaaaagtccgtaaaaccgttacgttaccgtacggaacggaccggaaccgggacgggaacccgtaaccgggtcctagggtttaccttactttacggtcgttaacggaactaaagggtcgggtacgtaaccttacgaactacgttaggtttcggtttacgacttccggtagggaccgggtaaccgaaacggttactaacgttggtacccttaccgg

SEQ ID NO: 191826 - DNA, 878 bp, Homo sapiens
  misc_feature: GYAE6OF02HNPV5.35.44.D11.1.454.CMB.1.raw
tcagtacagatcgtcacgaccggtgctcgatttagcgcagtacgaagggggccccgagccctgggactcccagctgtttctgcttgctgatcaggactgcacacagagaactcaccatggagttcggctgagcttgggttttccttgttcgacctaagttttaaaggtgtccagtgtgaggtgcgagtcgtggtaggaggtccgggggaggcgttagttcgacgtccggtcggggggtccctaggtagtaccgtcctccgtgtacgaccgacgtccctcgtcggtacttcctaccttctaacggttacgtcctacgtggtacgtcgtacctacggtcgggttaccgtaccggtaaccgttaccgggaacgggggtaacggggtccgttaggggttaggggttccgggttttacgacggttaacgttacgggtacggtggtacggtacggtaacgtacgaactaacgtaaacgtccgtaaccggacccggtccgttaccggaacgggaaccggtaccggtacctaccccgtacccccttaacgaacggtaaccgaaaccgaaccgtaacccgaaacgaccctaaacgaacttacgtacctctaaacgtaacgtaaactaacggtaaccaaggttcgtaacgaaaccgggaccgggtaaccgggaaaccgggtacccgacgggttacccgtttaacggttttaaccgaacgtttaaccggtttcggaaaccgttaacgggtaaggtaaaccgggtcgttaaaccgtaccgttaaacggtttcccgtaaaggtttttcggttaccggtaaccgtttaccggtacggacggggttaaccggaaaccggttacgtaaaccggttcggtaccccgttaacccgg

SEQ ID NO: 191827 - DNA, 813 bp, Homo sapiens
  misc_feature: GYAE6OF02JW7SD.35.44.D11.1.454.CMB.1.raw
  modified_base (751)..(751): a, c, t, g, unknown or other
  misc_feature (751)..(751): n is a, c, g, or t
tcagtacagatcgtcacgaccggtgctcgatttagcgcagtacgaaggggccccgagccctgggactcccagctgtttctgcttgctgatcaggactgcacacacgagaactcaccatggagtcggctgagcgtgggtttccttgttgccaattttaaaggtgtccagtgtgagtgcagcgtggtggagtccgggggagtctttagttcagccggtgggggtccctgagactcgtcctgtgcagtcctctggtacttcctaccttacagtacgttcgaccgtggtactgaccgtacggttcgggtaccgttacgtaaacgttccggaacggggtaacggggtcgttcgggttggttttaccggggtttaccgtaaccgggtttaacgtttacgggagggttaggtacggttacgggtaccgttaacggaacctaacgtaaacgttaccgtaacgggtccggtaccgggttaccggttaagggaaccgggtcccgttaaccgtccccgtaacccccttaccggaacggtaaaccggtaaccaacccgggtaccaaaaggtaacccaccggttaacctaattaccgtactacgaaacgtaaacgtcgaaactaggttaccaaggacgtaacggcgttaacggaaaccggccggttaacgtcgtttaaacgtaaccgtttacgtacggaacgttaacgaaagggttacggttacgaaccttaaccgtagttacgttaaacggtttgggttttanaaccgttccggtaacgggttccggaaacgtaaccgggtagacgttaccggtaccctaccggg

SEQ ID NO: 191828 - DNA, 708 bp, Homo sapiens
  misc_feature: GYAE6OF02GPKQG.35.44.D11.1.454.CMB.1.raw
  modified_base (648)..(648): a, c, t, g, unknown or other
  misc_feature (648)..(648): n is a, c, g, or t
tcagtacagatcgtcacgaccggtgctcgatttagcgcagtacgaaggggggccccagccctgggactcccagctgtttctgcttgctgatcaggactgcacacagagaactcaccatggagttcgggctgagcgttgggttttccttgttgcctaattttaaaaggtgtccagtgtgaggtgcagcgtgggtggaggtccgggggaggtcgttagttcgacggtccggtcggggggtccctggacggtaccttcctccgtgtcgcgacgtccgtcgtggtacttcctaccttcagttacgtctacgtggatgcacgtcgggtccgtcgtaacgtccggaggggagggtcgttgggtggttacgggttcgtacggttagttacggtagtaggtagtcggacgtgactactactcgtacggacgtactcggtacggacggtctactacccacccctacgaacgacgaaccgaaccgaaccaacgtaaccaccgtaacttaactactacgagaaacaaacgtacgaaacgtgttacgaggaacgacggaccggaacggaccgtacgtccgttaacggttcttaacgttcgtaggtaccgaacgtaagggtacgttacgacctaagacgttacgtcggtttaggtttaacncgttccggtacgggttacgggaacgtaacgggtaacctacgggttaccggtacctacccg

SEQ ID NO: 191829 - DNA, 762 bp, Homo sapiens
  misc_feature: GYAE6OF02IC2J1.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggtttttccttgttgcctaatttttaaaaggtgtccagtgtagaggtgcagtcgtggtggaggtccgggggagctttagttcagtccggtgggggtccctggagacgtctccgtgtgcacgccctgtcggtattccgtaccttcgtaagttacgtcgtactaggtatcgacgtcgttacggggtcccgtagtaacgttccggaagggggtaagggccggttgggttcggtttgggtttacaacggtttagttaacggagttggaagtcgggactagaccgaactatacgtaccggacgtaccgtcgggtaagacggggaccgttacttaccccgaccccctacgtaccgaaacggtaccaaacccgtaacgaacgaaacctacaaccttaagtaacctcgtacgtaacaaagttacgaacgtactcgtaggaagaccgtacggaaacggaccgtaacggtcgttagtaccgttaagtttaccgtagttacgacgtaaaggtacgggagtaacccgtaacgaacgtttaccgtaacgtttaaggttttcgtaaccgttacggttccggtaacggggaccggtaaaggggtaacccggaaggtttcccggggtaccctttaacccggg

SEQ ID NO: 191830 - DNA, 764 bp, Homo sapiens
  misc_feature: GYAE6OF02HFMLL.35.44.D11.1.454.CMB.1.raw
  modified_base (223)..(223): a, c, t, g, unknown or other
  misc_feature (223)..(223): n is a, c, g, or t
  modified_base (700)..(700): a, c, t, g, unknown or other
  misc_feature (700)..(700): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcttgggttttccttgttgtcctaattttaaaggtgtaccagtgtgagtgcagcgtggtggaggtcggggagtcttagtcagcgtggggtccngacgctctcgtgtcgcacgctcgtgacttcctaccttcagttacgtcacgtggatcgactacggttcggtaccgtacgtaacggttccggaaggggtaaggggtcgttagggttggtttacgggtttaccgtaaagttacgttaaccggtagttaggaacggtttaggacgttaacgaaccgtaactaaagtaccgtaaaccggccggttaacgtccgggtaaggaaaccgggtcccgtaaccttcccccgtaacccgtaaccgaaggaaacgaacccgaaaccgaccgtaaaacgaaccaaactaaaccgttaattaaccgttacgtaaccgtaaaccgtaaaagtaaccgtaaacgtaacgttaaccgtaggaaacgaccggttaaccgaacggtaaccggaacgtccgttaaggttaccttagtacgtacgtagaacgacggtaggtacgactacgtaacgttcgtaaggtttnttacgacgtttaccgggtcgtaacggggaactaacgggtaacgtaacgttacgtacccggtacc

SEQ ID NO: 191831 - DNA, 939 bp, Homo sapiens
  misc_feature: GYAE6OF02HTJ80.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcttgggtttttccttgttgcctaagtttttaaaaggtgtccagtgtgaggtgcagctggtggaggtccggggagcttagttcagcgtgggggtcctgagactctccgtgtgcacgccgtcgtaggattccaccttcagtacgttcaacgtggatcgctacgtcgggtcctacgtaacggttccggaaggggacgggggtcttaggggtttcgggttacgggttttaccgtaacggttttaacggttaaccggtaaggtttagaagggttacggggaacttacggaaaccaacgtaaacgttaccgttaaccgggaccgggttaacccggtaccgggttaacgggaaaccgggggtccctaaaccgttttcccccgaaacccccccgttacgaaacggggtaaccgaaacccgtaaaacccggaacccgaaaaacggaaacccttaaacctaaaaccggtttaaccttaaacttaccgttaacggaaaacctaaaaacgttacggtaaaaccgtaacggttaccggttaacgggaaacgggtaaccggacccgggaaaacgggtaaccccggtaacgggtttacccggttaagtttacccgtttaaacgtttttaacccggtaggttaaaccgggttaaaccgggaaaaggttaaggggttaccccgggtaaacttaaacccttaagttacccggttaaggttttttaccgggtttttagaacggttttacccgtaccggggtttaccgggggaaaccgtaaaaccggggttaaacgaaacggtttcccgggaacccttttaaccccgg

SEQ ID NO: 191832 - DNA, 629 bp, Homo sapiens
  misc_feature: GYAE6OF02IJ2BP.35.44.D11.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (499)..(499): a, c, t, g, unknown or other
  misc_feature (499)..(499): n is a, c, g, or t
tcagtacagatcgtcacgaccggtgctcgatttagcgcagtacgaaggggggaccccgagcccctgggactcccagtactgtttcctgcgttgctgactcaggactgtcacacacgacgaactcaccatggagttcggctgagctgggtttccttgtgccattttaaaggtgtccagtgtgaggtgcagctggtggaggtccggggaggctttagtcagccgtgggggtccctgagactctcctgtgcagcctcnggattcaccttnagtagtcactggatcgcacgtcggtccgtactaacgttcggaacggggaggggccgtgggtggttggttcgtacggttagttacgagtgtagtaggactagacacgtatcgtaccgcggtacctcggtagacggtaccacttcccacccctcgagacgacaaccgaccaaacgaaccacaactataactcgaatacaatacgaactagtctagagacgacgacggacacggnttcgtacttacttacgtgtacgtaacaaggtacggtcgactactaattcggtaagtttacgtttgaaccgttcggtaaccgggttacgggtaccggaacggtaacgtaacggttaccggtaccgtacccg

SEQ ID NO: 191833 - DNA, 858 bp, Homo sapiens
  misc_feature: GYAE6OF02G0HLA.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagcgtggtggaggtccgggggaggcgttagttcagccgtgggggtccctgagactctcctgtgcacgcctctggtactccgtaccttcagtacgtcacgtggatgactcgtcgggtccgtacgaacgttccgaaggggtaacggggtcgtagggttggttcgggttctacggttaagttacggtagtacggtagtagggactacggaacctaactaagtacctaccgggacggtaccgtccggtaagggaacgggcccgtagttaccccaccccccgttacgaacggaacggtaaccaaacccggacccgtaaaacggaaacccacccgtaaacttaacgttaaccgtacgttaacgaaccaaaaagttacgaaaccttaacggtaacgttaggaaccggttaaccgggaacccgggtaaacggaaacccggtacgggtacggttaccggtttaacgttttaaccctttaacggtttaccggttaaacgggttaccggtaaaacggggtaacggggtttaacgggaccgttaaccgttaacggttaacccgtttaagggtttaaccgggttttttacgggttacgttaacccggtttacggggtaccgggttaacccggggtaaaaccgggtaccgggtaaaaccggtttccggggtttaaccccgtttaaccccgggg

SEQ ID NO: 191834 - DNA, 884 bp, Homo sapiens
  misc_feature: GYAE6OF02HOR4I.35.44.D11.1.454.CMB.1.raw
  modified_base (182)..(182): a, c, t, g, unknown or other
  misc_feature (182)..(182): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgtgcctattttaaaaggtgtccagtgtgaggtgcagntggtggaggtccggggagtcttagttcgagtccgtgggggtccctgacgtacttctcctgtcgcacgcctnttcggtacttcctaccttanacggttagtcctacgtaggtntcgtcctacgttcgggtaccctacgaacggtttaccggaacgggggaagggtccggttggggtttacgggtttaggggttttccctaggtttaacgtttaccgggtaggttggtacggtgggtaacgttcggtaaccaagtaaccgttacgtaaccggtaccggtaccgttaccgggtaaggtaaccgggtaccgttacgtttacccccgacccccgttacgaacggtaaacccgaaccgtaacccggaacccaaaacgaaacccgtaaaccgtaacgttaaacttaaccgttacgtaacggtaaaccttaaaacggtaaccgttaaacgtacgttaccgtacgggaacggttaacccggaccggtaccggaaacttaccggcgttttacgtaacgtttaactttaccgtagggtttaacgaaccggtttaaaggaacggggttacaaccgtttaacccgtaagtttaccgtttaacggtttttagggttttacgaacctttttaccggggtaaccgggttcggggttaaaaccccgggacgggttttaaaccgggtacggttacccggggttacccccttaaacccggg

SEQ ID NO: 191835 - DNA, 849 bp, Homo sapiens
  misc_feature: GYAE6OF02I0HQK.35.44.D11.1.454.CMB.1.raw
  modified_base (272)..(272): a, c, t, g, unknown or other
  misc_feature (272)..(272): n is a, c, g, or t
tcagtacagatcgtcacgaccggtgctcgatttagcgcagtacgaagggggccccagccctgggactcccagctgtttctgcttgctgatcaggctgcacacagagaactcaccagtggagttcggctgagcttgggttttccttgttcgcctattttaaaggtcgtccagtgtgaggtgcgtagcgtggtgggaacggtccgggggagtcgtttaggttccgacggtccggttcggggggtcccctggacgtcttccgttccgtggtcgcncgtcctcgtggtacttcctaccgttccagtacgtcctaagtggtattcgcgtaccgttcggtacccgtacggtaacgttccgggaaggggtacgggtcgttgggttcggttacgggtttaccgtaacgtttacggttaacgggtagggttacgtaacggttacgggtacgtaacggtaacgtaacctaaacggtcccgttaaaccgggtccgggtaacccgttcccggggtaacggggtaaccgggttaccccgttaacgttaccccccggtaacccccctaaccgggtaaccggaaccggttaacccgaaccgtaaacccgaaaccgtaaacccgaacctaaccgttaactaacgttacgtaacgaaacttaacgtacggaaaccttggtacgtagggttacaacggaccgacggaccgtacgtacgttacgttacgtaacgttacgtacggtcgaacgtaacggttacgcgtaaccggttactaacggttcggttaggtttaacgttcgtaaccggttaccgttcggttaacggggaccgttaaaggcccttaaggttacccggtcgtaaccccg

SEQ ID NO: 191836 - DNA, 676 bp, Homo sapiens
  misc_feature: GYAE6OF02JYTZ4.35.44.D11.1.454.CMB.1.raw
  modified_base (259)..(259): a, c, t, g, unknown or other
  misc_feature (259)..(259): n is a, c, g, or t
  modified_base (339)..(339): a, c, t, g, unknown or other
  misc_feature (339)..(339): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttggttgcctagttttaaaggtgtaccagtgtgaggtgcagcgtgggtggaggtccgggggaggtcttagttcacgccggtgggggtcctgagacttctcgtgtgcagtcctacgnggattccacttcagtagtcacgtggatgcctacgtcggtcctcgagttaccgaggggtaggcgtggtacgttgggttacncggtattacggagtggtagtgggtactaggacaacggtactcgtacggcgggtaacctcggtaggaacggtcgactttccccgacccttacgacgaacggtacaacccgggtacaaacccgacaaaccctcctaaataccgtagtaacgtacaaaaccgtgaaacgacggttacaggtacggaaacgccggaaccgggacaacgggcgttaccgtgttaacgttacgttggacaaccggtaggacgtcgaactcgaaacgttggtaaccttgggttactaagttccgtaccgggttgaaccggtaacggtaacctaaggttcccggtactacccggg

SEQ ID NO: 191837 - DNA, 818 bp, Homo sapiens
  misc_feature: GYAE6OF02JZF9C.35.44.D11.1.454.CMB.1.raw
  modified_base (756)..(756): a, c, t, g, unknown or other
  misc_feature (756)..(756): n is a, c, g, or t
tcagtacagatcgtcacgaccggtgctcgatttagcgcagtacgaaggggccccgagccctgggactcccagctgtttctgcttgctgatcaggactgcacacagagaactcaccatggagttcgggctgagctgggtttccttgttgcctattttaaaggtgtccagtgtgaggtcgcagcgtggtggtacggtccgggggtaggtcgttagttcgacggtccggttcggggggtccctggagtacgttccgttccgtgtcgacctacgccgttcgtggtactttccgtaacccgtttacgtacgttacgtacgtacgttgggtacttacggtaacgttcgggttcccggtacgtaacggttaccgggaacggggtaacggggtcggtcggttggttacgggtttacgtacggttacgttacggtacggtagtacggtaggtacgtgtaacgacgtaactccgtacgcggtaccgtacggtaggacgggtaccgtacctacccgtaccccgtacgtaacggaccgtaaccgaaccgaaccgtaacgaacctaccgtaaactcgtaaccgttacgtacggtaactaaaacgttacgaaaccgtacgttaacggttaacgacggaaccggtaccggaaaccggtaccgtaaaccggtccggtttaacgtaccttaaccggttttaacgcgggttaacaagggtaacccggtaggtaccgttaacgtaaccctagtacctttagggtttgtttaacgngttacccgttaggtaccggaacgttaacggtaaccgttggtaaccggttcctaccgttaccg

SEQ ID NO: 191838 - DNA, 776 bp, Homo sapiens
  misc_feature: GYAE6OF02GFMAB.35.44.D11.1.454.CMB.1.raw
  modified_base (161)..(161): a, c, t, g, unknown or other
  misc_feature (161)..(161): n is a, c, g, or t
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (318)..(318): a, c, t, g, unknown or other
  misc_feature (318)..(318): n is a, c, g, or t
  modified_base (667)..(667): a, c, t, g, unknown or other
  misc_feature (667)..(667): n is a, c, g, or t
  modified_base (756)..(756): a, c, t, g, unknown or other
  misc_feature (756)..(756): n is a, c, g, or t
tcagtacagatcgtcacgaccggtgctcgatttagcgcagtacgaagggggcccagccctgggactcccagctgtttctgcttgctgatcaggactgcacacagagaactcaccatggagttcggctgagctggtttccttgttgcctattttaaaaggtntccagtgtgaggtcncagctggtggagtccggggagtcttagttacngccgtgggggtcctgagtactcgtcctgtgccacgtcctcgtaggacttctaaccttgaactcgtccaagtgggatacgtcacgttcggtaccgttacgtacgtaccggnggggtaacgggtcggtgggttcgttacggggttccaaggttacgtacggtaggttagacggttagggtctaggtactaacgacgtacgtacgaccggtaccttcggaacggtaccggaccgtttaccgtcccgtaaccccgttacccggaaggaaccgttaaaccgaacccgtaccggtaaaactaacgaacctaacggtttaatcaaaccgtttagaactaaaagtccgaatccggttacaaggtaccggtacgaaaccgtaggtaccggaacggttcctaacggggttccttaaatttaccggagtttacccgaaagtaacccgggttacggaaccgtactttaaanaacccggtttacgttaagggttttccggttaaaccgtccgacgttttaccgggggttacgggaacccttaagggtaacctttaaccggnggggtttaaaccccccgtcg

SEQ ID NO: 191839 - DNA, 885 bp, Homo sapiens
  misc_feature: GYAE6OF02HHS7S.35.44.D11.1.454.CMB.1.raw
  modified_base (159)..(159): a, c, t, g, unknown or other
  misc_feature (159)..(159): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttcctgttgccattttaaagngtccagtgtgaggtgcagctggtggagtccggggagcttagttcagccgtgggggtcctgagactctcctgtagcacggcctctggacttccgaccttcgagtacgtctacgtggaatcggctacgttcggtaccgtacaacgttcccggaaggggtaacgggacgttgggttaggttcgggttttacaacgttaagtttaccggaagttcggagttaggggacttaggaaccaacgtaaacttccggtaacggtaccgggtaccgttacccggtaggtaaaccggggcccgtaaactttccccgaaccccccgttaacggaaacgggtaaccgaaaaccggtaaaccccggaccgtaaaaaccggaaaccggtaaaacccttaaaccggttaaaacttaaccggtttaaccgtaaccggtaaaccgttaaaaacggttaaccggaaaaccttacgggttaaccggttacggtaaacgtaaacccgggtaacccggaaacggaaaccgtaccgggttaacccggttacgtttacccgtttaaacgtttaccggttaaccggttaaggtaacccggaaaagggttaaccgggttaaccggtaaacgtttaaaccgttcgttaaaccgggttttaggttttaacgtaacggtttaccggtacgggttaccggggtaaaccggaacgggtaacgtaaccggtttacggttaccgtacccgtttacccgg

SEQ ID NO: 191840 - DNA, 641 bp, Homo sapiens
  misc_feature: GYAE6OF02GY6GI.35.44.D11.1.454.CMB.1.raw
  modified_base (263)..(263): a, c, t, g, unknown or other
  misc_feature (263)..(263): n is a, c, g, or t
  modified_base (565)..(565): a, c, t, g, unknown or other
  misc_feature (565)..(565): n is a, c, g, or t
  modified_base (599)..(599): a, c, t, g, unknown or other
  misc_feature (599)..(599): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgccattttaaaaggtgtccagtgtgaggtgcagtctggtggaggtccgggggaggcgttagttcagccgtgggggtccctgagctctcctgtgcagcctctggacttctaccttnagtagtcactggatgcacgtcgggtccgtacaaggttcccgaaggggaacggggtccgttgggttcggttggggttttacctacggttaagtttacggaggttggtaagtcggggacccgtacaacctaatccgtacgacggtaccgtccggtaggaacggggtccgactttcccgacccccctcgacgtacgaaccgaaccgccaaacgaaccaacaccttaatactctagacctaaagtagaaaccgtgtacgtagaacggagaccggagaccgacggtcttgtacttagttccgtgtancgtaagcggtagctagatcgtagttggtttactntccgtcgttgggaccgacggatacgtggtaccgtcgttaccg

SEQ ID NO: 191841 - DNA, 782 bp, Homo sapiens
  misc_feature: GYAE6OF02I9VXR.35.44.D11.1.454.CMB.1.raw
  modified_base (228)..(228): a, c, t, g, unknown or other
  misc_feature (228)..(228): n is a, c, g, or t
  modified_base (582)..(582): a, c, t, g, unknown or other
  misc_feature (582)..(582): n is a, c, g, or t
  modified_base (646)..(646): a, c, t, g, unknown or other
  misc_feature (646)..(646): n is a, c, g, or t
tcagtacagatcgtcacgaccggtgctcgatttagcgcagtacgaaggggcccagcccgtggactcccagctgtttctgcttgcgtgagtcaggactgcactacagagaactctaaccagtggagttcggctgagcgttggttttccttgttgtccgtaagtttaaaggtcgtccgagtggtgtaggtcgcagtcgtggtggaggtccggggagtcgtttacgttcgngtccggttcgggggtaccctgacgtacttccgtcgtcgtgcgcgtccgttcgtggtactcctaccttacgagtagccagtggtagtcgccgttaggtcgggtaccgttacgtaaccgttcggaaggggtaacgggtccgttaggttaacggtttcggttaaccgaccggtttaaacgttacggaacggttcggtaacgggttaccgggacgttaaccggaacctacggttaaaacctccggttaaccgggtaccgtaacgttaccggaacgtacggtaccgtaaccgttaccccgaccctacggtaacgtacgaaacccagaacccgtaaagaaccaccgtaacttacgtaacncgttacgaactaaacgtcaaacgtacgcgtagagaccggacgcgaaccgtaccggtaactttanaacgtttcgaagtacggtaacgttcggtacggttaacgtgtacggttacggtacggtaacggtggtacggtacttaacggtccggtaacgttcggaccggggtaccgtaggaccggtacccggtttgaacccccgg

SEQ ID NO: 191842 - DNA, 677 bp, Homo sapiens
  misc_feature: GYAE6OF02GP0XS.35.44.D11.1.454.CMB.1.raw
  modified_base (175)..(175): a, c, t, g, unknown or other
  misc_feature (175)..(175): n is a, c, g, or t
  modified_base (263)..(263): a, c, t, g, unknown or other
  misc_feature (263)..(263): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (496)..(496): a, c, t, g, unknown or other
  misc_feature (496)..(496): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcggtcggtttcgtcgtaggccattaaagtagtcagtgtgagtncagctggtgagtccgaggaggtcttacgtgacgccgtggggtcctgacgctcgtccgtgtgacgcgccgtcgtggacttccgaccttntacggtacgttccacgtgggacttcgccgtacgttcgggtaccgtcgtaaccggttaccgggaggggtacggtcggtggtacggttccgggttanaacggtttnttaacgggcgtaaggnggttcgggacgtagtactaacgaacgttcgtaacggccgtcgttaccgtacggaacggtccgtactcccaacccgtcgagaccaaccgtacgacaacgtacgctaactacgtntcaggacttacagccggttaancttagngacgcggtagaatccggtngttcctagtntacgggntacgaagggtccttggacctttagacggtttcgttaacgttcggttttaaaccgcggttttacccgaagggggtaccctttaaaggtaccgggtaaacgttccgggtatccccgggg

SEQ ID NO: 191843 - DNA, 863 bp, Homo sapiens
  misc_feature: GYAE6OF02GNXUI.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctaattttaaaaggtgtccagtgtgaggtgcagctggtggaggtccgggggagcttagttcagccgtcgggggtccctgagactctccgtgtgcagcctcgtaggtacttccacccttcagtacgtcacgtggatcgctacgtcgggtccgtacgtaacggttaccggaaggggtaacggggtcgttgggttaggtttcggggtttacgtaacggtttaagtttaccggtaggttaggtaacggttcggggtacctaacggtaacctaaccgtaaacgttcccgttaaccgggacccggggttaacccgttacccgggtaacggggaaaccggggtacccgttaacccgtttaccccccgaccccccccgttaaccggaaccggaaaccggaaaccccgtaaaccccgggaaccccgtaaaacggaaaacccctaaccctaaaccgtttaacttaaccggttacgttaaacggtaaaccgtaaaacgtacggaaaacccgttaacggttaccgtaagggaaccggtaccgggtaaccggaaccggggaaccgtaaccggtcggtttacgttaccgttaagtttaccgtagggtaccgaacgaagggtacggttacgtactaacgacgttcgttaaggtttacgggtttactaacgttcggtaccgggtacgggtaccggtaaacgggacttacggttcggtacccttacccgg

SEQ ID NO: 191844 - DNA, 652 bp, Homo sapiens
  misc_feature: GYAE6OF02F2KY0.35.44.D11.1.454.CMB.1.raw
  modified_base (162)..(162): a, c, t, g, unknown or other
  misc_feature (162)..(162): n is a, c, g, or t
  modified_base (255)..(255): a, c, t, g, unknown or other
  misc_feature (255)..(255): n is a, c, g, or t
  modified_base (504)..(504): a, c, t, g, unknown or other
  misc_feature (504)..(504): n is a, c, g, or t
tcagtacagatcgtcacgaccggtgctcgatttagcgcagtacgaagggggccccagccctgggactcccagctgtttctgcttgctgatcaggactgcacacagagaactcaccatggattcgggctgagctgggttttccttgttgccattttaaaggtntccagtgtgaggtgcagcgtggtggagtccggggagcttagtcagccgtgggggtcctgagactctcctgtggcagcctgtggattcaccttnagtagtcacgtggattcgcacgtgggtcctcgaacgttccgaggggaagggtctgggttgttcgggtttacacgttacgttacggagtggaagttcgggactggaactactaacgtccgtaacggcggaacctcggtaggaacgggtcctaacttcccgaccccctacgaacggacgaacctaaaccgaccaaagaaacccactaactaactactcgtacaacgaaaatcgaaactcgttcacgaacgngtacccgaaggaccgtacgtctacggttacttacgttatacgtcgaacgttaaggcgttacgacttaactagcgttaacgttggtttacacgtttcggacgggttacgggaacaaaccgggtaactgggttaccggtacttaacccgg

SEQ ID NO: 191845 - DNA, 956 bp, Homo sapiens
  misc_feature: GYAE6OF02GYLBC.35.44.D11.1.454.CMB.1.raw
tcagtacagatcgtcacgaccggtgctcgatttagcgcagtacgaagggggccccagccctgggactcccagctgtttctgcttgctgatccaggactgcacacagagaactcaccatggagttcggctgagcttgggtttccttgttgcctaagttttaaaggtgtaccagttcgtggaggtcgcgagtcgtgggtcggacgggtccgggggaggtctttacggttccgacggtccggttcgggggtccctgacgtacttccgtccgtggtcgccacgtccttagtcggtactacctaccttacgacgtacgtctacgtggacgtgcctacggtcggtaccgtacgtaacgttccgggaaggggtaacgggtgtaggggttcggtttagggtttacccgtaacggtttagttaccgggtagttaacggtacggttaccgggtacgtaaccgggtaacttacgtaacgtaccgtaacccggggtaccggtaacggtcccgggttaagggaacccggggtacccgttaaccgtttaccccccaacccccggtttaaccgaacgggaaacccgttaaccccgggaaaacccaaccggaaaacccgtaaacccgtaaacccgtttaacgtttaaacctaaccgtttaccggtaaccggtaaaactaaacgtttaaccgggaaaacgttccggttaacgaaacggtaaccggtaaccgggtacccggtaaaccgggtacgacccgggtttaaacgttacgttaaccgtttttaaacgttacggttacggttaacggggttaaaccgtaaaccgggttgggtaacccgtacgttaaaccgttaggttaccgtttaacggggtttttgttaaaccggttccggttaccgttaacgggttaccggggtaacccggtaaagtttaccgggtaaacggttaccccggtttaacccgttacccggg

SEQ ID NO: 191846 - DNA, 656 bp, Homo sapiens
  misc_feature: GYAE6OF02HCFLT.35.44.D11.1.454.CMB.1.raw
  modified_base (258)..(258): a, c, t, g, unknown or other
  misc_feature (258)..(258): n is a, c, g, or t
  modified_base (468)..(468): a, c, t, g, unknown or other
  misc_feature (468)..(468): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctattttaaaaggtgtccagtgtgaggtgcagctggtgggaggtccggggggaggtcgtttagttcgaggccgtgggggggtccctggacgacttcctcctggtgcncgtcctcgtggtacttcctaccttcagtagtcactggatcgcacgtggtccgtacagttccgaggggtagggctgggtgttgggttcacggtattacggagtgtagtgggactagacaactactcgtacgcggtactccggtaggtacggccgtacttccccacccctcgacggaacacgaaccgaccaagaaccactacttatactcanacctaaagcgtaaacgtgtcgtagtaacggcggacccggagggaccaccggtcgtgttactacgttcgtgacgtacgaaaggtcggtacgtactacgtaacgttcgttaacggtttcggtttagaaccgtttcggttacgggtacggggtaaccgtaagggaccgtacggttacggttaccgtacccg

SEQ ID NO: 191847 - DNA, 1032 bp, Homo sapiens
  misc_feature: GYAE6OF02FVZPO.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggtctgagcgtgggttttccttgttgcctaattttaaaggtgtccagtgtgaggtgcgagcgtgggtggaggtccggggggtaggtcttacgttcgacggtccggttcggggggtccctaggacgtaccttcctccgttaggtcggacgacgtcctcgttaggtacttcctacccttcgtaaggttacgttccgtacggtacggtacgtacggtacctaccggttacggggttaccccggttaaccttaaaccgggttacccggaacggggggtaacggggggttccgttaggggtttaggttcggggttttaccgtaacggttaacggtttaacggaggtaggtaagtcggggtaacttacggaaccgtaacgtaacgttccgaaccgggtccgtaaccgttccggtaacgggtaaccgggtaccgtaaccttacccccgtaacccccgtaccgtaaacgggaaccgtaaccccgaaaccggtaaccccgtaaaacgaaacccgtaaacccgttaaacggttaaacctttaacgttaacccgtaaccggtaaaacctaaaacggtaacccgggtaaaacgttaaccggttacggtaaccgggttaaaggaacccgggttaacccgggggaaaaccgtaaccgggaaccggttttaacccggttaccgggtttaaacccgtttaacgttttaaccgtaaccgggttacggtaaaaccggaaacgggtttaacgggttaccggttaaccttaacggttaaaccccgtttaggttttaaaccggggttttttaagggttttaccgttaaccggtttaaccggttaccccgggggttaaggggtaaacccgggtaaaacggttaaacccggtttaacgggtttaccccggggttaacccctttaacccggg

SEQ ID NO: 191848 - DNA, 717 bp, Homo sapiens
  misc_feature: GYAE6OF02H3O71.35.44.D11.1.454.CMB.1.raw
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (622)..(622): a, c, t, g, unknown or other
  misc_feature (622)..(622): n is a, c, g, or t
  modified_base (662)..(662): a, c, t, g, unknown or other
  misc_feature (662)..(662): n is a, c, g, or t
tcagtacagatcgtcacgaccggtgctcgatttagcgcagtacgaagggggccccagccctgggactcccagctgtttctgcttgctgatcaggactgcacacagagaactcaccatggagtcggctgagctgggttttccttgttgccattttaaaaggtgtccagtgtgaggtgcagctggtggaggtccggggagcttagttcagccgtgggggtccctgngactctctgtgcagcctctggtattccaccttcagtacgtcacgtggancgctagtcggtccatactaaggtccgaaggggagggtcgtgggttggttcggtttactaacgttagttacggagtaggaggtaggactagaacaactacgtacgtaccggccggtacgtaccgggtaagaaccgggtacctaccgttaaccccgtacccccctaacggaacggtaaccgaaacccgacccggaaacccgaaacgaaaccctaacccgttaaacgtaaacctacggttaaaccacgtaaactaaacgtaacgtaacgtaactaacgtgaacggtacggaaccgggacgaaccacgggttcgtaaacgttcgttaacgttacgttgaagaacggtaacggnggtttacgactaaacgtagtaaccggttattgggtttaanaccgttaggttacgggacgggtaaccgaaacgggtactaggttacccgtaaccgg

SEQ ID NO: 191849 - DNA, 703 bp, Homo sapiens
  misc_feature: GYAE6OF02HW9JQ.35.44.D11.1.454.CMB.1.raw
  modified_base (452)..(452): a, c, t, g, unknown or other
  misc_feature (452)..(452): n is a, c, g, or t
  modified_base (554)..(554): a, c, t, g, unknown or other
  misc_feature (554)..(554): n is a, c, g, or t
  modified_base (565)..(565): a, c, t, g, unknown or other
  misc_feature (565)..(565): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagtcgttgggttttccttgttgacctaattttaaaaggtgtctagtgtgaggtgcagcgtggtggaggtccgggggagtcttagttcagccgtcgggggtccctgagtactcctcgtgtcgcgacgtccttgtcggtactttcctacctttacgtacggttacgttacgaaccgttggaacgttggcctacggttccggggtaccgttacggtaacggttacccggagggggtaacggggtcgttacggggttgggtttacgggtttacctaaggtttagttacggaggttggaaggttcgggtaactacgaacaacgtaacncgtaaccggcggtaaccgtcgtagggaacggcctacgtccccacccgtacgaagacgaacaccgaacctaaacgactaacaactatataccgagaactaaanacgtaaaccgngtaacgtagacggtacgacggtaacgaccgtcggtacctagttcgtaaactttgtacgtagaacgaggaccgttaagactacgattacgtagtttagttgactcgttcgggagtacgaagtacgacttcggtcctacg

SEQ ID NO: 191850 - DNA, 823 bp, Homo sapiens
  misc_feature: GYAE6OF02I2D56.35.44.D11.1.454.CMB.1.raw
  modified_base (179)..(179): a, c, t, g, unknown or other
  misc_feature (179)..(179): n is a, c, g, or t
tcagtacagatcgtcacgaccggtgctcgatttagcgcagtacgaagggggccccagccctgggactcccagctgtttctgcttgctgatcaggactgcacacagagactcaccatggagttcggctgagcttgggttttccttgttgtcctattttaaaggtgtcctagtgtgaggtncagcgtgggtggacggtccggggggaggtcgtttaagtttcgacgggtccggttcggggggttccctaggaggtacgttctccgtgtcgtcgacgtcctcgtcggtacttctaccgttcgtacgttacgtactacgtaggtacgttcgacgtaccggttcgggtccgtacgtaacggttacggaggggaacggggtcttaggggttcggttaggggtttacctaggttaaccgtttacgggtacggtttacggaggttacgggtacgtacggtaaccaacgtaacgttccggtaccggacggtaccggtaccggttacgggaacgggtaccgtaccgttccctacccccgtacacggtaccgaaccgaaaccgtaccgaaaccggtaaacctaacgtaacccgttaattaacgttccgtacggtaacgtaaacgtaccgtaagttaaccggtacgtaacgggaacggtaaccgggtaaccgaacggggtaaccgtacggtaacgtttcggttaacctttacggtttacgtcggtaaccggtacgtacggtaccgggtggtaactacgtacgttcgttaagggttacgtttacgcgttacggtacggtacgggtacgaacggtactacgggtctaccggttaccg

SEQ ID NO: 191851 - DNA, 654 bp, Homo sapiens
  misc_feature: GYAE6OF02FR8GQ.35.44.D11.1.454.CMB.1.raw
  modified_base (274)..(274): a, c, t, g, unknown or other
  misc_feature (274)..(274): n is a, c, g, or t
  modified_base (453)..(453): a, c, t, g, unknown or other
  misc_feature (453)..(453): n is a, c, g, or t
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
  modified_base (576)..(576): a, c, t, g, unknown or other
  misc_feature (576)..(576): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctattttaaaaggtgtccagtgtgaggtgcagctggtggaggtccgggggagtcttagttcaggccgtggggggtccctggagaccttcgtcctgtcgcacgtcctgtcggtacttcaccttnaagttagtccaacgtggaatcgacctcgttcgggtccgtactaacggttcccgaaggggggtaacggggtcttagggtggttcgggttcaacggttattacggagtgtaggtgggactgaacactaacgtccaacggcggtactccgggtaggaacgggcctacttcccaacccccgtnaacggacaaccgaaccgaccgtaaagaacccactaacctaatactcgtanaacctaaaagtcgaaactgttccgtagaggccgaccggagaccgtcggtcgttnttaccgttattactggtanacggaagtgggntacctanactggtatttggttcattcggtacggtcgggacgaaaggtacgagttcggtcctaaccg

SEQ ID NO: 191852 - DNA, 605 bp, Homo sapiens
  misc_feature: GYAE6OF02GO8DS.35.44.D11.1.454.CMB.1.raw
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
  modified_base (479)..(479): a, c, t, g, unknown or other
  misc_feature (479)..(479): n is a, c, g, or t
  modified_base (545)..(545): a, c, t, g, unknown or other
  misc_feature (545)..(545): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaaggtgtccagtgtgaggtgcagctggtggaggtccggggagcttagtcagccgtgggggtccctgagactctcctgtcgcacgcctctggtacttcaccttcagtagtccactggatgcacgttcgggtcctacaaggttccgaaggggaaggggtcctggggttgtcggggtttcaacgttagttacgngtagagtgggactggaacctanaagtcctacggccggtactccggtaaggacgggcccgtattcccgaccccctnaagtacgaccaacgccaacgaacacactatactctagacaaactgaacagttcngaacgaggcccgaagggtacacgggtctcgtaccttagttactggttcgaactaggcgtgacctanaactgtaattcggtttanttccgnggtacgggacctaggacctaagtcggtactaacccg

SEQ ID NO: 191853 - DNA, 766 bp, Homo sapiens
  misc_feature: GYAE6OF02G1EKE.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagcgttgggttttccttgttgcctaagtttttaaaaggtgtaccgagtgtgaggtgcagcgtggtggaggtccggggagtcgttagttcagccgtggggtcctgagactctcgtgtcgcacgtctcgtagtacttacctaccttagtagtacgtacgtacgtaggtagtcgaccgtacggtccggtaccgtacggtacggtacggaaggggacggtggttaggttagggtttcggttacgtacgttaacggtacgtaggtaggaggtacggtagtacgaacaactaacgtacgtacgaccgtacgtacggtaacggacggtacctaccgtaccccgacccgtacgaacgaaccgaaccgaaccgtaaccgaaacgaaccctaaccgttaataactaccgttagaaccgaaacgttaagtaaccgtaactacgtcggtaacggtaacggaaccgggtaccggaagtaaccggaccggtttaccgtagtttaaacctttacgtagtagaaccgtaagtaacgggttaagtacccgtaataaccgtactttaggtttaggttttaccgttaaggacccgtttccggtagggtaacccgggattaaacccgggtacttagggtaccctaacccggttaccc

SEQ ID NO: 191854 - DNA, 709 bp, Homo sapiens
  misc_feature: GYAE6OF02GH0Q2.35.44.D11.1.454.CMB.1.raw
  modified_base (143)..(143): a, c, t, g, unknown or other
  misc_feature (143)..(143): n is a, c, g, or t
  modified_base (183)..(183): a, c, t, g, unknown or other
  misc_feature (183)..(183): n is a, c, g, or t
  modified_base (590)..(590): a, c, t, g, unknown or other
  misc_feature (590)..(590): n is a, c, g, or t
  modified_base (701)..(701): a, c, t, g, unknown or other
  misc_feature (701)..(701): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagcgtggtttcgtntagcctaatttaaagtgtccagtgtgagtgcagcgtgggnggtacggtcggggacgtcttacgttcaggtccggtcgggggtcctcggacgtacttcctcgtagtcgacgtcgtcctgtggacttccgaccttcgtacgttacgtacctcgtaggcgttcgacgtcggtcggttaccgtactaacgggttccgaggggtaacggggtcttgggttacgggtgggtttacctaggtacggttaacgagttaggagttcgggtaaccgtagaaccaaccgtaacgttccgtaccgtacggggtaccttaccggaagggaccggtacccgtaaccttccccgtaccccccgaagaacggaccgaaccgtaaaccgacctaaaagaaccgtacctaacgtattactacgcgtaacctaaagtccgaacgttgtacgtaagcgaacgggacncggtaaccgcgtacgttcgtactttcgagttcgtcgaacgaggttgactaactactgttccgttagggtttctaaggtccgttgtcccggaggtaccgagttacgacggtncccgttcg

SEQ ID NO: 191855 - DNA, 720 bp, Homo sapiens
  misc_feature: GYAE6OF02G2S4N.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctaattttaaaaggtgtccagtgtgaggtgcagctggtggaggtcggggagtcttagttcagccgtgggggtcctgagtactctcctgtcgcacgcctcgtggtacttccaccttcagttagtctactggatgcgtacgtgggtcctacgtaacgttccggaaggggaacgggtcgtgggttggttcgggtttaccacggttaacgttacggagtaggtacggtagggtactggaactacgtaacgttccgtaaccggtccggtacgttaccgggtagggaaacgggtcccgtaacgtttaccccaacccccgttacgaacggaacgaaccgtaaccgaccaaaacgtaacccaaacctacttaaactacgtctaacgaactaaataccgaaactacgttacgaggaacgtaaccggaccgtaacggaaccgtccggtacgttcgtacgttaattacggttacgagtacgaaggttacgggcgtaccttagtacgttacgttaggtttaggtttcgacttcggtacggtacgggtaacgtacggaacgttacggttacggtacccttaccg

SEQ ID NO: 191856 - DNA, 770 bp, Homo sapiens
  misc_feature: GYAE6OF02GA6WQ.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagcttgggttttccttgttgcctaattttaaaggtgtccagtgtgaggtgcagtcgtggtggaggtccgggggagtcttagttcgagccggtcgggggtccctggagtactccgtccgtgtcgaccacgtcctcgtggtacttacctacccttacgtacgttagttaccacggttaggaacttcggtcctacggttcggggttacccgtacggtaacggtttccggaagggggtacgggggtcgttggggttcggttacggggttttacctacgggtttaacgtttacggtaggttaggtaaggttcgggtaacgttacggaacctaacgtaactccggttaacccggacgggtacccggttaccgggtagggaacccgggttacccgttaacgtttccccgaaccccccttacggaacgtaaccggaacccgtaacccgaaccgaaacgaaacccaacctaacgtactaacgtaccgtagaactaaagttacaacgtgtacgtagacgaacggcgagacgtacgtctaggttacttagttactagtacgtcgaaggtgacgtatacgtactagtacggtttagttacgtacgttacgttcggcggtacggaacggtacgtacggtacgtcgttaacccg

SEQ ID NO: 191857 - DNA, 656 bp, Homo sapiens
  misc_feature: GYAE6OF02FR6KE.35.44.D11.1.454.CMB.1.raw
tcagtacagatcgtcacgaccggtgctcgatttagcgcagtacgaagggggcccccagccctgggactcccagctgtttctgcttgctgatcaggactgcacacagagaactcaccatggagttcgggctgagctgggttttccttgttgcctaattttaaaggtgtccagtgtgaggtgcagctgggtggaggtcgggggagcttagtcagccgtgggggtccctgagactctcctgtgcagcctctggtacttcctaccttcagtacgtcacgtggatcgctacgtcgggtcctacgtaacgttccggaaggggaaggggtcgtgggttggttcgggtttacgacgttagttacgaggtgagttcgggactagacaacaagtccgtaacggccggtacgtccggtagaacgggtccgtactacccacccctcgacggacgaccaacgaccaaagaaccactactatactcacgaacaaagtcgaactaggtactagacgacggaccgaggacgtccggatcgtacttaattcgtgtagaccgaaaggtcgggtagaccttaacagttacgttaggtttacgggtttacaccttaggttcccggaaggggtaccctaaaaggggtctaacgggttcccggtaccgttaaccccgg

SEQ ID NO: 191858 - DNA, 672 bp, Homo sapiens
  misc_feature: GYAE6OF02HLUBS.35.44.D11.1.454.CMB.1.raw
  modified_base (241)..(241): a, c, t, g, unknown or other
  misc_feature (241)..(241): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (603)..(603): a, c, t, g, unknown or other
  misc_feature (603)..(603): n is a, c, g, or t
  modified_base (622)..(622): a, c, t, g, unknown or other
  misc_feature (622)..(622): n is a, c, g, or t
tcagtacagatcgtcacgaccggtgctcgatttagcgcagtacgaagggggccccagccctgggactcccagctgttctgcttgctgatcaggactgcacacagagaactcaccatggagttcggctgagcgtggttttccttgttgcctattttaaaggtgtccagtgtgagtgcagtctggtaggaggtcggggagcgttagtcgagccggtggggtccctagagactcctcgtgtcgngacgcttcgtggaattccgtaccttgacgttagtctacgtagtacgtgctccgtgggttccgactaacgtcggaacgggtacgggccgttgggttggttacggtttaccgtacggtttaacgttaaccgggtagtaggttaccggcgggtaccgttagaaccccgtaaataacgtaccgttaccgggaccgggtaaacctcgggttaacgggaacgggtacccgtaaccggttcccacccccgttacaacggacacgacccgacaacgaacactaatactanctanactaatacgaactagcgagtacgacgaacgacgacgacgcttagtactattcgtagtgaacaggacgtagacctanacgtacgtagttcggttanaccgttgtacggtacggtcggaaacggttataacgtccgtacgttacccg

SEQ ID NO: 191859 - DNA, 803 bp, Homo sapiens
  misc_feature: GYAE6OF02I6VAK.35.44.D11.1.454.CMB.1.raw
  modified_base (175)..(175): a, c, t, g, unknown or other
  misc_feature (175)..(175): n is a, c, g, or t
tcagtacagatcgtcacgaccggtgctcgatttagcgcagtacgaagggggcccccagccctgggactcccagctgtttctgcttgctgatcagcactgaacacagaggactcaccatggagtttgggctgagctgggttttcctcgttgcttcttttaagaggtgtccagtgtnaggtgcagcgtggtgcgagtcgtgggggccggcgtggtaccagtccgtgggacgtcccgtgagactcgtacctgtacgaagtccctcgtggtacttccttccgttacaaacgtaactagtggacagtacgacgtacggtcgggtacccgaccgtacggacctaccgagggacgaacggggtccgtaggggtagggtcggggtcgggtacgaacggttaggtaacttaacgttccgtaaagttttacggaaagttaaggggtaaaaacgttaaaataaaaacgtacgtttaaccgactaaacgggtaaccgtaccgtaagggtaaaccggggaccgttaacttacccgaacctaccgttacctaaccgaacggtaacgtaaacctaaacgttaacccgaaaacgtaaaccctaaacgtttacccgtactttaacccgtccttacggaacccaaccgtaaagtaacgtaaaccgtaccgtacggtaccgggacccgttaagggaaccgaaccggtaccggtacgttacgtttaccgttaacggtttacgttacggtacggtaacggtaacggaaacgttaacgtaaaccgttaaagttaagtttagtacggtacgttaacggtagtaccg

SEQ ID NO: 191860 - DNA, 848 bp, Homo sapiens
  misc_feature: GYAE6OF02GPQF7.35.44.D11.1.454.CMB.1.raw
  modified_base (800)..(800): a, c, t, g, unknown or other
  misc_feature (800)..(800): n is a, c, g, or t
tcagtacagatcgtcacgaccggtgctcgatttagcgcagtacgaagggggccccagccctgggactcccagctgtttctgcttgctgatcaggactgcacacagagaactcaccatggacgttcgggctgagcgttgggttttccttgttcgcctaattttaaaaggtgtccagtgtagaggtacgcgagcgtgggtggacgggtccggggggtaggtctttaggttaccgacggccggttcgggggggttcccctggacgtaccgtccttccgtgttgacgtacggcccttcgtaggtacttacctaccttcgaacggttagtaccacggttcggattaccggacgtaccggttacgggtcccgttaactaaccgggttacccggaaacgggggtacggggtccggtaggggttcggttttacggggtttaccgtaaaccggtttaaggtttaaccggaacggttagtaaccggtaggggtaccttacggaaccaaccgttaacgtaccggtacggacccggttaacgttcccggtaagggaaaccgggtacccgttacccgttacccccgtaacccccgttaacggacgaaaccgggtaacccaaacccggaaccaaacccggaaaccaaccctaaacgttaacttaagtaccctaaggaaactaaaacggtacaaacgtagttacgaacgaacgtccggaacgaaacgggaccgaccggtgtaccggttataacggtttacagggttacgaactagggtagtaccgacgtaataccgttagtacgtttggtttacncgttacgttcggacggacggtaaacggtataaggtcccgtacgtaccg

SEQ ID NO: 191861 - DNA, 822 bp, Homo sapiens
  misc_feature: GYAE6OF02FQAXG.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcgggctgagctgggttttccttgttgcctattttaaaggtgtccagtgtgaggtgcagcgtggtggacgtcgggggagtcgttagtcagccgtgggggtccctgacgactctccgtgtcgcagcctcgtggtacttcaccttcgagtacgtctacgtggactgctacgtgggttaccgtacgtaacgttaccgagggggtaacgggtcgttgggttgttcgggtttactaacggttaagttacggtaggtcgaggttgggtactacggacctaacgtaacgttaccgtaacggtaccggtaccgttccggtaagggtaacgggtacccgtacttaccccgaaccccccgttacgaacggtaaccggacccgaaaccggtaacccgaaacggtaaacctaccaaacgttacctaacgtccgtaagaaccgttaaagtacggaaaccgtaggttaccaggtaacgtaccggaccggaaacggaccggtacggtaccgttacggttacgtttacttaaccggttacggtacgtaaacgtaacggttaagggtacgggttaaccctaacggtaacttaccgggttaaacggtttttacggggttttaacttacgtttaccccgggttaacgggtacccgggggtaaaccgttaaacgggggtaaccccttaagggtttacccgggttaccgtttaacccccgg

SEQ ID NO: 191862 - DNA, 844 bp, Homo sapiens
  misc_feature: GYAE6OF02HDU9I.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggacgttcgggctgagtcttgggttttccttgttgtacctaattttaaaggtgtccagtagtggtaggtgcagcgtgggtagggacgggtccgggggaggtacttaggttccgacggtcccgggtcgggggggtccctaggtacggtacctccttaccgtggtcgactccgtccgtctacggtacttaccgtacccttagtaacggttacgtccaacggttcggtatcggacctacggtcggggtccgtacgtaacggtaccgggtaaggggacggggtcgttcgggtaggttcgggttacgtaacggttaacgtacggaggttaggtaggttacgggtacgtacgtaaccgtactaaacggttccgtaaccgggtccggtaaccgtaccgggtaacgggaaccgggtccgtaaaccgttcccctaacccccgttacggaaacgaccgtaaaccaaacccggtaacgaaacgaaccaactaacgtaaccgtactcgtaaacgataaacgagtaaactcggtactacgggaacggtacggaccgaacggaaccgtcgtacggttacttacgttaacttaaccgttacggttaacgtaaacggggtactacggtaacccttaaggttacgttaacgttggttttaacggtttagttaccggtccgtttacggggtaccggggtaaccgtaaggtaacccggttacggttacggttccctaccggttacc

SEQ ID NO: 191863 - DNA, 592 bp, Homo sapiens
  misc_feature: GYAE6OF02GVX9Y.35.44.D11.1.454.CMB.1.raw
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
tcagtacagatcgtcacgaccggtgctcgatttagcgcagtacgaagggggccccagccctgggactcccagctgtttctgcttgctgatcaggactgcacacagagaactcaccatggagttcggctgagctgggttttccttgttgcctaattttaaaaggtgtccagtgtgaggtgcagctggtggaggtcgggggagtcttagtcaggtccgtgggggtcctgacgtactctcctgtgcagtcctcgtggtcttcaccttcgagtacgtcacgtgagtcncncgtggtcctacgaacgttcgagggaggngtggtgtggttcacgtagtagagtgagtggctagacactaatcgtacgcgtacgtcggaggtaacggcctacttacccaccctacgacgacgaccaacgacaacgaaaccactaactaatacactagaactaaatacgaaacgtgtactaggacgtacgaccgaacggacggacgtcgttacgtacttatacgtgacgtagaaaggtgtacgtactacgtatacgtagtttaggttacattcgtcggtacggccgaaagggtctaagtccgacgtacg

SEQ ID NO: 191864 - DNA, 650 bp, Homo sapiens
  misc_feature: GYAE6OF02HMYNA.35.44.D11.1.454.CMB.1.raw
  modified_base (224)..(224): a, c, t, g, unknown or other
  misc_feature (224)..(224): n is a, c, g, or t
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagtacagatcgtcacgaccggtgctcgatttagcgcagtacgaagggggccccagccctgggactcccagctagtttctgcttgctgatcaggactgcacacagagaactcaccatggagttcggctgagcttgggtttcttgtgcctaattttaaaggtgtccagtgtgaaggtgcagcgtggtggaggtcggggagtcttagtcagccgtcgggggtccngacgactctccgtgtgcacgccgtacgttaggtattcctacctttacgacgttaacgtcgtaacctggtaagtcgtacgtaccggtcggggttacccggttaaccgtaaaccggtttaccccggtaaaagggggggggttaaaaccngaacgcagtactcgcaagccagcacngagagcatccganatacnactagancacgtanagagtacagtaccgtactaccgtatacgagaactacgtacacgaagtacctacgacacgtacgtacgactacgacgtactaagacgtacgtacgacgtacgtaacgtaagtacgtacgtagaacgtacgtacgtacgtaacgtacgtaacggtacgtaacgtaaccgttaacgttaagtaccggaaccggtaaccggtaacggtaaccgtaactagtaacg

SEQ ID NO: 191865 - DNA, 799 bp, Homo sapiens
  misc_feature: GYAE6OF02G0PS2.35.44.D11.1.454.CMB.1.raw
tcagtacagatcgtcacgaccggtgctcgatttagcgcagtacgaaggggccccagccctgggactcccagctgtttctgcttgctgatcaggactgcacacagagaactcaccatggagttcggctgagctgggttttccttgttgcctatttaaaggtgtccagtgtgaggtgcagctggtggaggtccggggagtcttagttcagccgtgggggtccctgacgtactctccgtagtcgcacgtcctacgtcggtacttccgtaccttcgtaacggttacgttcctaaccgtggtaactcgtaccgacgttcggggtcccttacgtaacgttacccggaagggggtaacgggtccggttagggttcggttcgggttttacgtaccggttaagtttaccggtaggtaggtacggttacggggtaccttaggaaccgtaactaacgttaccgtaaccggtacggtacccgttccggttacggaaccggggtacccgttaaccgttccccgaaccccccgttcgaacggtaaacccgaaccgtaaacccgacccgaaaaggtaccccgtaaactaacgtaacttacggttacgtaacgtaacgtaaaacgtacgaaccgttaacggttacgttacggaggaccgacccgggtaagaccggtaacggtcttacgttacgtactttacggtagtacggtactaaaggaccgtcgaactttaacgacgttacgtggttttcggttagtaacccttcggttggaacgggtacctaacgggtactaacgttaccggagttacccg

SEQ ID NO: 191866 - DNA, 979 bp, Homo sapiens
  misc_feature: GYAE6OF02F0E8N.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatggagttcggctgagtcgttgggttttccttgttgcctaagttttaaaggtgtcctagtgtgaggtgcgtagcgtggtgggtacgggtccggggaagtctttagttcgacggccgggttcgggggtccctggacgtaccgttccgttccgtgtcggaccgacgttccgtcgtaggtaccttaccgtaccgttcgtaacggttacgtaccgaaccggttggtaactcggtacccgttaaccgggttcgggttacccgttaaccgttaacggtttaccccgggtaagggggtaacggggtccggtttaggggttcgggttttaaccgggtttaccgtaaaccgggtttacggttaaccgggttagttaccgggttaaggttcgggtaaccgttacggtaaaccgttaaacggttaacccggttaaccggttacccggtaaacccggggttaccttaccggggtaaacgggtaaacccgggtaacccgtttaaccccgttaacccccggtaaccccccgttaacggtaaaagggaacccggtaaaacccgaacccgttaaacccggtaaaacaaccgtaaacctaaaccgttactttacgtaaccgttaacgtaaacctaaacgtaacggtaaaccgttacgttaaccggtagaaacggtaaccggtaacccgaacgggttaaccgaccgggttacttagggttaacccttttaggttaccgcggtttaacgaacgggttaacggtaggttaaccgacgttaacgtaaccgtttgtaaccggtttggtttaactaccggtttaccggttacggaacgggttaaccgaccgggtaacgttaacggtacccggttaacccgttaccgg

SEQ ID NO: 191867 - DNA, 802 bp, Homo sapiens
  misc_feature: GYAE6OF02JSCA9.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccatcggagttcgggctgagcttgggttttccttgttgcctagttttaaaggtgtcagtgtgaggtgcagtcgtggtggtaggtccgggggagtcgtttagttccagggtccggtggggggttccctggacggtaccttccgttccgttggtcgtacgacgtccgttccgtaggttactttcctaaccttcggtaacgttacgtaccgtaacgttcggtaacgttcgtacctaaccggttcggggtcccgtacgtaacggtttaccggaggggtaacggggtcgttaggggttcggttaccgggtttctaacggtttaaggtacggtaggtttaggacggtacgggtaccgtaggtaacctacgttaacgtaccggtaccggtaccggtaccgtccggtaacgggaacgggtaccctaacttcccgaacccccgtacggtaacgaacgtaacccgaaccgaaccgtaaacgaaacctactaacgttacgtactaacgtacgtaaacgtaacgtaacgtaaacgcgtttacgagtaccggaacgtacggacgacgtacgtcgtacttaccgttaagttcgtacgaggtaaacggacggttacgactaagtactaggttacggttcggtttaacacgttcgtacggtagggtaacctaagggtccttaaggtcggttaccgtaccgttccg

SEQ ID NO: 191868 - DNA, 771 bp, Homo sapiens
  misc_feature: GYAE6OF02IAJPU.35.44.D11.1.454.CMB.1.raw
  modified_base (265)..(265): a, c, t, g, unknown or other
  misc_feature (265)..(265): n is a, c, g, or t
tcagtacagatcgtcacgaccggtgctcgatttagcgcagtacgaaggggggccccagccctgggactcccagctgtttctgcttgctgatcaggactgcacacagagaactcaccatggagttcgggctgagcttgggttttccttgttgcctaattttaaaaggtgtccagtgtgaggtgcagtctgggtgggaggtccgggggaggtctttagttcgacggccggtggggggtccctggagactcctcctgtgcacgtcctntggtattcctaccttacagtacgtcacgttggatcgctacgttcgggtccgtactaaggttaccggagggacgggtcgttagggttcggttacgggtttacacggttattacggaggttacgtagtcgggtactagaacgtaactaagtacgtaccggcggtaccgtcggtacgggaacggtaccgtaacttccccgacccctacgaacggtaacgaacgtaaacccgaccaaaacggtaaaccaccgtaaacttaacgtaacttccgtagtaaacctaaaacgtgtaaaaccgtcgttacgtaagggaaacgaccggtacggaacggaaacccgtacgggtaccttacggttaccttaaagtttacccgtaggttaacccgtaaggaaaggtcgggtaacgtacctaagtaaccgttgtaacggttttaggtttagaccgtttaccgtacggggtacgggaaccgaaaacgggttacgaacggtttcccggtacgttaaccccgg

SEQ ID NO: 191869 - DNA, 727 bp, Homo sapiens
  misc_feature: GYAE6OF02HS0LS.35.44.D11.1.454.CMB.1.raw
  modified_base (131)..(131): a, c, t, g, unknown or other
  misc_feature (131)..(131): n is a, c, g, or t
  modified_base (161)..(161): a, c, t, g, unknown or other
  misc_feature (161)..(161): n is a, c, g, or t
  modified_base (326)..(326): a, c, t, g, unknown or other
  misc_feature (326)..(326): n is a, c, g, or t
  modified_base (537)..(537): a, c, t, g, unknown or other
  misc_feature (537)..(537): n is a, c, g, or t
  modified_base (701)..(701): a, c, t, g, unknown or other
  misc_feature (701)..(701): n is a, c, g, or t
tcagtacagatcgtcacgaccggtgctcgatttagcgcagtacgaagggggccccagccctgggactcccagctgtttctgcttgctgatcaggactgcacacagagaactcaccatggagtcggctgagngttgggttttctgttgactatttaaaggtntcagtgtaggaggtgcgagtcgtaggtggacggtccggggggatcggttattacggaggtccgggtcggggggttcctaggtacggtaacttccttccgtgtcgacgtacgtcctcggtagactttcctaccgttagtacggtacggttacacgtaggtcgttanccgtagtcgggttacctacgtacggttcccggaaggggtggtcggtttacggttcgggttaggtttccggtaactttaaggttcggagttagggaggtaccgggttagcgtaacaactaccgttaagcgaccggttacgaccggtagacggtaccggtctacccgaccccgttagacgacgaccgtaacgccgaaacgcctaactaacttnaacgtgtaacgaataacgtactaactaggtaacgtggaacgtacgacccggacgggaaactcgttacgttagtacttagtacctgtaaccgaaggaggtaggtacggtaatacgttcgagttacggtttagtacgttctacggtcgggtaggtacccgggtaanaaggtacgtttaccggataaccccgg

SEQ ID NO: 191870 - DNA, 613 bp, Homo sapiens
  misc_feature: GYAE6OF02JDJED.35.44.D11.1.454.CMB.1.raw
  modified_base (107)..(107): a, c, t, g, unknown or other
  misc_feature (107)..(107): n is a, c, g, or t
  modified_base (128)..(128): a, c, t, g, unknown or other
  misc_feature (128)..(128): n is a, c, g, or t
  modified_base (369)..(369): a, c, t, g, unknown or other
  misc_feature (369)..(369): n is a, c, g, or t
  modified_base (458)..(458): a, c, t, g, unknown or other
  misc_feature (458)..(458): n is a, c, g, or t
tcagtacagatcgtcacgaccggtgctcgatttagcgcagtacgaagggggccccagccctgggactcccagctgtttctgcttgctgatcaggactgcacacaganaactcaccatggagttcgggntgagcttgggttttccttgttgcctattttaaaggtgtccagtgtgaggtgcagctgggtggaggtccgggggaggcttagtcagccgtggggggtcctggagactctcctgtgcagcctctggattcaccttcgagtagtcacgtggatcgacgtacgtgggtccgtataaggttccgaaggggaaggggtcttggggtgtgggtttacacggttagtacgagtgagtgggactgaacanaatctacgcgacgtcgaggaacggcactccacccctcacgacgacaactcaacgaacacacgtatactcagactaaatacgaaatacgngtacgaaggacgaccgaggacacggcttactattacttacgtcgtagacgaaaggcggtaggaccttaacgaacttacgtaagtttacggtttacggtacttacggttcggttacggggacctaaaggggaacctaaaggtcggtaactacccgg

SEQ ID NO: 191871 - DNA, 1198 bp, Homo sapiens
  misc_feature: GYAE6OF02JB7XG.35.44.D11.1.454.CMB.1.raw
tcagtacagatcgtcacgaccggtgctcgatttagcgcagtacgaaggggtcccgagccctgggactcccagctgttctgcttgcgtgactcaggactgcacacagagaactcaccatggagttcggctagagtcgtacgggttttccttggttcgcctaattttaaaaggtcgtaccgagtgtagaggtgcgacgtcgtggtggaggtccggggagtcttacgtcacgccggtcgggggtaccctggagtccgtctccgtagtcgcgacgtccttcgtaggtaccttaccgtacccttacgtaacggttacgtccgtaacggttaggtaccgtccgtaccggttaccggttaccggggttacccgtaaccggttaaccggttaccggggtaacgggggtacggggtcggttacggggtttacgggttttacgggtttaaccggtaaccgttttaacgggttaaccgggttacgggttaacgggtaacgggtttaccggggtaacccgttaaacgggtaaaccctaaaaccggttaaaccggttaccccggttaaccccgggggtaacccggggtttaacccgggttaaccccgggggttaaacccgggggttaaaaccccccgggggtttaaccccggtttaaaaccccccggttttaacccccccccgggttaaaaccccccccccgggttaaaccccggggaaaaaccccgggtttaaaaaccccccggggtaaaaaacccccccgggtaaaaaaccccccgggttaaaaccccccggtaaaaaaaacccccgggttaaaaaaaccccccgtttaaaaccccggttaaaaacccccgggttttaaaaccggttttaaaccccggtttaaaccccggttttaaaaacccggtaaaaacccggttttaaaaaaccgggttttaaaaccccggtttaaaacccggttttaaaccgggtttaaaccccgggtttaaaacccgggttaaaacccgggggtaaaaccccgggggtaaaacccccggggggttaaaacccgggggttaaaaaccccggggtttaaccccggggttttaaaccggggtttttaaacccgggtttttaaacccggttttttaaacccggggtttttacccgggtttaaacccggggtttaaaccggggttaaaaccggggttaaacccgggggtttaaaacccc

SEQ ID NO: 191872 - DNA, 978 bp, Homo sapiens
  misc_feature: GYAE6OF02GEGNR.35.44.D11.1.454.CMB.1.raw
  modified_base (164)..(164): a, c, t, g, unknown or other
  misc_feature (164)..(164): n is a, c, g, or t
  modified_base (291)..(291): a, c, t, g, unknown or other
  misc_feature (291)..(291): n is a, c, g, or t
tcagtacagatcgtcacgaccggtgctcgatttagcgcagtacgaagggggccccagcccgtgggactcccagctgtttctgcttgctgatcaggactgcacacagagaactcaccatggagttcggctgagcgtggttttccttgttgctaattttaaaggtntccagtgtgaggtgcagcgtgggtggacggtccgggggagtcttagtcgacggtccggtcgggggttccctggacggtaccttcgtccgttggtcgacacgtccttcgtggtacttcctacccgttnacgttacgtcacgtagggtactcgaccgtacggttcgggttccgtaccgtaacggttccgggaagggggtaacggggtcgttcgggttggtttacggggttaacgtaacggtttacgttaacggtaggttaggtaacggttagggtactaacggaacctaaacggtaacgttacccgtaaccggggaccggttaaccggtccgggtaagggtaaaccggggacccttaaccgtttaccccccggtaacccccgtaaccggtaaacgggtaacccgaaaaccccggaacccgtaacccaaaacggtaaacccgtaaccttaaaaccgtaacgttaacccgttaccgtaaacggtaaacccgtaaaacgttaccgggaaaacttacggttaaccgtaaggaaaccgggtaccgggtaaacccgggaaccgggttaaacccgaacccgggttacgtttaccgggttaacctttacggtttaacccggttaggtaacggttaaacgtaaaaccggggttgggtaacccgggttaacttaaccgtaaacgtttacccgggttttaaggttttaaccgggtttttaaccgaccgttttaacccggggttagggggttaaaccccgggggtaaccggttaaaagggggttaaacccctttaaggggtttacccggttaccccgtttaaccccgg

SEQ ID NO: 191873 - DNA, 739 bp, Homo sapiens
  misc_feature: GYAE6OF02JX6ZU.35.44.D11.1.454.CMB.1.raw
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (561)..(561): a, c, t, g, unknown or other
  misc_feature (561)..(561): n is a, c, g, or t
tcagtacagatcgtcacgaccggtgctcgatttagcgcagtacgaagggggccccagccctgggactcccagctgtttctgcttgctgatcaggactgcacacagagaactcaccagtggagttcgggctgagcgttgggttttcctgttgcctaagtttaaaggtcgtccagtgtgtaggtgcgngntgggtggacggtccggggaggtcttagttcacggtccgtggggggtcctgagtaccttctccgtgtcgcacgtccgtcgtaggtattccctaccttaccgtagtaacgtcgtaacgtcggtatggctccggttacgggtccgttaccgtaaaggttcccggtaaggggggtaaccggggtggttggttgggttacgggtttactaacggtttaacgttaaccggaggtttccggtaggttaggtaccgttacgaacgtaacgtacgtaccgttaccggttcggtaacggtacccggtgggtaaaccgggtccaaccgttacctaccccgtagaccgtagaccgacgtacgaagtacctactactactagtacngtacgtaacgtacgtaacgtacgtacgacgtagaacgtccgacgtaccgacgtacttcgtagtactagtagtacgacgaggagtcgtaccgactacgtacgtagtttaggttacgtaaggttcgaacggttccgggaacggtacggtaaccggtacggttaccgttacgttaccccgg

SEQ ID NO: 191874 - DNA, 744 bp, Homo sapiens
  misc_feature: GYAE6OF02GIW6G.35.44.D11.1.454.CMB.1.raw
  modified_base (259)..(259): a, c, t, g, unknown or other
  misc_feature (259)..(259): n is a, c, g, or t
  modified_base (510)..(510): a, c, t, g, unknown or other
  misc_feature (510)..(510): n is a, c, g, or t
tcagtacagatcgtcacgaccggtgctcgatttagcgcagtacgaaggggccccagccctgggactcccagctgtttctgcttgctgatcaggactgcacacagagaactcaccatggagttcggctgagctggttttccttgttgcctaattttaaaggtgtaccagtgtgaggtgcagcgtggtggaggtccgggggagtcgttagttcgagtccgtgggggtccctgagactcgtccgtgtgcacgcctctcggtnttcaccttctagtacgtcacgtggactgacacgtcggtccagtacgtaagttccgaagggaagggcctaggtcggtggtttacaggttacgtaggagtcgaggttcggacgtgtacaataactcgtacgtacgacgttacggtacgaacgggtcctacgttaccccaccccttcgaacgtacgaaccaaccgaccgaaacgtaaaccactaacctaatacgtacctacgtaacgaaactcggtaaaacccngtaccgttaacggacggaaaccggtccgggaaaggtacccgtacggggtacctttacgggtaaaccttttacggttaaccgttacgggttacgaaaaccgttaaggggacgggttttccgaaccgttaactaacggttacgtaaccgtttggggttaaaccttcgtttacccggttaccgggaggggttaaaacccgtaacggggttaaccgttaacgggtccgtttaaccccg

SEQ ID NO: 191875 - DNA, 670 bp, Homo sapiens
  misc_feature: GYAE6OF02I6319.35.44.D11.1.454.CMB.1.raw
  modified_base (281)..(281): a, c, t, g, unknown or other
  misc_feature (281)..(281): n is a, c, g, or t
  modified_base (411)..(411): a, c, t, g, unknown or other
  misc_feature (411)..(411): n is a, c, g, or t
tcagtacagatcgtcacgaccggtgctcgatttagcgcagtacgaagggggccccagcccgtgggactcccagctgtttctgcttgctgatcaggactgcacacagagaactcaccatggagttcgggctgagcgttgggtttttccttgttgcctaagttttaaaaggtgtaccagtgtgaggtgcagcgtgggtggacggtcgggggaggtcttagttcgacgccggtcgggggttccctagagacctctcctgtgcacgcctctggtactctaccgtnagacgtacttattcagtacgacgtggactccgctacacgtccggaggggtaagggccaggtacggtcggtcacgtaaccacgatcgaagcgtaacgtacgtcgacctaacaccgattcggtactacgganacgtatcgttgacggacggctactactacgtatttaacggactaacgtcgtaacggtctcgtagtactgtagtaacaagtacaagacgcgtagacgagtaaccgagacgtacgcttaagtacttacgtacgttagacgtacgtagtacgtttacggtacgggtttacggtaggggttaaccgtcggtttaacggttgggttaaccgggtttaccggttaaaacgggtttcccgggttaaaccgggtacgggtttaacgg

SEQ ID NO: 191876 - DNA, 700 bp, Homo sapiens
  misc_feature: GYAE6OF02F1Z7B.35.44.D11.1.454.CMB.1.raw
tcagtacagatcgtcacgaccggtgctcgatttagcgcagtacgaaggggccccagccctggactcccagctgtttctgcttgctgatcaggactgcacacagagaactcaccatggagttcggcgtgagtcgttgggttttccttgttgtcctaagttttaaaaggtcgtcctagtgtggaggtgctagtcgtgggtggacggtcgggggagtcgttaggttcgacgtccggttcgggggtccctaggtacgactccgtacgtgtcgcgacgtacctcgtggtacttccgtaccgttcgtacgttacgtctacgtggtactgacgtacgtcggtcctagacgttcggaagggaggtgttggtggtcggttacacggttacgtagacgtagtagtaggacgtgactacgtactacgtacgcgtaccgacggtaggtaacggcccgttaataccccgaccccgttagacggacgtaaccgaacgtaaccgaacggtaactaccgtaacgttaagtaacgttcgtaaactacgtaaaacgacgtacgtaacgttacgacgtaaacggtcggaacgacggtacgccggttatcgttaccgtaattcgtccgtaagtactaaggtgtaacgactacgtaattcgtagtcggtttacgacgttacgcggtaccgacggtaggtaactacggtacgtccgttaccg

SEQ ID NO: 191877 - DNA, 971 bp, Homo sapiens
  misc_feature: GYAE6OF02HAZRW.35.44.D11.1.454.CMB.1.raw
tcagtacagatcgtcacgaccggtgctcgatttagcgcagtacgaagggggccccagccctgggactcccagctgtttctgcttgctgatcaggactgcacacagagaactcaccagtcggagttcgggctgagtcttgggtttttccttggttgtccttaattttaaaaggtgtacctagtgtgaggtgccgtaggcgttgggtagggacgggtccgggggtaggtcgtttacggttacgacggtcccggttcggggggttccccgtagacggtacccttccgtacccgttcgttggacccgtacgtcccttaccggttcggtaactttacccctaacccgttttacgtaagttaacggttacctaccggttaagggtacgtacggtaccgttacgggttcccgggtttaccgtaccgttaaacggttacccgggtaacgggggtaaggggggttccggtttcgggggttaggggttttccggggttttaccggtaacggtttaaccggttttacggtaacgggttagggttacggttacgggggtaacgttaaccggtaacctaaccggttaaacgttacccggtaccgggtacccggtttacccgttaccgggtacgggtaaacccgggtccggttaacccttacccccgtaaccccccgttacccgaaaggtaacccgaaaccgttaacccggaaccctaaaccgaacctaacccgtaacctttaacgttacgttacgaacgtaaccgtaagtaaccgtaacggttacgtaaaccggttacggacggtaaccggaccggtacgaaccggttccgtcggttaacctttaccgtttaactaccgggttacgtacgtaaccggtaaggtaccggggtactaaccgtacgttaacgttactgggttttaccggtattacgttaccgtcgggtaccgggtaataaccggtacgtcgttaccgtaccgttccg

SEQ ID NO: 191878 - DNA, 540 bp, Homo sapiens
  misc_feature: GYAE6OF01DKYGW.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtccccctgtcgtggtcatctatcaagacaccaagcggccctcgagggactccctgagcgtattctcgtggctccgaggtcgagggacaacggtcacattcggccatcagtggacgtccaggcagaggacgaggctgacttattattgtacaatcaacacgacactagttcgtacttatcgttcttacgggaactggacgtaaccgtaaggtccaacccggtccgtgggtaccacggaccccaacggaccccaacccctcgtaccg

SEQ ID NO: 191879 - DNA, 499 bp, Homo sapiens
  misc_feature: GYAE6OF01CNEFR.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatcctgagcgattctctggctccaggtcagggacaacggtcacattgccatcagtggagtccaggcagaggacgaggctgactattatgtcaatcaacagacaccattggtacttatgtcttcgaactgacgaacctaaggtcaccgtctgggtccaggacccaaggcccaacccgctcg

SEQ ID NO: 191880 - DNA, 504 bp, Homo sapiens
  misc_feature: GYAE6OF01ELD8L.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacacgtgccgtgttcgggccgggggacaaggcgtgaccgtccgtcggtcacgcccaaggctcgcccccgtggtccc

SEQ ID NO: 191881 - DNA, 520 bp, Homo sapiens
  misc_feature: GYAE6OF01A69BC.51.28.C06.1.454.CMB.1.raw
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagcggccctnagggatccctgagcgattcntggctccaactctgggacacagccatctgaccatcagcggacgcaggctgtggatgagctgacttttactgtcgaggcgtgggacagcgacacgtgaccgtgttcgggccgggggaccaaggtccgtgacccgttccgtccgggtcacggcccgaagggcctacggccccctcgggtcctacccg

SEQ ID NO: 191882 - DNA, 524 bp, Homo sapiens
  misc_feature: GYAE6OF01BWDS6.51.28.C06.1.454.CMB.1.raw
  modified_base (414)..(414): a, c, t, g, unknown or other
  misc_feature (414)..(414): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacacaagcggccctcagggactccctgagcgattctctggctccaactctgggaacacagccactctgaccatcagcgggacgcgaggctgtggatggaggtctgtacttttacngtcgaggcggtgggacacgcgacacgtgccggttggttcggggcgggggaccaaggccgtggaccgtccgtcggtcacggcccgaaggcctccgcccccgtcggtacccg

SEQ ID NO: 191883 - DNA, 571 bp, Homo sapiens
  misc_feature: GYAE6OF01BA00M.51.28.C06.1.454.CMB.1.raw
  modified_base (328)..(328): a, c, t, g, unknown or other
  misc_feature (328)..(328): n is a, c, g, or t
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctcgagggactcccgngacgcgattctcgtggcctcccaactcgtacgggaacacacgccactctcgaccatacgaggccgggacgcgaggcctggtagggatggacggtcgttacgtacttttacgtgtcgacgggtcgtagggacacggaccgactacgtcggccggtgggtccgggcgggggaccaacgggccgtacggtacccgtccgtccggcgaccgcccgtaacggcccgtcccgccccgtcggtctacccg

SEQ ID NO: 191884 - DNA, 714 bp, Homo sapiens
  misc_feature: GYAE6OF01DZYQH.51.28.C06.1.454.CMB.1.raw
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (411)..(411): a, c, t, g, unknown or other
  misc_feature (411)..(411): n is a, c, g, or t
tcagcgatcgtatacacgaccggtgctcgattttagagctcacgtattgggggtttggggctcgggcctcaggaaggccggtagcatcggaggtgcctcagccattggcatggatcccgtctcgttcctcggcgtcttgcttacngcacaggntttgtggcctcctactcgacgctgactcacgccacccgtccggtcgtccggtcgtccccgaggaccagacacgccagcgtcacctgctcgtgggaataaatgcgcgatagatatgtttctggtatacaacagaacgccaggccacgtcccctggtcgtggtcatactatacaagacaccgaagccgaccctgaacgggactcccgtggagcgtatttcctcgttgtacctaccgaaccttcggacgggaacacgaacncccaacttcacgaacccacgtacgacggggacccgggaaccggcggtaacggcgtttagggagggtagttacgggacgggttcttacggtttaacttttttacggtcgggttacgaacggggttccggtacggggaacgagggtacccggaacctcgggtccggtccgggtttccgggggttccggggggaccgggggggtaacccaaacggggttccgtaacccgggtcccggttacccgcgggttacccgaccggacccgaacgggtcccctaccccgggtcccccggtccggttaccccg

SEQ ID NO: 191885 - DNA, 668 bp, Homo sapiens
  misc_feature: GYAE6OF01DK7MK.51.28.C06.1.454.CMB.1.raw
  modified_base (345)..(345): a, c, t, g, unknown or other
  misc_feature (345)..(345): n is a, c, g, or t
  modified_base (467)..(467): a, c, t, g, unknown or other
  misc_feature (467)..(467): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagcccaccctccgtgtccgtgtccccaggacagacagccagcgtcacctgctcgtgggataaatgcgcatagatatgtttcctggtatcaacagaacgccaggccagtcccctgtcgtgtcatctatcaagaccaaccaagccggacccctgacgggactcccgtgacgcgtacttcncgtcggcctccaactcgtacgggaaccacgtacgccctaactcgtacgaccataccgacggacggggaccgcgaacggtcgtcggtaggtagtaggacggtacttacgttaactttttacgnggttacgacggggtcggtacgggtacgacggaccgtaacgtacgttccgggtacccgggttcggggttacccgggggaccggggggttaacccgaaccgggttccgtacccgggtacccggtttcccggtaccgggtacccgaccggtaccccggtaaaccgggcccgttacccccggcccccggttaccggttaccccgg

SEQ ID NO: 191886 - DNA, 709 bp, Homo sapiens
  misc_feature: GYAE6OF01CN9OH.51.28.C06.1.454.CMB.1.raw
  modified_base (343)..(343): a, c, t, g, unknown or other
  misc_feature (343)..(343): n is a, c, g, or t
  modified_base (417)..(417): a, c, t, g, unknown or other
  misc_feature (417)..(417): n is a, c, g, or t
tcagcgatcgtatacacgaccggtgctcgatttagagctcacgtattgggtttggggtgggcctcaggaagcagcatcggaggtgcctcagccatggcatggactccctctcttcctcggcgtccttgcttactgcacaggtatttgtggcctctatgagctgactcacgccaccctccgtcgtccgtcgtcccaggacagacacgccagccgtccaccgtcgtccgtcggtaggggtaataaacgttcgacgtacgtaagtagtatacgtttcgtttcctaggtactacgaaacgaaggaccgaccgacggcctaccgtcccctggtccgtgtactatctanacaacgacacgaacgccgcctagacggctccgtagacgtctacttctcgtcgacctaccgactcgtacggaacncacgccctacgtcctacgactacgtaccgaacgggtcggaacgcggacggtacgtggtaggacgtacgggtacgtacgttccgtttaacgttttacgcggttacggtcgggtacggacggtacgaccggtacgaccgtacggtacccgggtcgggtaccggggttaccgggggaaccgggaaccggtacgtacccggtaccggttacccgggtaccgtaacccgggccgtaaccgacccggtacccgggtacccgttcccccgtaccccggttccggtccccgttaccccgg

SEQ ID NO: 191887 - DNA, 785 bp, Homo sapiens
  misc_feature: GYAE6OF01E5AO9.51.28.C06.1.454.CMB.1.raw
  modified_base (148)..(148): a, c, t, g, unknown or other
  misc_feature (148)..(148): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgnggcctcctatgagctgactcacgccaccctccgtgtccgtcgtccccaggacagacagccagcgtcaccctgccgtcgtaggggaacttaaagttcggccggcgaattaggattatgttttcctggttactacaaacgagaacgccgaacggcccacgtcccctggtcgtcggtctatcctatacaaacgaccaacccgaacgccccggaccccgttacgacgggtacctcccgtaggaacgtccgtatttcctcgtcggtccgtccgaacgggttccggaaacgggaacgtaacccgggtccaaccgtacgttacggaccgtacgttcgacgggtaggaccgtaccggaacgggtacggaacgggaaacggggtacggaacgggtccgtaagttaaccgttttagttttacgttattaacccgaacgttaccaaacgaaccgttaaccgaacccgtttaagttttaccggtttaacgtttacgttaccgtttaccgggtttacggtaaccgtacgggtaacccgtaaccggtaaaccggtttccccggtaaaccccggttcccggtacggggttcccaaacccgggttaacccccggaaacccggggacccccctaaaccccgtaccgttaccccg

SEQ ID NO: 191888 - DNA, 736 bp, Homo sapiens
  misc_feature: GYAE6OF01EV92H.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttgtggccttcctatgagctgactcacgcccaccctccgtgtcccgtcgtccccaggacacgacacgccagtccgtacaccctgccgttcggtaggggtaaattaaatcggaccggtagaatagtattaagttcgttttccgtaggtacaccaaagtacggaacgccaacggcccacgttcccccttaggttccggtcggtactacttacgtactaaccgaaacgaacccgaaccgaacgccccggtacccttacggaaccgggtacttccccgtggaacgtccgtacttccgtcgtcggtcccttaaccaaccgttagaccgggaaacctaacggcgaccctaccttcgacgtaaccctagtaccgacgggtaccgggaccgtacgaacggtcggttaggcggtacgtaggtacgttcgttaacgtttcgtttaacgcggttcgaaccgggtgggtaacgaccgtaacggcaaccgtcgtaccgggcgttaacggggtccggggcggaactcggtaccgtccgggtaacccgtcggtacccgtacggaccccgtaaccggtcggtacccttcccgtccccggtctaccccg

SEQ ID NO: 191889 - DNA, 707 bp, Homo sapiens
  misc_feature: GYAE6OF01BZWDY.51.28.C06.1.454.CMB.1.raw
  modified_base (111)..(111): a, c, t, g, unknown or other
  misc_feature (111)..(111): n is a, c, g, or t
  modified_base (445)..(445): a, c, t, g, unknown or other
  misc_feature (445)..(445): n is a, c, g, or t
tcagcgatcgtatacacgaccggtgctcgatttagagctcacgtattggggtttggggctgggcctcaggaagcagcatcggaggtgcctcagccatggcatggatccctntcttcctcggcgtccttgcttacgtgcacgaggtatttgtggacctcctatgagctgactcacgcccaccctccgtgtccgtcgtccccgaggacagacgacgccagcgtccactgctcgtagggaataagttgcgcgatagattagttgttccgtaggtactacgaaactagaacgtaccacggtcctacggtccccgtagtcggtcgtactagttacctatacgaacgacctaccgaacgcccgtccctagacgggtaccttcccgagtacgccgttattcgacgtcggtaccctacgtaacgtcggaacgtaaccacgaccgcctacgtcncgaccactacggacgacgggacgtcggacggtcgttggtacggtagtcggacgtacttacgttaccgttttagacggtcggtaacggtcgggttacggacgaccggtaccgtacgtaccggtcggtccgggtttaccggggtaccggggaccggggtaaccgtacgggtcccgttaaccgggtcccggttacccgtaccggtacggtaaccccgtaccggtaaccggccccggtttaccccgaccccggttccggtaacccg

SEQ ID NO: 191890 - DNA, 866 bp, Homo sapiens
  misc_feature: GYAE6OF01DRIYK.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttctcggcgtcctgcttactgcacaggatttgtcggcctcctatgagctgactcacgcccacccctccgtcgtccgtcgtccccaggacacgaccacgccaggccgtaccacctgaccttcggtaggggtaattaaacgttcgaccgacgatacggaattagttcgtttaccgtagggtactaacgaaacgtacggaaacgcccgacggccctaaccggttcccccgttaggttccggtacggttacaaccttcttaacgtaacgaacgaccgaacccgaacggtccccggacccgttaccggaacggtccttacccggtacggacggtacccgttactttcccggtacgttaccgggtacccttacccggtaaaccgttacccggtaccggggtaaacccaaccgaaccgtaccccgttaacgtacccggttaccgaaaccccgtaaacggttaccccggaaccggggtaccccggggaaccggtaccggacgggtaccgttaggggtaacggacgtacgggtacggttcgttaaccgtttaccgttttacggtcggtacggtaacgggtcggtacgggtacgacgggtacccgtaccgtaacggttccggtaccggtttcccggggtaccgggggacccggggtaaaccggtccgtaccggtacccggtacccgggttcccggttacccgtaccggaacccggtacccggtaaccgccccggttaccccggcccccgttaccggtaccccgg

SEQ ID NO: 191891 - DNA, 752 bp, Homo sapiens
  misc_feature: GYAE6OF01AZBMZ.51.28.C06.1.454.CMB.1.raw
tcagcgatcgtatacacgaccggtgctcgatttagagctcacgtattgggtttggggtgggcctcaggaagcagcatcggaggtgcctcagccaatggcatggatccctctcttcctcggcgtccttgcttactgcacaggtatttgtcggcctcctatgagctgactcagcctaccctccgtgtccgtcgtcccaggacagacagccagccgtaccaccgtgcttcgtaggggaacttaaagttcggacgcgtaagtagtattagttcgttttaccgtgggttaactaccaaacgaggaaccgaccgacgggtaccctaaccggttcccccgttggtccggttggttaccagttcttaacgtaccgaacgacccgaccgaacgtcccggacccttacgaacgggtaccttcccggtggacgtccgttaattccgtaccgtcggtaccctttacccaaaaccgttcggtaaccgggaacaaccgtacgtaccccgtaacgttcctaacggtaccctaacgtccggaacgggtcccgggtaaaccgcccggttaacgggtctacgggtgggtactagggtacggtccttacggtttactttcgggtacgacgggtacgggtcggtaggtaccgtagggaccgtcgtaagtccgggtccgttaagggccgggaccgggtactacggtcgtccgtaccggtccggtacgccgaccgtacctaccgggacttccccgacccgttggtaccctccgg

SEQ ID NO: 191892 - DNA, 515 bp, Homo sapiens
  misc_feature: GYAE6OF02JQEFU.51.28.C06.1.454.CMB.1.raw
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctcaactctggaacacagccactctgaccatcagcggacgcaggctgtgagtgagctgtactttactgtcgaggtcgtgggacaggccgacacgtcgccgtggttcgggcggggaccaaggccgtggaccgtcgtccggtcgacgcccgacggccgtcggccccctcggtcctaccg

SEQ ID NO: 191893 - DNA, 505 bp, Homo sapiens
  misc_feature: GYAE6OF02IPN0Z.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggcctcagggatccctgagcgattctctggctcaactctggaacacagccactctgaccatcagcgggacgcgaggctgtggatgagctgtacttttactgtcaggcgtggacagcgacacgtgccgtgttcgggcgggggaccaaggcgtcgaccgtccgtcggtcgacgccgaaggcctcgcccccgtggtcccg

SEQ ID NO: 191894 - DNA, 521 bp, Homo sapiens
  misc_feature: GYAE6OF02JAPGC.51.28.C06.1.454.CMB.1.raw
  modified_base (433)..(433): a, c, t, g, unknown or other
  misc_feature (433)..(433): n is a, c, g, or t
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctgggataaattgcgcgatagatatgtttcctggtatcaacagaagccaggccagtcccctgtcgtggtcatctatcaagacaccaagcggccctcgagggatccctgagcgattctctggctccaactcgtgggaacacacgccactctgaccatcagcgggacgcgaggctggtggatggaggctagtacttttactgtcgaggcggtgggacngcgacacgtgccgtggtcgggcggggaccaggtcgtcggaccgtccgtcggtcacggcccgaggcctccggccccgtcggtcctaccg

SEQ ID NO: 191895 - DNA, 676 bp, Homo sapiens
  misc_feature: GYAE6OF02FGBNX.51.28.C06.1.454.CMB.1.raw
  modified_base (325)..(325): a, c, t, g, unknown or other
  misc_feature (325)..(325): n is a, c, g, or t
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcactgctctgggataattgcgcgatagatatgtttcctggtatcaacagaagccaggccacgtcccctgtccgtggtcatctatcaagacaccaagccggcctcgagggactccgngacgcgtattcctcgtcggacctaccctaactcgtaggggtaaaacccaaccgacggtaccccaaccgtccgtaacggtaaccctaacgtaccgacgggaccggggtaacccgaccgaacgggtccgtgggtagggacgttagggaacgggtcgttacggttaaccgtttttacgtcggttaccgtacgggtacggtacggggactacgggaccgtactaccgtcggtccgggttcggttcccggggaccgggggtacaacgggtccggtccggtacccggttcccggtaccgtaccgaccggcccgaacggtcccgttaccggccccccggtacggttacccctacccgg

SEQ ID NO: 191896 - DNA, 624 bp, Homo sapiens
  misc_feature: GYAE6OF02IDML5.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatgtttcctggtatcaacagaagcaggccagtcccctgtcgtggtcatctatcaagacaccgaagcgccctcgagggactccgtggagccgtattctcgtgctaccaactcgtacggaacacgacgccaactcgtacgaacctactaccgacggaccgggacgcgaggccgtggtacggagtggacggtcgttagttaccttttacgtaggtcgtagggtacgggtcggaacgacggacgaccgtaccgtcggccggttcgggttaccggggaccggggggtaaccgtaacgggccgtaccggtacccggtcccggttaccggtacccgaccggacccgaaacgggtcccgtacccggtaccccccggtccggttaacccg

SEQ ID NO: 191897 - DNA, 541 bp, Homo sapiens
  misc_feature: GYAE6OF02FZ18P.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagcggccctcgagggactccctgacgcgattctctggctaccaactcgtacgggaacacacgccactctacgaccatcacggcgggacgcgaggcgtgtggatggaggtcttgtacttttactgtcgaagggcggtgggacaggcgacacgtcgcgtgttccgggcggggaccacggtcgtcggaccggtccgtcggtacgacgcccgaaggtccgtccgtcccccgtggtcccg

SEQ ID NO: 191898 - DNA, 518 bp, Homo sapiens
  misc_feature: GYAE6OF02FGPHQ.51.28.C06.1.454.CMB.1.raw
  modified_base (280)..(280): a, c, t, g, unknown or other
  misc_feature (280)..(280): n is a, c, g, or t
  modified_base (322)..(322): a, c, t, g, unknown or other
  misc_feature (322)..(322): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccngtcgtggtcatctatcaagacaccaagccggccctgacgggntcccctgagcgtatttctctggcctaccaactcgtacgggaacaccacgccactctagaccatcaggcgggacgcgaggctgtggatggagctgtacttttacgtgtcgaggcggtagggacaggcgacacgtgccgtggtccgggcgggacagcgtgaccgtcctggccacgccacggctccgccccgtgtcccg

SEQ ID NO: 191899 - DNA, 620 bp, Homo sapiens
  misc_feature: GYAE6OF02HASPT.51.28.C06.1.454.CMB.1.raw
  modified_base (441)..(441): a, c, t, g, unknown or other
  misc_feature (441)..(441): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcacgccaccctccgtgtccgtcgtccccaggacacgacacgccagcgtcacctgctcgtagggaataagttgcgcgatagatagtgtttcctggtatacaacagaacgcagccacgtcccctgtcggtgtcatctatacaagacaaccgaagccggccacggtacggacttcctaggacgcgactttctcgtggtccctaccaacgtcgtacggaaccacaccgccctaactcgtaccgaccacgtacgacggacgggacgcgacggcgtacggnggtagtaggacgtaccggtcgttaactttcgtagttaccgacggggtaccggttacgggactacggacgaaccgtcgtacggtccggttagggttccggggacgggggacctaacggcgtacggacccggttcgccggtacaccggaccgtacgacccgtccggtccccggtctacccg

SEQ ID NO: 191900 - DNA, 584 bp, Homo sapiens
  misc_feature: GYAE6OF02FYPCP.51.28.C06.1.454.CMB.1.raw
  modified_base (576)..(576): a, c, t, g, unknown or other
  misc_feature (576)..(576): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtcgtccccaggacagacagccagcgtcacctgctcgtgggataaattgcgcgatagatattgtttcctggtatacaacagaacgccaggccacgtccctgtcgtggtcatctatcaagaccacacgcgccctacgaggactcctgacgcgtatcttcgtgcctacactcgtcggaacacacgccctactctacgacctactaccgacggaccgggacgccgacgggtccgtggtggtaacgtcggtggtcgttacgttacgtttactgggtcgtagggtcgggtaggacgaggacgtaccacgtcgtcggtcggtccggggacgggaacgacggtacgtcggtacccggtccgtcggcgtaccggccgaacggtcccgcccggtacccccngtaccccg

SEQ ID NO: 191901 - DNA, 540 bp, Homo sapiens
  misc_feature: GYAE6OF02F76XF.51.28.C06.1.454.CMB.1.raw
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatattgtttcctggtatcaacagaagccaggccagtcccctgtcgtggtcatctatcaagacacaagcggccctgaggactcctgacgcgtaattctcgtcggcctaccaactcgtaggggaaacctcgacgacccactctacgacccatacagggtcgggacgcgaggtctggtcggagtgaggtctgttacttttacngtcgaggtcggngggacngacgcgacgtgccgttgtcgggcggggaccaggcgtacgccggtcgtcgcgacgcccgaaggcctccgtccccgtgtcccg

SEQ ID NO: 191902 - DNA, 669 bp, Homo sapiens
  misc_feature: GYAE6OF02G50OI.51.28.C06.1.454.CMB.1.raw
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctcgtggggataaattgcgcgatagatatgtttcctggtatcaacagaagccaggccagtcccctgtcgtggtcatctatcaagacaccaagcggccctcgagggactccctgacgcgattcctctggcttccgaactcgtagggaacacgacgccactctcgaccagtcgagcgggacgccgagggcgtacggtggagtcgaagggtctgttaaccgtttttacgtcggtacgtacgggtccggttaggggaaccgacgggtaccgtaaccgtaccggttaccgggtcccgggttacggggttaccggggggtacccgggggggaacccgtaacgggtccggtaccgggttaaccccggttcccggttacccggggtaccgacccgggtacccggaaccgggttccccgtacccgggtccccccccggtttccgggtacccgttaccccggg

SEQ ID NO: 191903 - DNA, 720 bp, Homo sapiens
  misc_feature: GYAE6OF02JY9WP.51.28.C06.1.454.CMB.1.raw
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggtatttggtggcctcctatgagctgactcagcccacctccgtgtccgtcgtaccccgaggacagacagccagcgtcacctgctcgtaggggactaagttgcgacgatagatagttcgtttccnggtactcaacaggaacncgacggcacgtcccctgtcgtggtcatctatacaacacaaccgacgccggacctgacggactcccgagacgctacttctcgtcgtacctacgaaccttcggtacggaactaaccgacgtcccaacgtctacgaacctacgtacgacgggccggaccgtcggtacgggctagggtacgtacgtacggtaggtcgttacgttaactttcggtacggttacggacggggttacggtacgggacgacggtaccgtaaaccgtccgttacggggtaccgggtttacgggggttaacccgggggggaccggggtaacccgtaacccggggttccgggtaaccccgggttaccccgggttacccgttccggggttaaccgacccgggtaaccccgggtacgggtcccccgtttacccggggtccccccggttaacggttaccccccg

SEQ ID NO: 191904 - DNA, 671 bp, Homo sapiens
  misc_feature: GYAE6OF02GAMU5.51.28.C06.1.454.CMB.1.raw
  modified_base (259)..(259): a, c, t, g, unknown or other
  misc_feature (259)..(259): n is a, c, g, or t
  modified_base (413)..(413): a, c, t, g, unknown or other
  misc_feature (413)..(413): n is a, c, g, or t
tcagcgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagcccaccctccgtgtccgtgtccccaggacagacagccagcgtcacctgctcgtggggataattgcgcatagatatagttcctggtatcaanagagcgacgcacgtcccctgtcgtggtcatctactacaacgaccaaccgaacgccggcccctacgacgggtactccccgtagacggtaccgtacttcctacgttcgggaccttacccaacgttccgtagggaaccaacgacgacccgtactccncgaaccctacgtacgacggtccgggaccgacgtacggtcgttgggtcggaacgttcggtaacggtcgtttagttaccgttttacgttcggtacggtacgggttaccgggtacgggaccgtaggccgacgtacgtacggtccggttacggtcccgggggaccggggtaccgacggtccggttaccggacccgttccggtaccggtccgaccggtacccgacggtcccggtacccgtcccccggtacgtcccgttacccg

SEQ ID NO: 191905 - DNA, 773 bp, Homo sapiens
  misc_feature: GYAE6OF02IVRCR.51.28.C06.1.454.CMB.1.raw
  modified_base (251)..(251): a, c, t, g, unknown or other
  misc_feature (251)..(251): n is a, c, g, or t
tcagcgatcgtatacacgaccggtgctcgatttagagctcacgtattggggtttggggctgggcctcaggaagcagcatcggaggtgcctcagccatggcatggatccctctcttcctcggcgtccttgcttactgcacaggtatttgtggcctctatgagctgactcacgccaccctccgtcgtccgtcgtcccgaggacacgacacgcagcgtcacctgctcgtagggactaagtcgcgacgatagatnttagttcctaggtactacaacagacgcctaggcctacgtccccgtaggtcgttcggtactacttctaactacgaaacgtaccaaccgaagggccccgtacccgtacggtaccgggtaacctccgtacggaacgtcgtaacgtttccgttcgtacgggtacccttaccgtaaacgttcggtaaccggggaacctaacccgacggtaccccttaacctccgtaacgtaacccgtacgtccgggaaacgggaccgggtaccggaccggtacgggcgttagggtacggtaggtacggtaacggttacgttacggtttaacctttcggtaacgggttcggtacgggacggtaggaaccggtaccggtacgtaaacgttccggtcgggtaccgggtaccggggtaccgggggtaccgggaaccggttaaccggtaccgggttaccgacccgggttacccggtaccggaccggaacccgttacccggaaggttaccccgttcccgggaccccgttcccggttaacccgg

SEQ ID NO: 191906 - DNA, 798 bp, Homo sapiens
  misc_feature: GYAE6OF02G3QNI.51.28.C06.1.454.CMB.1.raw
tcagcgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctcgtgtccgtgtccccaggtacagacagccagcgtacacctgctcgtgggataaactgcgtacgatagagttattcggtttaccgtaggttactctaaacgacggaaacgcccgtaacgggacctaccggtcccccgttggtcgtcggttacagttacctactaccgtaaacgaccctaccggaaacgccccggtcccgttaccgaacggggtaacccttccccgaggaaccggttccgtaagtttccgttaccggtacgggtccctaaacccttaaccggttacggtaaccggggtaaaccaaccgaccgaccctaactaccgttacgaaccctacgtccggaacgggtcccgggacgaccggtcggtccgttaggtcggtaaagttccgggagggttccttccggttacgtttaacgtcggtcgtacgggtaccgggtcgggaacacgggtacctaaccgacggtttacccgtacggtttccggggtacccgggggaccgggggtaccgtacggtccggtaacccggttacccggggtcccggttcccggaaccggttacccggtacccgggttaaaccggccccggtttacccccggtaccccggtacccggttaacccg

SEQ ID NO: 191907 - DNA, 618 bp, Homo sapiens
  misc_feature: GYAE6OF02FXJHD.51.28.C06.1.454.CMB.1.raw
  modified_base (345)..(345): a, c, t, g, unknown or other
  misc_feature (345)..(345): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
tcagcgatcgtatacacgaccggtgctcgatttagagctcacgtattgggtttggggtgggcctcaggaagcagcatcggaggtgcctcaagccatggcatggatccctctcttcctcggcgtccttgcttactgcacaggatttgtggcctcctatgagctgactcacgccacccgtccgtgtccgtcgtccccaggaccagacaggccagcgtcacctgctcgtggggataaattgcgcgatagatattcgtttccgtggtatctaacgacgaacgccacggccagtcccctgtcgtggtacattctatcgaagacacaacgcgaccctgacgggtctcccgngacgcgtattccgtcgtcggtcttcgaacgtcggtacggaacgtacaccgcctacctcgttacacctacgtaccgacgggtcggacgacgacgggtctggcgtacgtggacgtgtacgttacgtttacgngtacgnggtcgaggcgacgctacgacgttcggtcggtcggtaccgggaccgggtacacggtaccgtccggtaccgttcccgtacggtaccgaccgacccggttacggtacccgtccccggaccccggttcgtaccttacccgg

SEQ ID NO: 191908 - DNA, 799 bp, Homo sapiens
  misc_feature: GYAE6OF02FRBTW.51.28.C06.1.454.CMB.1.raw
  modified_base (91)..(91): a, c, t, g, unknown or other
  misc_feature (91)..(91): n is a, c, g, or t
tcagcgatcgtatacacgaccggtgctcgatttagagctcacgtattgggtttgggggctgggcctcaggaagcagcatcggaggtgcctnagccatggcatggatccctctcttcctcggcgtcttgcttactgcacaggtatttgtggcctcctatgagctgactcagccaccctcgtgtccgtcgtccccgaggacacgacacgccagccgtccacctgtctcggtagggaattaacgttgacgcgtatagtattagtttgtttccgtaggttactacgaacgtaagaacgccggacggaccctaccggttccccgttaggttcggtcggtacctacgttccgtaactacgaaacgtaccgtaaccgaacgggtcccgtacccgtacgacgggtacctcccgtgtacgcgttacttcgtcgtccggtaccctacctagtaccggtaggaaaccctacgacctacccgtacgtacgtaccgtaccgtactacggaaccgggccggggaccgtaccgtacggtcggttacggtacgggtacggtacggtacggtaccgtttacggtttaaccgtttacggttacggtaccgggtaccgggttaccgggttacggaaccggtaccggtaccggtaaccgacggttaccgggtcccgggttaccgggggtaccggggggtacccgggacccgggtaaccggtcgggttacccggtaccccgggttcccgtaccggtaaccggtacccggacccggtaaccggttcccggtacccgggttaccccggtccggttaccccgg

SEQ ID NO: 191909 - DNA, 521 bp, Homo sapiens
  misc_feature: GYAE6OF01CGYY4.47.59.F04.1.454.CMB.1.raw
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (438)..(438): a, c, t, g, unknown or other
  misc_feature (438)..(438): n is a, c, g, or t
  modified_base (511)..(511): a, c, t, g, unknown or other
  misc_feature (511)..(511): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaanagaaacctggtcaggctcccaggctcctcatctatgatgcatccaacngggccactggcatcccagacaggttcagtggcaggtgggtctgggacagacttcactctcaccatcagcacgctagagcctagaacgtactttggtacttttattactgtcagtcagcgtgtagttcnggtcctcgtctcgtacgtttcgggcggtacggaccgtagggtggagagtacgaaacgtacgtggtgctgcacntctgtcttac

SEQ ID NO: 191910 - DNA, 510 bp, Homo sapiens
  misc_feature: GYAE6OF01DBJTV.47.59.F04.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctcctcatctgggatgcatccaacaggggccnctggcatcccagccaggttcagtggcaggtgggtctggggacagacttcactctcaccatcagcagcctagagcctgaagtattttgctagtttattactgtcagcagcgtagcaactggcctctctacgtttcgggcggagggccgagggtggagagtcgagacgaatggtggctgcacatctgtcttctac

SEQ ID NO: 191911 - DNA, 513 bp, Homo sapiens
  misc_feature: GYAE6OF01BIP6N.47.59.F04.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttgtgttgacacagtctccagccaccctgtctttgtctccaggggaaangccaccctctcctgcagggtcagtcagagtgttgacagctacttagtctggtaccaagagaaacctggccaggctcccaggctcctcatctgggatgcatccaacgagggccnctggcatcccagccaggttcagtggcaggtgggtctgggacaggacttcactctcaccatcagcagcctagagcctagaagtatttgactagtttatactgtcagcaacgtaatactgcctccgctctacgttcggcggacggaccgagggtcgacagtagaacgtacgtgnggcngcacgtatctagtctcntccg

SEQ ID NO: 191912 - DNA, 504 bp, Homo sapiens
  misc_feature: GYAE6OF01D9FT2.47.59.F04.1.454.CMB.1.raw
  modified_base (497)..(497): a, c, t, g, unknown or other
  misc_feature (497)..(497): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttgtgttgacacagtctccagccaccctgtctttgtctccaggggaaagagccaccctctcctgcagggccagtcagactgttaacttcaactacttagcctggtaccagcacaaacctggccaggctcccaggctcctcatctatggtgcatccaccagggccactggtatcccagccaggttcagtggcagtgggtctgggacagagttcactctcaccatcagcagcctgcagtctgaagtattttgctaattttattacttgtcagcagtataataactgcctcgcttcggcaggacacgactggagattaacgactgtggctgcaccatctgtcttcntctcccg

SEQ ID NO: 191913 - DNA, 520 bp, Homo sapiens
  misc_feature: GYAE6OF01CV5RG.47.59.F04.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (512)..(512): a, c, t, g, unknown or other
  misc_feature (512)..(512): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccaccctgtctttgtctccaggggaaangccaccctctcctgcagggtcagtcagagtgttgacagctacttagtctggtaccaagagaaacctggccaggctcccaggctcctcatctgggatgcatccaacgagggccnctggcactcccagccaggtcagtgcagtggtctgggacngacttcgactctcaccatcagcagcctagacgcctagaagtatttgacttagtttattacgtgtacagactaacgtaaatactcgtctccgtctcgtacgttcggcggtacggacgagggtgactagtagaacgacgtgtgctgcacatctgtcttcntcgtcccg

SEQ ID NO: 191914 - DNA, 529 bp, Homo sapiens
  misc_feature: GYAE6OF01BZ7Y7.47.59.F04.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctctcatctgggatgcatccaacgngggccnctggcatcccagccaggttcagtggcaggtgggtctgggacagcttcactctcacatcagcagcctagacgctagaagtatttgactagtttattactgtacagactaacgtaatactcgcctccgctctacgtttcggacggtacgggacgagggtggacagtacgaaacgacgtggtggctcgcacactctcgtacttctcgttcctcccg

SEQ ID NO: 191915 - DNA, 576 bp, Homo sapiens
  misc_feature: GYAE6OF01CVI28.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccaccctgtcttgtctccagggaaagagccaccctctcctgcagggtcagtcagagtgttgacagctacttagtctggtaccaagagaaacctggccaggctccaggctcctcatcgtgggatgacatcccaacgagggcccgcgtggcactccccaagcccgtaggttcaggtggcaggtgggtctgggactaggacttcactctacaccatcaagcaacgcctagacgcctagtaacgtatttgactagtttatacgtgtacagtactaaacgtaaactacgtcgtcctccgactacgtacgtttcgggacggtacgggaccgagggtcgacagtacgaaacgtaacgtggtaggactggacctaaccgagttaccgtgttacttctgttcccttacccg

SEQ ID NO: 191916 - DNA, 559 bp, Homo sapiens
  misc_feature: GYAE6OF01ES4DP.47.59.F04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggccagtcagagtgttggcagctacttagcctggtaccaanagaaacctggccaggctcccaggctcctcatctgggatgcatccaacgcggggccgctggcagttccagccaggttcaggtggcagtgggtctgggacagacttcactctcacatcagcagcctagacgcctagaacgtactttggtaactttattacttgtacagcgagtcgtgtagttctggccctccgcttctacgtttcgggcggtacgggaccgtaggggtggaaggtagtaccgaaaacggacgttaggtcgggtctcggccaccgtatccgttagttccttcacttcccg

SEQ ID NO: 191917 - DNA, 737 bp, Homo sapiens
  misc_feature: GYAE6OF01CWB72.47.59.F04.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccaccctgtctgtctctccaggggaaangccacatctcctgtagggccgtcagagtattagcatcaacttagcctggtaccagcagacgaccgtgggcaggcctcccgaggcctcctcatctatgatgccgtccaccgngggccacgtcggtttcccagcctaggttcaggtggctaggtcgcgtcgtgggactaggtagttccaacgttcctacaacctataccaactacgcctcgacctagttctaggtaaagttatttttcgacttaagttttaactttacgttgtactagtactaagttacttacgtaacgttaaaccgtcgggtaccccgttacgttacccgtaacccgttttaccgggaaccccggtaaacggggaacccgtaaaccgggtaaccggttaacggggtaaaaccgggttaaaaccgtttaaaaaaccggggtaaaccggtttaccggggtttaacggggtacccgtttaaccgggaaccccgttaaaaccccgttaacggtttaccccgttttacgggtttaccccgttttaacccgtttaaaccccg

SEQ ID NO: 191918 - DNA, 528 bp, Homo sapiens
  misc_feature: GYAE6OF01B2PA4.47.59.F04.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (513)..(513): a, c, t, g, unknown or other
  misc_feature (513)..(513): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtcttgtctccaggggaaaanccaccctctcctgcagggtcagtcagagtgttgacagctacttagtctggtaccaagagaaacctggccaggctcccaggctcctcatctgggatgcatccaacngggccnctggcatcccagccaggttcagtggcaggtggtctgggacagacttcactctcaccatcagcagcctagcgcctagaagtatttgctagtttattactgtcagcaacgtaatctgcctcgctcacgtttcgggcggagggaccgagggtcgacgtagtacgaaacgtacgtggtcggctggcaccattcgtcgttctanacttccttcccgtcc

SEQ ID NO: 191919 - DNA, 605 bp, Homo sapiens
  misc_feature: GYAE6OF01A90VK.47.59.F04.1.454.CMB.1.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccacctgtcttgtctccaggggaanagccaccctctcctgcagggtcagtcagagtgttgacagctacttagtctggtaccaagagaaacctggccaggctccaggctcttcatctgggatgcatccaagacgggccnctggcactccccagccaaggttcaggtcggacaggtgggtctggggtacaggacttcacttcncaccntcagcagcctagactacctagaagtnttttgactaagtttatacgttgtactagactaaacggttaaattacgtcggtaccctccgacttaccgtacgtttccgggacggtacgggacccgtagggtacggtacgaagtacgaaaacggaaccgtggtacgggacttcggacctaaccgacgttccgttacggttaccctttctacgttcccgttaacccccgg

SEQ ID NO: 191920 - DNA, 531 bp, Homo sapiens
  misc_feature: GYAE6OF01DM1SX.47.59.F04.1.454.CMB.1.raw
  modified_base (262)..(262): a, c, t, g, unknown or other
  misc_feature (262)..(262): n is a, c, g, or t
  modified_base (523)..(523): a, c, t, g, unknown or other
  misc_feature (523)..(523): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagacattgttttgacacagtctccagccaccctgtctttgtctccaggggaaagagccaccctctcctgcagggccagtcagagtgttggcagctacttagcctggtaccaanagaaacctggccaggcctcccaggctcctcatctatgatgcatccaacgagggccacgtggcatccccagccaggttcagtggcaggtgagtcgtgggacagacttcactctcaccatcagcagcctagacgcctagaagtatttgctactttattactgtcagcagcgtagcaacgtcggtcctcttctacgtttcgggacgggtacgggacgtaggggtggacgtagtcgaggtacgacgtgtcggtctgacctaccgngttcgtcg

SEQ ID NO: 191921 - DNA, 568 bp, Homo sapiens
  misc_feature: GYAE6OF01CN5BX.47.59.F04.1.454.CMB.1.raw
  modified_base (319)..(319): a, c, t, g, unknown or other
  misc_feature (319)..(319): n is a, c, g, or t
  modified_base (390)..(390): a, c, t, g, unknown or other
  misc_feature (390)..(390): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaagagccaccctctcctgcagggtcagtcagagtgttgacagctacttagtctggtaccaagagaaacctggccaggctccaggcctcctcatctgggatggcatccaacgagggccnctggcatccccagccaggttcagtgcaggtgggtctgggacagacttcactctcacatcagcagcctagancctagaagtatttgactagtttaatactgtcagtacaacgtaaatacgtcgacctccgctaccgtacgtttcgggacggagggtaccgaggggtcgacgagtacggaaaacgtaacgtggtaggctcggaccaaccgtagttccgttacgttacgttcctacgttcccgttacccccg

SEQ ID NO: 191922 - DNA, 606 bp, Homo sapiens
  misc_feature: GYAE6OF01BP0D5.47.59.F04.1.454.CMB.1.raw
  modified_base (203)..(203): a, c, t, g, unknown or other
  misc_feature (203)..(203): n is a, c, g, or t
  modified_base (477)..(477): a, c, t, g, unknown or other
  misc_feature (477)..(477): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacattgttttgacacagtctccagccaccctgtcttgtctccgaggggaaangccaccctctcctgcagggccagtcagagtgttggcagctacttagcctggtaccaactagaaacctggccaggctcccgaggctcctcatctatgatgcatccaagagggccagtggacactcccgagccgtaggtcaggtcggctagggtcgacgttcgtcgggacctagtaccttcaccgttcctaccaacctatcaggccacgccctagacgtcctaggtaactattttcgacttacttttattaccgtgtacagtactaggtacgttanaccgtaacgtcgggtacccttgtacccgtacggttccgggacgggtacgggtaccgaggggttaccggagtacgtacggaacggtaacggtacttgggtacggtacacggacctacgtagttccgtacg

SEQ ID NO: 191923 - DNA, 532 bp, Homo sapiens
  misc_feature: GYAE6OF01AT9SO.47.59.F04.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (523)..(523): a, c, t, g, unknown or other
  misc_feature (523)..(523): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctgaccaggctcccaggctcctcatcgtgggatgcatccaacngggccgctggcatcccagccaggttcagtggcagtggtctgggacagacttcactctcacatcagcagcctagacgcctagaagtatttgctagtttattactgtcagtactaacgtaatacgtcgtcctccgactcgtacgttcgggcggacgggaccgagggtcgacgagtacggaaacgacgtggtgcgtgacactagtctgtcttctnttcctcccg

SEQ ID NO: 191924 - DNA, 772 bp, Homo sapiens
  misc_feature: GYAE6OF01C0F8I.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccacctgtctttgtctccgaggggaaagagccaccctctcctgcagggtcagtcagagtgttgacagctacttagtctggtaccaagacgaaacctggaccaggcctcccgaggcctcctcagttccgtagggatcgacactacccaaacggacgggcccgtcgtggccacgtcccccgaagggcccgtaagggtttccaagggttcgggaccgtaagggttcgggggtaccgtagggggaacctacggtaccctttccgaaccttcctaacccaccctaagtccgaaggccaacggtccctaacggacgtaccgttaaggtaaacgttacgtttttacgacgttaacggtttttaattacgtttacggttaccgtaaggtaaccgtaaaaccggttaaactttaaccgtaccggttacccgttacccggttaccgtttaccgttaacccgggttttccggggaaccggggttaacggggaacccggttacggggtacgggtaacgtaacggtaaacggtaaaccgtacggtacggtacgggacttcggacctaccgtacgttcgttacgttaccttccgtacgttcccgttaccccg

SEQ ID NO: 191925 - DNA, 520 bp, Homo sapiens
  misc_feature: GYAE6OF01CTDBJ.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagatacccaccggagaagttattttgacacagtctccagccaccctgtctttgtctccaggggaaanagccaccctctcctgcagggtcagtcagagtgttgacagctacttagcctggtaccaacagaaacctggccaggctcccaggctcctcatctatgatgcatccaacagggccactggcatcccagccaggttcagtggcagtgagtctgggacagacttcactctcacatcagcagcctagagcctgaagtatttgctactttattactgtacagtacagcgtagactaactggcctctctactttcggcggagggacctagggtaggagacgtcgaggacgtaacgtgtggcgtgaccaccacttcgtgttaccg

SEQ ID NO: 191926 - DNA, 563 bp, Homo sapiens
  misc_feature: GYAE6OF01AM2ZV.47.59.F04.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagngtgttgacagctacttagtctggtaccaagagaaacctggccaggcctcccgaggcctcctcatcgtgggatgcatccaacgngggccgntggcactcccagccaggttcaggtggcgaggtgggtctggggtcagtacttcgactctcacctatcagcagcctagacgcctaggaacgtatttgactagtttattacgtgtcagtactaacgtaatcgtcgtcctccgctctacgtttcggcgggtaggaccgtagggtcggactagtacggaaacggtagtggtaggtcgtgacctacctagtccttagtaccttcacttccgttccccg

SEQ ID NO: 191927 - DNA, 537 bp, Homo sapiens
  misc_feature: GYAE6OF01DPEVJ.47.59.F04.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (373)..(373): a, c, t, g, unknown or other
  misc_feature (373)..(373): n is a, c, g, or t
  modified_base (525)..(525): a, c, t, g, unknown or other
  misc_feature (525)..(525): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctcctcatctgggatgcatccaacagggccnctggcatcccagccaggttcagtggcaggtgggtctgggacagacttcactctcacntcagcagcctagacgcctgaagtattttgactagtttattactgtcagtacaacgtaatactggcctccgctctacgtttcggcggagggaccgtagggtcgacgatacggaaacgaacgtggtggctgaccgaccagttcctagtccttcnttccgttccccg

SEQ ID NO: 191928 - DNA, 572 bp, Homo sapiens
  misc_feature: GYAE6OF01CGWDX.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaangccaccctctcctgcagggccagtcagagtgttggcagctacttagcctggtaccaacagaaacctggccaggcctcccaggcctcctcatctatgatgcatccaacgagggccactggcatcccagccaggttcagtcggcagtgagtctagggacagacttcactctcaccatcagcagcctagacgtacctagtaagtatttgacttactttattactgtcagtcagcgtagctaacgtcggccttctcctacgtttccgggacgggtacgggacccgtaggggtcggaaggtacgtacgaaggtaaccggtaacggttggtcgggtacgttacggaccgtaccgtacttccgttcgtttacccg

SEQ ID NO: 191929 - DNA, 574 bp, Homo sapiens
  misc_feature: GYAE6OF01A8EKX.47.59.F04.1.454.CMB.1.raw
  modified_base (203)..(203): a, c, t, g, unknown or other
  misc_feature (203)..(203): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaacctggccaggcctccaggctctcatctgggatgcatccaacgagggccgctggccactccccgagccaggttccaggtcgcgaggttcggcgtagggacagtacttcactctcacntcagcagcctagacncctagagtatttagcttagtttattacgtgtacgagtactaaacgttaatcgtacggtcctccgctccgtacgtttcgggacggtacgggaccgagggtcgactagtacgaaacgtacgtggtggacgtcgacctacgtacgttccgttacgttaccttctacgttcccgttaccccg

SEQ ID NO: 191930 - DNA, 504 bp, Homo sapiens
  misc_feature: GYAE6OF01E3C4U.47.59.F04.1.454.CMB.1.raw
  modified_base (309)..(309): a, c, t, g, unknown or other
  misc_feature (309)..(309): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctgtctctccaggggaaagagccaccatctcctgtagggccagtcagaatattcactcctacttagcctggtaccaacagaaacctggtcaggctcccaggctcctcatctatgatgcatccaanagggccactggcatcccagacaggttcagtggcagtgggtctgtgacagacttcactctcaccatcagcagcctagagcctgaagtactttggactttattactgtcagcagcgtgagttctggcctccgctctactttcggcggagggaccgagggtggagagtcgaaacgactgtggctgcacatctgtcttc

SEQ ID NO: 191931 - DNA, 532 bp, Homo sapiens
  misc_feature: GYAE6OF01D3JRC.47.59.F04.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagcccaccctctcctgcagggtcagtcagagtgttgacagctacttagtctggtaccaagagaaacctggccaggctcccaggctcctcatctgggatgcatccaacgnggggccnctggcatcccagccaggttcagtggcagtgggtctgggacagacttcactctcaccatcagcagcctagacgcctagaagtatttgctagtttattactgttcacgacaacgttaaatactggcctccgctctacgtttcggacggtacgggaccgagggtcggacagtacgaaacgtacgtggtggctgcaccatctntnttcntcgtcccg

SEQ ID NO: 191932 - DNA, 604 bp, Homo sapiens
  misc_feature: GYAE6OF01CI83Y.47.59.F04.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (379)..(379): a, c, t, g, unknown or other
  misc_feature (379)..(379): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctccaggcctcctnatctgggatgcatccaacgngggccntggcatcccagccaggttcagtggcaggtgggtctggggacagtcttcatctcacatcaaacngcctgctagtcgtagaagttattttacgacttaagttttacttacgtgttactacgtctaagttatactaattaacgtcggtaccctcgttaccgtacccgtttaccggacccgtaaacgggacctaacggtacgtagggtaaacgtaacgttaaaaccggtaacgttgggtacggtcgttacggacctaaccgtattcgttacgttcctttacgactttccccg

SEQ ID NO: 191933 - DNA, 636 bp, Homo sapiens
  misc_feature: GYAE6OF01BBCTN.47.59.F04.1.454.CMB.1.raw
tcagagctcacgtacacgaccggtgctcgatttagtacacacacttagggattgggggaggaactgctcagttaggacccagagggaaccatggaagccccagctcagcatctcttcctcctgctactctggctcccagataccaccggagaagttattttgacacagtctccagccaccctgtctttgtctccgaggggaaagagccaccctctcctgcagggtcagtcagagtgttgacagctacttagtctggtaccaagagaacctggccaggctcccaggctcctcatcgtgggatgctatccaacgacgggccgctgggcactcccagcctaggttcaggtggcaggtgggtctgggacagtacttcactcacacctatcacgcacgcctagacgccgtagtaagtagttttcgacttaagttttacgttacgttgttactacgtacctaaacgttaaacttaccgttcggtacccgttacccgtaccgtaccgtaccgttttacgggacgggtaacgggtaccggtaacggggtacggtaccgtacgtacggtaaaaccgtacgttacgggtacggtcgtacgtacccgaacgtacgttaccgttacggtttccttcctacgttccccg

SEQ ID NO: 191934 - DNA, 508 bp, Homo sapiens
  misc_feature: GYAE6OF01B66YB.47.59.F04.1.454.CMB.1.raw
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
tcagagctcacgtacacgaccggtgctcgatttagtacacacacttagggattggggtaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaaggagaaacctggccaggcctcccaggctcctcatctggggatgcatccaacaggggccgcgtggcactcccagccaggttcaggtgcaggtgtgtcgngggacagtcttcactctcaccntcagcagcctagacgctagaagtatttcgacttactttatacttgtcagcagcgtagcaacgtcgcctctctcgttcggcggacggacgngggtgagatcgagacgagtgngcngcacatctntctc

SEQ ID NO: 191935 - DNA, 821 bp, Homo sapiens
  misc_feature: GYAE6OF01DYC0D.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactggctcagttaggacccagagggaaccatggaagccccagctcagcttctcttcctcctgctactctggctcccagataccaccggagaagttattttgacacagtctcctagccaccctgtctttgtctcagggaaagngccacctctcctgcagggtcagtcagtagtgttgacagctacttagtctggtaccaagagaaacctggaccaggcctacccgaggtcctccgtctatcgtgggatggactactacccgaagacgggccgcgtcgggcacgtcccgaggcccgtaggtttccgaaggttcggacgtaggggttcggggtacgttacgggggaacctaagggtaaccctttaccgaacccgttccgtaaccctaacccgtaagttacccgaaacggtccgtaaacggtaaccggttacgggacggtaccccgttaaggtaaacggtttaacgtttttacgaacggttaaggtttacgtttaacgttttaccgtttacggttaaccgtaacggttaccgtaaacggtttaaggtaccgggaaaccgttccccgttaacccccgttagtttaccccgttaacccggttttacccggggaccccgttacggggtaacccgttaaggggttacggtaaccgttacggtaaaccggtaaaaccggtaaccggttaggttacgggtccttacgggtaaccctaccggttaaccttacggtttaccgtttacctttcccgtacgtttaccccccgg

SEQ ID NO: 191936 - DNA, 568 bp, Homo sapiens
  misc_feature: GYAE6OF01AQH4O.47.59.F04.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (557)..(557): a, c, t, g, unknown or other
  misc_feature (557)..(557): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccaggctcctnatctgggatgcatccaacgagggccgctggcactccccagccaggttcaggtggcaggtgggtctggggacagacttcactctcaccatcagcacgcctagacgcctagaacgtattttgacttaggttttattacttgtactagtactaaacgttaaattactggtccctaccgcttcgtaccgtttcgggaccggtaacgggaccgtaggggtacgacgagtacggaaacgtaacgtgtaggctcgacgacctatctgtacttcnttccgttcccg

SEQ ID NO: 191937 - DNA, 572 bp, Homo sapiens
  misc_feature: GYAE6OF01B83UN.47.59.F04.1.454.CMB.1.raw
  modified_base (448)..(448): a, c, t, g, unknown or other
  misc_feature (448)..(448): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctatgatgcatccaacagggccacgtggcactcccagaccaggttcagtggcaggtgggtctgggacaggacttcactctcaccatcagcagcctagacgcctaggaacgtacgtttggtaacttttattactgtcagctaggtcgtgtagttcncggtccctccgcttccgtaccgtttcgggaccgggtagggaccgtagggggtcgagacgttaccgaaacggtacgtgggtcggccgttaggcctaaccgtacttccgtcgttccttccgtaccg

SEQ ID NO: 191938 - DNA, 796 bp, Homo sapiens
  misc_feature: GYAE6OF01C3TBV.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccacctgtctttgtctccgaggggaaagagccaccctctcctgcagggtcagtcagagtgttgacagctacttagtctaggtaccaagagaaacctggaccaggctcccaggcctcctcatcgtgggatcgacactaccaacgacggggcccgctcgggacctacgtacccccgaacggtacccgtaagggtttccaagggttcgggaccgtaagggttcggggggttcctacggggggaaccagggtaaaccttttccgaaccgtttccttacccaaaccccgtaagttaccgaaacggtcccgaaccgggtacccgttaacgggaccggtaccccgttaaggtaaaacggttacgtttttttacggtactttaaacggttttttaacgtttaacccgtttaggttaacccgtaaaggtaaccgtaaaaccggtttaaaacgttaacccgttaccgggtaccccttaccggaccgtttaccgttaccggttttaccgggggaccgggtaacggggtaaccgtacggggtacggaacgtaagtacggaaaacgtacgtggtacggtacgtcgacctaccgtagttccgttacggttacctttacgtcgttcccgttaccccg

SEQ ID NO: 191939 - DNA, 807 bp, Homo sapiens
  misc_feature: GYAE6OF01AIKEP.47.59.F04.1.454.CMB.1.raw
tcagagctcacgtacacgaccggtgctcgatttagtacacacacttagggattgggggagggaactgctcagttaggacccagagggaaccatggaagccccagctcagcttctcttcctcctgctactctggctcccagataccaccggagaagttattttgacacagtctccagccaccctgtctttgtctccaggggaaagcgcccaccctctcctgcgagggtccagtcagtgtgttcgacagcttacttagtctacggtaccaaggacgaaccctggcccaggcctcccgagcctcctcatcgtgggatcggcaacgtcccaagcgggccgcgtggcacgtcccaaggcctaggttcaggtcggcacgggttcgggtcgtacggggacaaggttacctttccaacgttcccgtaccgaaacctagttaccgaacggtccgtaaacggtacccgttaacggtaaccggttaccccgtaacgggttaaacggtttacgtttttacgtacccggtttaaagtttttaaccgtttaaccgtttaccggtttacggaaccgttaaccgttaaaaccggtttaaacgtttaccggtaacccgggttacccgttaccccgtacgtttacccgttaccgggttttaacccggggaccgggttaaccggggaccgggttaacgggggttaccgtaacggtacgttaaacggaaaccggtaacggtttcggtacgggttacgtaccggtaccctaaccgtacgttacccgtttacggtacctttacccggtaccgtttcccgttaccccggg

SEQ ID NO: 191940 - DNA, 598 bp, Homo sapiens
  misc_feature: GYAE6OF01CNF5Y.47.59.F04.1.454.CMB.1.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
  modified_base (584)..(584): a, c, t, g, unknown or other
  misc_feature (584)..(584): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctcagccacctgtctttgctcgagggaaanagccaccctctcctgcagggtcagtcagagtgttagacagctaacttagtcgtaggtaaccaaagacgaaaccgtggaccgaggcctccgaggtcctcctcattcgngggatgacactaccaacgacgggccncgtcggcactcccgagcctaggttcaggtggcaggttgggtcgtgggacagtacgttcactcgtacactatcagcacgactagagcctagtaacgtattttcgacttaagtttattacgtgtacaggactaaacgtaatacgtcgccctcgtactcgtacggtttccggacgggtaggtaccggagggtacgacgacgtaacggaacgtaacgtggtacgcgtcgacctacctacgtcttagtacccttacncgttcccgtacccg

SEQ ID NO: 191941 - DNA, 770 bp, Homo sapiens
  misc_feature: GYAE6OF01CZVVI.47.59.F04.1.454.CMB.1.raw
  modified_base (122)..(123): a, c, t, g, unknown or other
  misc_feature (122)..(123): n is a, c, g, or t
  modified_base (134)..(134): a, c, t, g, unknown or other
  misc_feature (134)..(134): n is a, c, g, or t
  modified_base (138)..(138): a, c, t, g, unknown or other
  misc_feature (138)..(138): n is a, c, g, or t
  modified_base (156)..(156): a, c, t, g, unknown or other
  misc_feature (156)..(156): n is a, c, g, or t
  modified_base (164)..(164): a, c, t, g, unknown or other
  misc_feature (164)..(164): n is a, c, g, or t
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (477)..(477): a, c, t, g, unknown or other
  misc_feature (477)..(477): n is a, c, g, or t
tcagagctcacgtacacgaccggtgctcgatttagtacacacacttagggattgggggaggaactgctcagttaggacccagagggaaccatggaagccccagctcagctttctcttcctcnnctctcgcgccnccanacaccgacgagtagtttnttagacanctcacncaccctctgttcttcgtcacggaagggaanccgccctacctcctcgcgacggacggtctagtacgaggtagttgtacacgtactactttacgttacgtcggtaacgaaccgaaaggaaacctaaccggtcgaaccggacgtcccctaccggacgttccctactacgtacgttcgggtaggtactcgaccttaaccgaaccgaacgggccgggcctcggcggacctaccctaccggacgtacgttacggtacgagggtcgacgtggggttcgtcggaggacacgtctacacttcactaactcgtcganaccgtcgtaacgtacgaccgtaacgtaagttaaagttttcgtttacgtaacgttttaacgttttacttcggacgttacgaagtcgtttaaagttaaattaacctaccgggttcggtacccttcggttacccggtcgggaaaccggacgggtacctaaccgggttagtacgggtaaaacgttaaaccgtaaaccggttaggtcggggtaaccgtcctaacgggaacccctaccgttacggtttaccgttacggttttacccctaggtttaacccctttcccggtacccgtaacg

SEQ ID NO: 191942 - DNA, 621 bp, Homo sapiens
  misc_feature: GYAE6OF01CF2AK.47.59.F04.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctccgaggggaaangccaccctctcctgcagggccagtcagagtgttggcagctacttagcctggtaccaanacgaaacctggaccaggcctcccgaggtcctcctcactctatgatgcactccgaacgcgggccacgtcggccactcccagcctaggttcaggtcggcaggtgagtcgtagggactaggtaccttcactctaccaacctatacacgaccacgtacctagacgtaccgtagtaacgttacttttacgactttaacttttacgttactgtacgtacgacgtagtcgtaacgacctaacgtcggtcccttacgttaccgtaccggtttcggggcggtaacgggtacccgtaggggtacggacggtacgtacggaacggtaaccggtaacgttggtacggtcgtacggacctaccgtagttccg

SEQ ID NO: 191943 - DNA, 556 bp, Homo sapiens
  misc_feature: GYAE6OF01CJQM0.47.59.F04.1.454.CMB.1.raw
  modified_base (204)..(204): a, c, t, g, unknown or other
  misc_feature (204)..(204): n is a, c, g, or t
  modified_base (541)..(541): a, c, t, g, unknown or other
  misc_feature (541)..(541): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttgtgttgacacagtctccagccaccctgtctttgtctccgaggggaaangccaccctctcctgcagggccagtcagaatattcactcctacttagcctaggtaccaacagaaacctggtacacggctcccaggcctcctcatctatgatgcatccaacgagggccacgtggcactccccaagacaggttcagtcggctaggtgggtctgggacagacttcactctcacatcagcacgcctagcgctagtaacgtacgtttgacttttatactgtacagcagtcgtgtagttcgtcgcctccgctcgtacgtttccgggacgggtacgggaccgtggggtagagtacgtacgtaaacgtagtcggtcggcgtacgcgtacctacgtnttcgttcttcgtacc

SEQ ID NO: 191944 - DNA, 661 bp, Homo sapiens
  misc_feature: GYAE6OF01CXYW2.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccacctgtctttgtctccaggggaaagngccaccctctcctgcagggtcagtcagagtgttgacagctacttagtctggtaccaagagaaacctggccaggctcccaggcctcctcatcgtgggatggccactccaacgacgggcccgctcggcacgtccccgagcccgaggttccaggtcggactacggtgggtcgtaggggacaggtacctttcgacttccgtccaacccataccgagtaccgacgtacccgtaaggaccgtaccgttaggaacgttacttttcggacttaacgttttacttacctggttaccagtctacggtcgtgtacgtttcgtcggtcccttccgtccgttacgtaccgtttcgggacgggtacgggaaccgtaggggtacggaacgtacgtaaccggtaaaacggtacgttacgggtcggacgtacggacctaaccggttacttcccgttacgttcctttacgtacccg

SEQ ID NO: 191945 - DNA, 587 bp, Homo sapiens
  misc_feature: GYAE6OF01AY0IF.47.59.F04.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaangccaccctctcctgcagggtcagtcagagtgttgacagctacttagtctggtaccaagagaaacctggccggctcccgaggcctcctcatctatgatgcatccgaacgngggccacgtggcactccccgagacgtaggttcaggtggcaggtgggtctggggactagtaccgttcacgttctacgacctatcgagcacgtcctaagacgcctaggaacgttactttgacttaagttttatactagtcaagtacctaaacgtaatcgtcggtccctcgcttctacggtttcgggacgggacgggtaccgagggtcgaactagtacggaaaacgtcgtggtggactcgacctacgtagttctacgttacttacctgttcccgtcccg

SEQ ID NO: 191946 - DNA, 805 bp, Homo sapiens
  misc_feature: GYAE6OF01DJ9PP.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccaccctgtctttgtctccgaaggggaaagagcccaccctctcctgcgagggtcagtcagagtgttgacagcttacgttagtcgtaggtaccaagacgaaacctggaccaggcctacccgaggtcctcctcagttcgtgggactcgactactaccgaaacggcgggcccgcgtcggaccacgttccccgaggtcccgtaggtttccgaggttcggacgtagggttcggggtccgtagggggaacctacggttacctttaccgaaccgtttccctaccgaaacccgtacgttaccgaacggtaccgaacggtacccgttaacggaccggtaccgttaggtaaaacggtttacgtttttacggtaacgtttaacggtttttaactttaaccggttacgttaccgtaacggtaaccgttaaaacggtttaaacgttaccgttcgggtacccgttccgtacccgtttaccggttaccggtttacggggaccggggtaaccggggtaaccggtagggggtacggtaaccgtaacggtaacgggtaaaacggtacggtcgggtacgggtaccgtaccggaccgtaccgtaacgtttccgtacgtttacctttaccgtacccgttcccgttacccccg

SEQ ID NO: 191947 - DNA, 772 bp, Homo sapiens
  misc_feature: GYAE6OF01ENABD.47.59.F04.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (411)..(411): a, c, t, g, unknown or other
  misc_feature (411)..(411): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccgggagaagtttattttgacacagtctccagccaccctgttctttgtctcgaggggaancgcccaccctctcctgcagggtcagtcagagtgtgacngcttatagtctaggtaaccagagaacctggaccaggcctacccgaggcctcctagacttcgtagggattcggacctacgtcccaaacggccggggccctacgtcgggacctaccgtaccccgagtcccgtaagggtttccaagggttcggcgtagggtcggggttacnggggaaccagtacttcacgtctaccaccgtatcgagtccgaacgtccgtaacggacgtaccgtagtaagtttacgttttcggactttaaggttttacttacgttacgttacggtaacgtaacgttaaaccgttaaacgttaccgttaccgggtacccttacccgtaccgtttacccgttaccgggttttacccggggacgggtaaccggggtaacccggtagggggtacggtaaaccggtacggttaaacgggtaaaccggttaccggttgggtacccgggttacggtacgtacccgtaaccccgttagtttacccgtttacggtttacccctttacgtacccgtttccccggttaccccg

SEQ ID NO: 191948 - DNA, 705 bp, Homo sapiens
  misc_feature: GYAE6OF01DDCJC.47.59.F04.1.454.CMB.1.raw
tcagagctcacgtacacgaccggtgctcgatttagtacacacacttaggtattgggggaggaactgctcagttaggacccagacggaaccatggaagccccagcgcagcttctcttcctcctgctactctggcctccagataccactggagaaatagagatgacgcagtctccagcccacctgtctgtgtcctaccgaaggggaaacgcgccctacccttctcctggccgagggccctaagtcgagtaagtattagcaaggtactaacttgcccgtaggtaacccagacaaggaaaaccgtgggacgacggcctaccgaggtcctacctactactacctagtagtacgtcgacccgtaccacccggaacggggtcccctaccgtttccgggtttaccccaacggtccgttaaggttccgaaggttcggcgtaggtcggcgtaccgtagggaacctaggttacgttcctaccgtcctaccaaccctacgtacctaaacgtccggtacccgtacgacgtacgttacgtaaggtaaacgtttagttttacgacgtttaagtttttaacttacgtagtacgtagtaacaagtttactaacgtacgtccgactccgtacgtaccggacgtaacggatacgaagtacggaagtaaccgttaaaggacttggacggtctacggaccgtaactagtttctacgtcgttaaccg

SEQ ID NO: 191949 - DNA, 606 bp, Homo sapiens
  misc_feature: GYAE6OF01BSYRZ.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagagaccactggagaaatagtgatgacgcagtctccagcccaccctgtctgtctctccgaggggaanagccaccatctcctgtagggccggtcagagtattagcatcaacttagcctggtaccagcagacgaccgtgggcaggcctcccgaggcctcctcatctatgatcgccgtcccaccgacgggccacgtcggacacgtcccagactacggttcaggtggcgaggtgggtcgtgggacagtacttcactctacaccatcagcacgacctagacgctagtaacgtacgtttaggtaactttacttacttgtacgacgtcgacgtcgtagtacgttcgtcggtcccttccgtccgttaccgtaccggtttcgggacgggtacggggtaccggtaggggtacgggtaagtaacggtaaccgtaaaacgggtacgttgggtacggtacgtacggacctaccgtcgttccg

SEQ ID NO: 191950 - DNA, 676 bp, Homo sapiens
  misc_feature: GYAE6OF01CNH6S.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctccaggcctcctcatcgtgggatgcactccaacgagggccgctggcactcccagccaggttcgagtggctaggtgggtctcggggacacggtacttcgactccgtccaacccgtattccgaagtccacgtaccgtagacgtaccgtaggtaaagtacgttttacgtacgttagttttactttacgttcgtacgtaacgtacgtaaacgtaaacttaccgtacggtaccgttacccgtaccttaccgtaccggttttccgggaccgggtaacgggtaacccggtacggggtacggtacgtaacgtaacggtaaaccggtaacgttcgggtacggtacgtccggaccgtacccgtacttaccgttcgttaccttaccgttcccgttcccgttacccccgg

SEQ ID NO: 191951 - DNA, 622 bp, Homo sapiens
  misc_feature: GYAE6OF01AZJ8P.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtcctccgaggggaaanacgccacccctctcctgcagggtcagtcagagtgttgacagctacttagtctggtaccaagagaacctggccaggcctccgaggcctcctcatctatgatgacatccaacgagggccacgtcggaccactccccaagtacgacgggtttcagggttcggcgtaaggttcggggtacgtggggaccaggtaccttcaccgtcctaccacctatcagcacgcctagcgtactaggtaagtaccgtttaggtaacttttacgttacgttgttacgacgtcgacggtcgtagtcgtttcgtcggtacccttccgtccttccgttaccggtttccgggcgggtacgggaccggtggggtacgagaagtaccgaaacggtacgtggtcgacgtcgaccgtacctatcgttcgttcttcgtacg

SEQ ID NO: 191952 - DNA, 576 bp, Homo sapiens
  misc_feature: GYAE6OF01C330J.47.59.F04.1.454.CMB.1.raw
  modified_base (205)..(205): a, c, t, g, unknown or other
  misc_feature (205)..(205): n is a, c, g, or t
  modified_base (381)..(381): a, c, t, g, unknown or other
  misc_feature (381)..(381): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagatacccaccggagaagttattttgacacagtctccagccaccctgtctttgtctccaggggaaagngccaccctctcctgcagggccagtcagaatattcactcctacttagcctggtaaccaacagaaacctggtcaggcctcccgaggcctcctcatctatgatgcataccaacgacgggccacgtggcactcccagacaggttcaggtggcaggtgggtctgggacagtacttcactcncacatcagcagcctagacgccgtaggaacgttacgtttaggtaacttttaactacgttgtcgagcgtagtcgtagcaacgtcgccttctctacggtttcggacgggtacggaccggtgggtaggagagtacgacggacgtaacgtggtacggtcgtacgaccgacctagttcgtacgttccttcgtcgttccccg

SEQ ID NO: 191953 - DNA, 588 bp, Homo sapiens
  misc_feature: GYAE6OF01B4DNW.47.59.F04.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaanagccaccctctcctgcagggtcagtcagagtgttgacngctatagtctggtaccaagagaaacctggccaggcctcccaggcctcctcatcgtgggatgcactccgaacgcgggcccgngtggcactccccgagccctaggttcagtggcaggtggggtctgggacagtactcactctcacatcagcagcctagacgctagaagtatttgacttagtttacttacttgtacacgtactaaacgttaaactacgtcggcccttccggccttcgtaccgtttcgggaccgggtacgggaccggtaggggtggaaccgtagtacggaaaacggacgttggtggctcggacctactacgttcttcgtcttctaccgttccgttccccg

SEQ ID NO: 191954 - DNA, 572 bp, Homo sapiens
  misc_feature: GYAE6OF01BDOLY.47.59.F04.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccaggcctcctcatctgggatgcatccaacgaggggcccgctggcactcccagccaggttcaggtcggcaggtgggtcgtggggacnggacttcacttccncaccatcagcagcctagacgcctagaagtatttgcgtaagttttattactgtacagtacctaacgttaaatacgtcggtccctccgtctcgtaccgtttcgggaccgggtagggaccgaggggtcgactagtacggaaacgtacgtggtaggcgtcgccacgtacgtcgtgttcctctacttcccttacccg

SEQ ID NO: 191955 - DNA, 719 bp, Homo sapiens
  misc_feature: GYAE6OF01DM7MB.47.59.F04.1.454.CMB.1.raw
  modified_base (199)..(199): a, c, t, g, unknown or other
  misc_feature (199)..(199): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttgtgttgacacagtctccagccacctgtcttgtctcgaggggaancgccacctctcctgcaggccagtcagatattcactctacttagcctagtacacagaacctgtacaggctccgaggcctcctcatctatgatcgactactaccaacgacgggaccacgtggacctacgtacccgaagtaccgtaacgggttcaggtcggtacgtagggttcggggtaccgtaggggaacctaacggtacctttaccgaacctttccgtacccaaacctacgtccgaacggtcctacgtacccgtaaggaccgtccgttaacgggtaaacggtttaccgttttaacgggttaacctttttaacgtttaaccgttaggttaccgtaacgtaccgtaggtaccggttaggttaccggtttccgtccgggtccccttaccgtccgttaccgttaccgggtttccggggacgggtacggggaaccggttaggggtacggaacgtacgtaacgtaaaccggtagttcgggtacgtacgtccgaccgtaccgtacttccgttcgttccttccgtaccg

SEQ ID NO: 191956 - DNA, 813 bp, Homo sapiens
  misc_feature: GYAE6OF01CREV6.47.59.F04.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (706)..(706): a, c, t, g, unknown or other
  misc_feature (706)..(706): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctccagataccacggagtaagttatttgacacagtctcagccacctgttctttgtctaccgaaggggaaanacgcccaccctctccgtgcgagggtcagtcagtgtgtgacagctacttagctaggtacaagacgaacctggtacaggtctccgaggtcctcctanaatctagtgatcgactactacccgaacggacggccctaagtggacctactacccgaagacgtaggtacaggtcggtacgtagggtcgggtacgtcggggaactaacggtacccttcgaaccgtttaccgtaccaaaccgtattacccggaagggtaccctaacgggtaacccgttagggacccggtaaccggttaaacgggtaaaccgttttaccggttttaacgggttaaacctttttaacggttaccgttacgggttaaccgtaacgggtaccctaacggggttcgggtttaacggttaaccggttttcccgggtaacccgtcccgttcccggttaaccgttaccggttaccgggtttacccggggaacggggttaccgggggaaccgggtttaacggggggtanaaacggggttaaccctaaacggaaaccgggtttacgtcgggggttacctccgggtaaccgtaccgtaacccttaggttaccgtttcgtcccgtttaccgtaaccccg

SEQ ID NO: 191957 - DNA, 589 bp, Homo sapiens
  misc_feature: GYAE6OF01BFC2F.47.59.F04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgctccaggggaaangccaccctntcctgcagggtcagtcagagtgttgacngctacttagctggtaccaagagaaacctggccaggcctccaggctcctnatctgggatgcatccaanagggccnctggcatcccagccaggttcagtcgcagtgggctgggacagacttcactctcaccntcancagcctagacgcctagaagtatttagctagttttactactcgtacgaagtcaaacgttaatcgtcgtcctccgacttccgaacgtttccgggacggtacgggacccgtaggggttacggaacctagtaacggtaaaaccgtaccggttggtacggtacttacggacccaacccgtaagttcccgttacggttacttcctacgttcccgttaccccg

SEQ ID NO: 191958 - DNA, 641 bp, Homo sapiens
  misc_feature: GYAE6OF01B86NZ.47.59.F04.1.454.CMB.1.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagagctcacgtacacgaccggtgctcgatttagtacacacacttagggattgggggaggaactgctcagttaggacccagacggaaccatggaagccccagcgcagcttctcttcctcctgctactctggctcccagataccatcggagaagttgtgttgacacagtctccagccaccctgtctttgctccgaggggaaancgccaccctctcctgcagggccagtcagaatatcactctatagcctgaccaanagtaacctggcaggctccaggctcctcatctangatgcactccaacgngggaccacgtggcactccccgaagtactacggttcaggtggctaggtggggtctaggggacaggtactttcgaccttctaccaactactcgaacgccagcctaagcgcctagaacgttactttacggtacttttacttacgtacgtactacggactagtcggttaggtacgtttccggtacggtccccgtccggtaccttaccggtaccgtttaccggggacgggtacggggtacccgtaggggggtaggtaacggtacgtaaccgtaaaaaccggttacgtcgggtacggtaccgtacgtacccgtaaccgttagttccgttcgtttccttacccg

SEQ ID NO: 191959 - DNA, 718 bp, Homo sapiens
  misc_feature: GYAE6OF01CPCVQ.47.59.F04.1.454.CMB.1.raw
  modified_base (207)..(207): a, c, t, g, unknown or other
  misc_feature (207)..(207): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagagctcacgtacacgaccggtgctcgatttagtacacacacttagggattgggggaggaactgctcagttaggacccagacggaaccatggaagccccagcgcagcttctcttcctcctgctactctggcctcccagataccatcggagaagttgtgttgacacagtctccagcccaccctgttctttgtctccgaggggaaancgccaccctctcctgcagggccagtcagaatattcactcctacttacgcctgtaccaagagaaacctggaccaggcctcccgagcctccncactctangatgcactaccaacgcggaccactcggccactaccccgagaccgtaggtcaggtggacgtagggttggggtcgtaggggacctaggtacctttaccgacttccgtaccacctacgtacgacgccgaacgtcccgtaaggtaccgacccgttaaggtaacgtttaccgttttaggttaacccttttttaacgttacgttcggtaacgtacggtcgtaacggtcgttacgggtacgtttccgtacgggtcccccttaccggtcctttaccggttacccggtttaccgggggaccggtaacgggggtacccggtaagggggttacgggaaaccgtacgtaaaccggaaaccggttaacggtcgggtaccggtctaccggtaccctaacgttattaccggttcgttccgttaacccg

SEQ ID NO: 191960 - DNA, 571 bp, Homo sapiens
  misc_feature: GYAE6OF01B3590.47.59.F04.1.454.CMB.1.raw
  modified_base (563)..(563): a, c, t, g, unknown or other
  misc_feature (563)..(563): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaagagccaccctctccgtgcgagggccagtcagaatattcactcctacttagcctggtaccaacagaaacctggtacaggcctcccgaggcctcctcatctatgatgcactaccaacgacgggccacgtcggcactcccgaagacgaggttcaggtggctaggtggtctgggactagaccttcgactctacacctatcagcagctagactcgtagtaagtctttaggtactttatactgtacagcgtagtcgtgtacgttcgtcgccctcgtcctcgtacgttcgggacggtacgggacgtagggtggacgtagtaccgaaacgtacgtggtcggctcgtacactacgtctagttcttccgngttccccg

SEQ ID NO: 191961 - DNA, 856 bp, Homo sapiens
  misc_feature: GYAE6OF01C6BTT.47.59.F04.1.454.CMB.1.raw
  modified_base (208)..(208): a, c, t, g, unknown or other
  misc_feature (208)..(208): n is a, c, g, or t
  modified_base (568)..(568): a, c, t, g, unknown or other
  misc_feature (568)..(568): n is a, c, g, or t
  modified_base (818)..(818): a, c, t, g, unknown or other
  misc_feature (818)..(818): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctccagataccatcggagtaagttgtgttgacacagtctccagccacccttgttcttgtcctcgaaggggaaacncgccctaccctctcctcgcgaggggccaaggtcaagtaattacttaccaccttaccttacgtttacgcccgttaaggtaacccaaacgtaacggtaaaacccgttggggttaccaacggggtcccttaccccgaagggtcccttccgtaactacgttcttaagtcggtaacttcgaccaactaacccgaaacggtccggggccctaaccggttcgggacctaaccggttcccccaaagggtaacccgttagggttccctaggggtaccggccgttaaggggttcggggttacggtacggggtacctaacgggtcccttttaccgacccgtttaccactaaacccgtagtaaccgggaacnccgtaacgtacccgaaggtaccgtacgtaggtaaaccgttacggttttacggttaacgtttaactttacgtcgtacgtacgtccgtacgggtacgttacggttcggttaccgtaccggttccccgtacccgggttacgttacccggtttaccgggttttacccggggaccggggtaaacgggaaccgggttagggggtaccggtaagtaacccgtaaaccgggtaaacgggttaacgtgggttacccggnttacccggacctacgtacttccgttcgttccgtaccgg

SEQ ID NO: 191962 - DNA, 621 bp, Homo sapiens
  misc_feature: GYAE6OF01A562F.47.59.F04.1.454.CMB.1.raw
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
  modified_base (570)..(570): a, c, t, g, unknown or other
  misc_feature (570)..(570): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagngccaccctctcctgcgagggtcagtcagagtgttgacagctacttagtctaggtaccaagagaaaccgtggccaggcctacccgaggcctcctcatcgtgggatgcatcccgaacgacgggcccgcgtggccactccccgacgccgtagggttcaggtcggacaggtggggtcgnggggacaggtaccttcactctccaccatcgagccagaccgtagacgtccgtagagttatttcgacgttagtttattacgttgtacagtacgtaaacgttaactcgtacgtcccgtccgtactccgtaccgtttcgggacgggtacgggaccgtaggggtacgacgtaagtacggtaaacgtacggttcggnggaccgtcgaccgaccgtacgttctcgttacttctcgttcccgttaccccg

SEQ ID NO: 191963 - DNA, 972 bp, Homo sapiens
  misc_feature: GYAE6OF01DLOMT.47.59.F04.1.454.CMB.1.raw
  modified_base (207)..(207): a, c, t, g, unknown or other
  misc_feature (207)..(207): n is a, c, g, or t
  modified_base (551)..(551): a, c, t, g, unknown or other
  misc_feature (551)..(551): n is a, c, g, or t
  modified_base (618)..(618): a, c, t, g, unknown or other
  misc_feature (618)..(618): n is a, c, g, or t
tcagagctcacgtacacgaccggtgctcgatttagtacacacacttagggattgggggaggaactgctcagttaggacccagagggaaccatggaagccccagctcagcttctcttcctctgctactctggcctccagataccgaccggagtaagtttatttgacacagtctccacgccaccttgtctttgcctacgaaggggaaancgcctaccctctcgtgcgaggtcagtcgaggattgttacgacagtacttacgtttaggtccgttacgggtaaaccaaaggaaccgtaaacccggtccgggaaccgtaacgggccccttacccggaacgggtcccttacccgtacgtaacggttcccggttaaggggacgtttaccggacctaaaccggtaccccgtaaaacggggccgggtcccccggtacgttacgggaccctaaccggtcccccgaaacggtccgttaacgggtttaacgcggtcggaccggtaggtttacgggtcgtaggggactaacgttccttaccgtaccttccgaaccaccgttaanccggaaacgccgtaaccgtaccttaagggacctaccggttaagttaagggtttacttttaaccgggnttttaaacgtttttaccgttaacgttacggttaaccgaaacggtttaaacccggaaaacgttttaaaccggttaccgtacccgggtacccccgtttcccggtaacccgtttaacccggtttaccggggtttaacccggggggaaccgggggtttaacgggtaaaccccggggtcggggggttaaaacgttaacccggtaagggttaaaaacccgggtaaaccccgggttaacggtttaccgggttaccggggtaacccttaccgggggtaccctaaacccgttttaccgttacccgggttttccctttaccccgttttaccgttacccccggtttaacccctttcccccccggg

SEQ ID NO: 191964 - DNA, 713 bp, Homo sapiens
  misc_feature: GYAE6OF01ASEJ0.47.59.F04.1.454.CMB.1.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
tcagagctcacgtacacgaccggtgctcgatttagtacacacacttagggagttgggggaggaactgctcagttaggacccagagggaaccatggaacgccccagctcagcttctcttcctcctgctactctggctcccagactaccgaccggagtaagtttattttgacactagtcctccgagcctacctgttctttgctaccgaggggaanacgccctacctctcctgcgaggtcngtcaggtagtgttcgacgtagtacttacgttacgtcgtacggtaaccgaaggaacgaaccgtcggaccgacgggtccctaccgaggtcctaccgtatacgtccggtagggtactcgacctaacgtaccgaacggacgggccgtcgtcgacctaccgtccgacgtccgtaggttcgaggtcgtacgtaggtcgggacgtagggaactcggtacctctacctctacacctacgtccagccgtacgactagccgtacgtagtaccgttagttacggttaactttacgttacgtctacgtcgcgtacgtcgtaagttcgttcgcgtccgtccgtctacggttcggtcgggacgggtaccggtacggtacggtacggtaacggtactaaaccgggtaagttaccggtggtaccggtcgtaccgtaacccgttacggttacgtttctacccggtttaacttcccgtaaccggtttcccccg

SEQ ID NO: 191965 - DNA, 635 bp, Homo sapiens
  misc_feature: GYAE6OF01DVBR7.47.59.F04.1.454.CMB.1.raw
  modified_base (205)..(205): a, c, t, g, unknown or other
  misc_feature (205)..(205): n is a, c, g, or t
  modified_base (542)..(542): a, c, t, g, unknown or other
  misc_feature (542)..(542): n is a, c, g, or t
  modified_base (599)..(599): a, c, t, g, unknown or other
  misc_feature (599)..(599): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccgacggagaagttgtgttgacacagtctccagcccaccctgtctttgtctccgaggggaaancgcccaccctctcctgcacgggccagccagacttagttaactcaacttactacgcctaggtaccagaccaactaaaccgtggaccaggtccctcccgaggcctcctactatcgtagtcggactacacgtaccgaggccgacgggcccaggtcgacctactacccgaagaccgtcgttcgaaggtcgaccgtaggttcgggtccgtagggactacgtaccttcacctcgtaccacactcgacgacgacgtacgtaggacgtacgtagtaacgttatttcgacgttagttagttacttacgtgtaccgtagtcgtagtagtacggaccgtcctaccctnttccgttaccgttccgaccgtacgggaaccgtaggtgtactacggtaactaaaccgngttggtacgctacgcctactacttctcgttcctacg

SEQ ID NO: 191966 - DNA, 579 bp, Homo sapiens
  misc_feature: GYAE6OF01CHSNW.47.59.F04.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (414)..(414): a, c, t, g, unknown or other
  misc_feature (414)..(414): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaancgcccaccctctcctgcagggccagtcagagtgttggcagctacttgcctggtaccaacagaaacctggccaggcctcccaggcctcctcatctatgatgcatccaacgngggccacgtggcactcccagcctaggttcaggtcggcagtcgcgtcgtgggacagagttcnctctcactatacaacncgcctnctagtcgtagtaagttntttgattagtttattactgtacagtactagtactactaacgtacgtcggcctactaccgtaccgttccggaccgaacgggtaccacgtacggtacggaaacgtaacgttaaacggacgttcggtacggtaccgtacgacctaccgtattccgttcgttcttaccg

SEQ ID NO: 191967 - DNA, 592 bp, Homo sapiens
  misc_feature: GYAE6OF01CJ9NN.47.59.F04.1.454.CMB.1.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggcctccaggcctcctcatctgggatgcatccaagacgggccnctggccatccccgagcccaggttcaggtcggcaggtcgggtctggggacagtacctttcaccgtctaccaactatccgaagtcacgacctagacgccgtagtaacgttattttgacttaacttttacttacgttgtacagacaggtcgtagacctaacgtcggtccttctacgtacgttcgggacggacgggtaccgagggtcggagacgtacgacggtaacgtacgtggtcggcctaggcctaccgtagttaccgttcgttccttcgtacccg

SEQ ID NO: 191968 - DNA, 800 bp, Homo sapiens
  misc_feature: GYAE6OF01EZ9PH.47.59.F04.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctcccagataccaccggagaagtttattttgacacagtctccagccaccttgtctttgctcgaggggaanagccaccctntcctgcgagggtcagtcaggagtgttagacagtactacgttagtctaggtaaccaaggaacgtaaccgtgggcccgggccttacccgaggtcctacctcacgttacgtcggggatcggaccacgttacccgaaccggacggggtcccgtcgtacgggccctaaccgtaccccgaaggtaccccggttaaggtttccgaacgggttcggacgtaggggtcgggttacgtaggggacctacgtacttccgacgttccctacgaaccagtccgagtaccgaacgtccctaaggaccgtacccgttaaggtaaacgtttcgttttacgtaaccttttaacgtttttaacgttaccgtttacggtaactcgggtacctagggttaaccgtaacgtacccttaaccgggttccgtacccgttaccttacccgggttaacccgggtttacggggaccgggggttaaacggacccgggttagggggtaccgagtaaccgttacggaaaggtaaccggtacgtttggggctaaccgttcggaacccttaaccggttactttccgaccggttttccaaccgtttcccttacccccgg

SEQ ID NO: 191969 - DNA, 755 bp, Homo sapiens
  misc_feature: GYAE6OF01E3I1E.47.59.F04.1.454.CMB.1.raw
  modified_base (209)..(209): a, c, t, g, unknown or other
  misc_feature (209)..(209): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctcccagataccaccggagaagttattttgacacagtcctccagcccaccctgttctttgtctccgaaggggaaanagcccaccctctcctgcagggtcagtcagagttgttgacagtcttacttagtcgtacggtaaccaagaacgaaaccgtggaccaggcctacccgacggtcctcctacacgtcggtgggtactcggccgtacccgaccggacgggtaccctacggtttccggtttacccgacggtcccgtaggtttccgaggtcggacgtaggtcggccggttacggtcggggaactacgggtacttccgtaccttccgacctactaactaccaaacgtccgtcctacgaccgtagtacgttagtaacggtttcttttacgtacgtttaagtttttactacgttcgtacgtagtaccgtaagttactactaaacggttaccgtcgtcccgtaccttacccgtacccggttaccgggaaccgtaacgggaccctacggtacgtaacggtaaacgtaaaccgttaaaccggcgtttacggggtcgtacccgtacgaccctaaacccgttgtttacccgttcgttaccctttaacggtcccctttcccgtccccgtaacc

SEQ ID NO: 191970 - DNA, 636 bp, Homo sapiens
  misc_feature: GYAE6OF01DF710.47.59.F04.1.454.CMB.1.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
  modified_base (428)..(428): a, c, t, g, unknown or other
  misc_feature (428)..(428): n is a, c, g, or t
  modified_base (608)..(608): a, c, t, g, unknown or other
  misc_feature (608)..(608): n is a, c, g, or t
  modified_base (620)..(620): a, c, t, g, unknown or other
  misc_feature (620)..(620): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaangcccacctctcctgcagggtcagtcagagtgtgacagcttacttagtctaggtaccaagagaaacctggaccaggcctcccgaggtctcctcatcgtgggatgacataccaacgngggcccacgtggaccactccccgaggacctagggttaccagggttggacctaggtcggtcgttacgtaggggactaagggtattcctacgccttacacctaatccaaacncgccgtcgctacgtctaggtaaagttacttttaggacttaaggttttacttacgttgtacgtagtacgttaagtacttaaccagttaacgtcggtaccctccgtacctacccgtttacggacccgtagggaaccacggaacgtacgggaagtaacgtaaacggtacgtaggtcgtacgtnaccctactactnttacgtcttctaaccg

SEQ ID NO: 191971 - DNA, 745 bp, Homo sapiens
  misc_feature: GYAE6OF01BFRKR.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctccgaggggaanagccaccctctcctgcagggccagtcagaatattcactcctacttagcctggtaccaacagaaacctggtacaggcctcccgaggcctcctcatctatgatgccataccaacggacgggcccacgtggccactccccgagaaccgtaggttcaggtcggcgtaggttcgggtcgaggggaactacggtactttacaccgttcctaccgaaccctagttccgacggacctaaccggcccttaacggacggtacccgttaagggaaaccgtttacgttttacgggtaacctttttacgttaaccgttggttacctaggccgtaaggttccgggttacgggttacggtttccgtccgggttccccgttcccggttacccttacggttacccggtttccgggggaaccgggtaacgggggtacccgtaaggggggtacgggtaacggtaaccggttaaacccggtaaaacggtaccgggttcggggtccgggtacgttccgggacccgttaaccgtagtttcccggtttcggttccctttaacccg

SEQ ID NO: 191972 - DNA, 594 bp, Homo sapiens
  misc_feature: GYAE6OF01EDW5W.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaangccaccctctcctgcagggtcagtcagagtgttgacagctacttagtctggtaccaagacgaaacctggaccaggcctcccgaggcctcctcatcgtgggatcgcactcccaacgcggggcccgcgtggcactcccagccaggttcaggtggcgtaggtcggggtcgtggggacaggtaccttcgacctctcaccatcagcgacgcctagacgccgtagtaagttatttgacttagtttacttacttgtacagtacgtaaactaactacgtcgcctccgtctcgtacgtttcggcggacgggaccgagggtacgacgtagtacggaaacgtacggtggtggacgtcgacccaccgtacgttccgtgttccttctacttcccgttaccccg

SEQ ID NO: 191973 - DNA, 815 bp, Homo sapiens
  misc_feature: GYAE6OF01B3SH5.47.59.F04.1.454.CMB.1.raw
tcagagctcacgtacacgaccggtgctcgatttagtacacacacttagggattgggggaggaactgctcagttaggacccagagggaaccatggaagcccagctcagcttctcttcctcctgctactctggcctccagataccatcggagaagttgtgttgacacacgtctccagccctaccctgttcctttgtcctaccggaagggggaaacgcgcccaccccttctccgtgccgaggggaccaggtacaagtaatacttaccaccttccttacttacgccttagggtaacccaaacgtaacggtaaaccgtcgggtaccgacgggtccctacccggacgggtcccttaccctactacttaccttagtacgtacgtcgtaacccacgttaacccgaaaccggacggggtaccctaacggccgggacctaacctcccgaaggttaaccgtacgggttaccgtagggttcggaccggtagggggtttcggggtccggtacgggaaccgtaacggttaccttaccgtaccgtttaccacctaaacccgtacttaccgggacgtaccgaacggtaccgggtacggggtaaccggttaccgtaaggttaacgttaacgtttttaggaacgttaacggttaacttaaccgttaccgtacgttaacggacgtaggttaacgtaggttacggtacggaactaccggtagtaccgggtacgtaccgggacggtaacgggaccgtaagggtaccggtaagacggaacgtacgacggttggacggaccgtcggtacccttacgttcgtacttcgttccgtacccg

SEQ ID NO: 191974 - DNA, 714 bp, Homo sapiens
  misc_feature: GYAE6OF01AET1E.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaanagccaccctctcctgcagggtcagtcagagtgttgacagcttacttagtcgtaggtaccaagacgaaacctggccaggcctcccgaggcctccgtcatctatgatcgacactcccaacgacgggtccacgtggaccactccccgagtccgtaacggttcgaggtcggactaggtcgaggtccgtagggaacacgtacttaccgactccgtaccacctacgtcacgaccacgccgttagacgtaccgtagttaacgttacgttttaccgtacttaaccgttttattaccgttcgttaccgacgtactagggtacgttaacggtaccgtaaccgtcggtacccctttaccggttaccgttaaccgggtttacccggggaacggggtaacccggggtaaccgggtacggggggtacgggtaacgtacgggtaaacccggagggttaacccggtacgggtcggttacgggtacccgtacgggaccctaacgtcgttccgtttccggtttacccc

SEQ ID NO: 191975 - DNA, 741 bp, Homo sapiens
  misc_feature: GYAE6OF01DZZEQ.47.59.F04.1.454.CMB.1.raw
  modified_base (388)..(388): a, c, t, g, unknown or other
  misc_feature (388)..(388): n is a, c, g, or t
tcagagctcacgtacacgaccggtgctcgatttagtacacacacttagggattgggggaggaactgctcagttaggacccagagggaaccatggaacgccccagctcagcttctcttcctcctgctactctggcctccagactaccgacggagtaagtttatttgacacagtctccacgccacctgttctttgtcctacgaaggggaagacgcccaccctctccgtgacgagggtcagtcaggtagttgttacgacgtacgtacttacgttaggttccgttagggtaaaccaaaggtaacggaaaccgttcgggaccgtaacggtccctaccgacggtcctaccgtacagtcgtagggactcgactactacgaacggcggccgtccgngcctacctaccgaacggtaccgtaacggttacgaggtcggtacgtacgggttcggtacggtacgggaacttacgtaccgttacctaccgttaccaccgtactacgtaaccgacgtaccgaaccgtaccgtaacgtacggtaccgttaaggttaaacggtttcttttaacggacttttaaacgttttcgttaacgttcgtacgtacgacgttacgtacgtacgtactacgtcgttacctacgttacgttacgggttccgggacgggtacgggacggttagggacgaacggtgtacgacgtaacggtacgttggaccggtctacggacctattacgtcgttacgttctccgtccg

SEQ ID NO: 191976 - DNA, 629 bp, Homo sapiens
  misc_feature: GYAE6OF01EHEW2.47.59.F04.1.454.CMB.1.raw
  modified_base (201)..(201): a, c, t, g, unknown or other
  misc_feature (201)..(201): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccacctgtctttgctccgaggggaangccacctctcctgcagggtcagtcagagtgtgacagctacttagtctggtaaccaagagaacctggccaggctcccaggctcctcatcgtgggatgacgtactccgaacgcggggccgcgtggccacgtccccgagacccgtaggttaccgaggtcggcgtaggtcgggtctaggggacagtacttcgacttctaccaacctagtaccacgtcgacgccgtaacggacgtaccgtaggaacgttacgttttacggtaacttttagttaaccttgttacacggtctacggtcggttgttacgttcgcggtccctccgtcttccgtacgtttccgggacggtacgggacgtaggggtaggaagacgtaacgaaacggtcgtggtacggcgtcgtaccacgtagttaccgtgtttaccttcgtcttccccg

SEQ ID NO: 191977 - DNA, 944 bp, Homo sapiens
  misc_feature: GYAE6OF01B4VZO.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacatttgttttgacacagtctccagccaccctgttctttgtctccgaaggggaaagacgccaccctctcctgcgaggtcagtcagagtgttgacagcttacttgtctggtaaccaagagaaaccgtggaccaggtcctcccgaggtcctccctactagtccggtaggggatcggacctaaccgtacccgaaacggaccgggggtcccggaccgttacggggacctaaccgtacccccgaacgggttccccgtaagggtttaccctaagggtacggggtacgtaacgggggttcggggttaccggtacggggggaacctaacggttaaccctttccggaaacccttcccgttacccgtaaacccgtaaccgttaccggaacggacccggtaaccgggtaaccccgttaaacggggacccggtaccccgttaaagggttaaacggtttaacgttttttacgggtaaccttttaaacgggtttttaacttttaaccgttacggtacccggttaaagtaaaccccgttaaaacggtttaaaaccgttaccgggttaccggtacccccgttacccggggtacccttttacccgggttaaccgggttttaccccggggggaaccggggttaacccggggggtaacccggtaaacggggggtttaccggaaacgttaaacggtaaaaccgggtaaaacccggtaacggttacgggggtacggttccgtaccgtaacccggtaacctacggtttccggtttaacccggttccgttttaccgttaaccccgtttcccccggg

SEQ ID NO: 191978 - DNA, 661 bp, Homo sapiens
  misc_feature: GYAE6OF01APS5X.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacattgttttgacacagtctccagccaccctgtctttgtctcgaggggaagngccaccctctcctgcagggccagtcagagtgttggcagctacttagcctggtaccaacacgaaacctggaccaggcctcccgaggcctcctcatctatgatgacactccaacgacgggccacgtggacctactccccgagtccgtacggttcaggtcggacaggtgacgtacgtgggacacgtcgttacacctctacgacctatacgacgactcgacctaggcgtctagtaacgttgtttacgacttaacttttattacgtgttacgacggtactacggacgtttaacaccgttaaccgtcgggttaccccttacggtttaccgtaaccgggttttcccggggaaccggggtaaggggtccccggtaagggggttacggtaacggtacgttacggaacggtacggtaaccggttgggaccggttcgtaccggtaccctaacggtccgtttcgttaccg

SEQ ID NO: 191979 - DNA, 805 bp, Homo sapiens
  misc_feature: GYAE6OF01CKZ5D.47.59.F04.1.454.CMB.1.raw
  modified_base (273)..(273): a, c, t, g, unknown or other
  misc_feature (273)..(273): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctccagatacccgacggagtaagtttatttacgacactagtcctccgacgccctaccgttgttcctttcgtcctaccggaaggggaaacaccgaccctacccttcgtccgtagcggtagggtcagtacaggtagttgtanacgtagtacttacgttagtcgtacggaacaagaacgtaaccgtggaccgacggacctaccgacggtccctccgtacgtacgttcggtacggtattaccgactaacgtaaccgacggaccgggtccacgttggacctaaccgtacccggaagtccgtacgggttacgaggtcgggtacgttagggttccggggtaacgtacgggaaccgtaacggtaccctttaccgtaaccgtccgtaaccaaccgtacgtacgaacgacgtaccgtaaccgtaacggtacgttaccgttaagttacgtttacgttttacgacggttttaaactttacgttacgtacgtaacgaacgttaaccgtaaacgtaacgttcgtaccggtacccttactacgttacccgtacggttacggggaaccggacgggtaccggtagggtaaccctaaggaacgttaacgggtaaacgtacggtaggtaccccgtaagcgtaaccgtaacttcggttaccttagtcccttaagtcccttccccgtaaccgg

SEQ ID NO: 191980 - DNA, 915 bp, Homo sapiens
  misc_feature: GYAE6OF01BKEXM.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagactaccaccggagaagtttattttgacacagtctccagccaccctgtctttgtctccgaagggaangccaccctctcctgcgagggtcagtcagtagtgttgacagtcttacgttagtcgtaggtaaccaagacgaaacctggaccgaggcctacccgaggtcctcctacagttccgtagggtactcgacaccgtacccgaacggacggggtcccgacggttcggacctaaccgttacccccgaacggtacccggttaacgggttttaccgaacggggttcgggtaccggtaacggggtttcgggggtttaccgtacggggggaaacccttaccgggttaacccgttttccaaccgtttaccccttacccggaaaccctacgttacccggaaacggaccgttaaccggtaccgttaacggaccggtacccgtttaagggtaaaacgttttacgttttacggaaccttttaacgggtttttaaacgtttaccgtttacggtaaccgtaacggtaaaccggttaaaccgtttaaaaccgttaccggttcccgggtaccccttaacccgggttaccttacccggttacccgggtttacccgggggaacccgggttaacccgggggtaaccgggttaacggggttaacggaaccgttaacggttaaaccgggtaaaccggttacgggttacggtaccgggttaccgtacggtaaccccggtaccttacggttaccgttaccgtttcgtttaacccgttaccgtttcccccgttaaccccg

SEQ ID NO: 191981 - DNA, 626 bp, Homo sapiens
  misc_feature: GYAE6OF01A9GY3.47.59.F04.1.454.CMB.1.raw
  modified_base (202)..(202): a, c, t, g, unknown or other
  misc_feature (202)..(202): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttgtgttgacacagtctccagccacctgtctttgtctccaggggaaangcccaccctctcctgcagggccagtcagaatatcactcctacttagcctaggtaccaacagaaacctggtacaggctacccaggctcctcatctatgatgcatccaacgcggccacgtcggcactcccagactacggttcaggtcggactaggtgggtctgggacaggtaccttcaccttctaccaacctattaccgagaccgaaccgcctaacggacgtcccgtaaggtaaacgttccgtttaaggttaacctttttaatttaaccctagttaccaggtacacggtacgttggtacgttcgttcggtaccctccgtctaccgttacgtttcgggacggtacgggaccgtagggtcggtagacgtaacgtaaaccggtagtcggtcggacttaggacctactacttactgttccttacgtaccg

SEQ ID NO: 191982 - DNA, 782 bp, Homo sapiens
  misc_feature: GYAE6OF01B0GX6.47.59.F04.1.454.CMB.1.raw
tcagagctcacgtacacgaccggtgctcgatttagtacacacacttagggattggggggaggaactgctcagttaggacccagagggaaccatggaagccccagctcagcttctcttcctcctgctactctggctccagataccagtcggagaagttgtgttgacacagtcctccacgccaccctgttctttcgtctaccgaaggggaaacgacgccctacccgtctccgtggcgacgggcctagtacaagtaacttacttaccacctttacctacttacgacccgttacggtaaacccaacgaacgaaacccgtcggacccgaacggtccctacccgacggcccttcctacgacttctactgtacgtcgaccttaccaacccgaacggccgggtaccacgtacggcctaacccgtccggaacgtccgtacgggttcacgggtcggacgtacggtacggtcggtacggtacgggaacctacgttaccgtaccaccgtttaccaaccctacgtaccgttaccgaacgaccggtacgtaaccggtacggtactaacccggttaagggttaactttacgttttaccgtaccttttaacttttaccgttacggtacgtacggtacgtaacggtcgttaacggtaccgtacgttaccggtccgtaaccttccggttacgtccgggtacgggaccgggtaacgggtcggtacggggtagaacgtcggtaacgacgggttacgtaggtaccgggtacgttcacccggtaccacgttgttcccggttacc

SEQ ID NO: 191983 - DNA, 702 bp, Homo sapiens
  misc_feature: GYAE6OF01D1FIU.47.59.F04.1.454.CMB.1.raw
  modified_base (151)..(151): a, c, t, g, unknown or other
  misc_feature (151)..(151): n is a, c, g, or t
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
  modified_base (660)..(660): a, c, t, g, unknown or other
  misc_feature (660)..(660): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagattccgaccgganactatttgttttgactacagtctccagcctaccctgtctttgctccgaggggaaancgcccaccctctccgtgcacgggccagtcaaggtagtgttggacngtctacttacgccgtaggtaccaacgagtaaaccgtggtacgacgcctacccgaggtcctcctcacgttcgtagggtactcgcctaacgtacccgaaacggcggggtcccacgtcggacctacgtcccgaacgtcccggtacggtcgtaggtcggtcgtaggttcgggacgtgggaactacggtccttacgacttacctccgaacctagtaccctaaggacccaacgtcccgtaaggtccgtaccgttagtaaacgtttagtttacgtactttaacgttttacttacgttataccgtaacgtaaccgttaaacgttaactacggtcgaccttacgtacctaccggttacgttaccgggcgggtacgggaccgtagggtcgaacgtagtaacgaaacggtctacgggtntccgtcgtaactcgttaactcgttacctcttcgttactcccg

SEQ ID NO: 191984 - DNA, 755 bp, Homo sapiens
  misc_feature: GYAE6OF01DMWXI.47.59.F04.1.454.CMB.1.raw
  modified_base (157)..(157): a, c, t, g, unknown or other
  misc_feature (157)..(157): n is a, c, g, or t
  modified_base (177)..(177): a, c, t, g, unknown or other
  misc_feature (177)..(177): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (384)..(384): a, c, t, g, unknown or other
  misc_feature (384)..(384): n is a, c, g, or t
tcagagctcacgtacacgaccggtgctcgatttagtacacacacttagggagttgggggaggaactgctcagttaggacccagagggaaccatggaagccccagctcagtcttctcttcctcctgctactctggcctcccagactacccagtggaanaaatagagatgacgcagtcnccagcccacctgtctgtgtcgtaccggaaggggaacncgccctaccgtctcgngcgacgggccagtcaagtatatacgcacgactaacgttcgccgtacgtaccagacgaacgtaacgtcgggacgacgcccgtccgaggcctcgtaccgtattacgtagttcggcacctaccgtaccgaaccggacgggtcctacgttcggtaccncccgaacgtcgtaacggttcgaggcggtacggtgggtacggtaccggtagggaactaggggttactaccgtacctaccgaccgtaacctacgtaccgaactccgacgggtcgtactcgggttaacgtacggttaagttaaacctttaggttttacaaacctttttaaaggtttacttaacccgggttgtttaacaccggttaacgtaaccgtttaaaattaacccggtaccgttccggtaccgttcggtaacccggttacccggaaacggttacggaaacctacgggaaacggttacggtaaaacggttaaacgttaaccggtacggtggtaacccgttcggaccgtactaacgttctcggttcctaccgg

SEQ ID NO: 191985 - DNA, 774 bp, Homo sapiens
  misc_feature: GYAE6OF01A2VSN.47.59.F04.1.454.CMB.1.raw
  modified_base (213)..(213): a, c, t, g, unknown or other
  misc_feature (213)..(213): n is a, c, g, or t
tcagagctcacgtacacgaccggtgctcgatttagtacacacacttagggagttgggggaggaactgctcagttaggacccagagggaaccatggaagccccagctcagccttctcttcctccgtgctactctggcctcccagactaccgaccggacgaagtttattttgaacacagtcctccagccaccctgtctttcgctccgagggaacncgccacctctccgtgcaggtcagtcagtagtgttgactgcttacttaggtctaggaccaagacgtaacctggacctaaggccttccaggtcctccacgagtcgcgggactcgactacgtacccaagtacgggcctcgtacggaccctacgttacccccgaggtaccccgttaaggggtttaccgacgggttaccgggaccgtaaacgggtttcgggggttaccgttagggggaaccctaagggtaccctttaccgaaccgtttcccgtaacaacccgtaatccgtaacgttaccgaaccgtacccgtaagaccgtaccgtaagtaacgttacgttttacgacgtttaagtttacgttacgtacgttacgaacgttaaccgtaaacgtttaacgtacgtaccgtaccgttacccgtacttaccgtaccggtttaccgggacggtaaccggttaacccggagggtacgaccgtagaaaccggtaaaccgtacggtcggtaggaccgtacgtaacctaccgtaacgtcgttaacgttcccttacgttaccgttccgttaccccg

SEQ ID NO: 191986 - DNA, 793 bp, Homo sapiens
  misc_feature: GYAE6OF01BJMUO.47.59.F04.1.454.CMB.1.raw
  modified_base (204)..(204): a, c, t, g, unknown or other
  misc_feature (204)..(204): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaancgccacctctcctgcgagggtcagtcagagtgtgacagctacttagtctaggtaccaagagaaaccgtgaccaggcctcccgaggcctcctcagtcgtgggatgcctagtccaaacgcggggcccgactcggactacgtccccgagttacgtacggtttcgaacggttcggacgtagggttcggggttaccgtagggggtaacctaggttaacctttcctaaccgttccgttacccaaacccgttattacccggaacgtaccgaacggtacccgttaaggacccggtacccgttaaggttaaacggtttacgtttttacggaaccgtaaggtttacggttaacttttaacgttcggttaacccgtaagtaccgtaagggtttaacgtaccggggtaacttccccgttaaccccgttaattttccccgggttaaccggtttttcccgggaaccccggtttaggggaacccgttaaaggggttccggtaaacgttacggttaaacccggaaaaacggttacggttacggttaccgggacttaccggacctaccgttacgttacgtccgtttacttcgtaaccgtttccccg

SEQ ID NO: 191987 - DNA, 586 bp, Homo sapiens
  misc_feature: GYAE6OF01ERFQY.47.59.F04.1.454.CMB.1.raw
  modified_base (205)..(205): a, c, t, g, unknown or other
  misc_feature (205)..(205): n is a, c, g, or t
  modified_base (288)..(288): a, c, t, g, unknown or other
  misc_feature (288)..(288): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctccgaggggaaagngccaccctctcctgcagggccagtcagaatatcactcctatagcctggaccaacagaacctggtcaggcctcccaggctcctnatctatgatgcactccaacgacgggccaacgtcggaccacgtccccgaagtaccgtagggttcaaggtcggcagggttggggtctggggacaggtaccttcacgtctaccacctatacatcacgtacctagacgccgtagaacgtactttggtaacttttagtacttgtacagcgagtcgtgtacgttcgtcggtccctccgtctcgtaccgttcgggcgggtacgggccgtaggggtcgaagtacgtaacgaaacgacgtgggacggctacggaccgtacctatcgttgtccttacg

SEQ ID NO: 191988 - DNA, 661 bp, Homo sapiens
  misc_feature: GYAE6OF01BI01C.47.59.F04.1.454.CMB.1.raw
  modified_base (590)..(590): a, c, t, g, unknown or other
  misc_feature (590)..(590): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagtttattttgacacagtctccagccaccctgtctttgtcctccgaggggaagacgcccaccctctccgtgcgagggtcagtcgagtagtgttacgacagtccttacttagtcgtaggtaaccaagaacgaaacccgtggaccagggtccctaccccgaaggtccctaccctactactccgtagtgtagttcgacgtactacccgaacggaccgggcctacgtcggaccacgtacccgagtacgtaggttcaggtcggcgtaggtcggtgaggactacgtactccgtactccaccgaacctcgtaccgagacctaccgactaacggcaccgtaagtaacgttcgtttacgttactttacgtcgtgtcgagtcgaggtcgtcgtagttcgtccgccttccgtccgttcgtaccgggttcggaccggggtacggtacggngggtaagcgtaagtaccggaagtcggtggtcgacgtcacgtaccgtacgttacttcgttccgttcgttccg

SEQ ID NO: 191989 - DNA, 891 bp, Homo sapiens
  misc_feature: GYAE6OF01EESL2.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccacggagaagtttattttgacacagtctccagccaccctgtctttgtctccgaggggaangccaccctctcctgcgagggtcagtcgaggtagttgttcgaacaggtcttaacttagtcgttacggtaaccaaggaacgaaacccgtgggcccgaacggtccctacccgacggtccctccgtactagtcgtagggtactcggacgtaactacccggaaggtaccggggtccgacgttcggacctaaccgtaccccgaagtacccgtaggttaccggcggttcggacgttacgggtcgggtcggtaacggggacctaaggtaccctttacggaccttacctacccgtaaccgtaacgtacggaccggtacgtaaccggtacccgttaacgggacccgttaccgtaaaagggttaaccggtttacggttttaacgttaaccgttttaagttacccggttgtaaccgcggttcccggtaacggttcggttaacggtttcccgttacccgggaccggtttcccccgtaacgtttccccggtttaccgggttttaccgggggacccgggggaaccgggttaacgggaacccggggggtttacggtaacgggaaacccctttaaaggggaaaaacccgtttaaacgggggtccgttaccggggttgttaaacccggccccggttaaccgttttaaacgttccgggtttacccgtttacgttaaccccgtttaccgggtccccccgttttacccg

SEQ ID NO: 191990 - DNA, 932 bp, Homo sapiens
  misc_feature: GYAE6OF01D56YC.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccgaccggagaagtttattttgacactagtctccagccacctgtctttgtctcgaagggaaancgccacctctcctgcaggtcagtcagtagtgttgacagtccttacttagtctaggtaaccaaaggacgaaaaccgttgggacctaaggccctacccgaggccttacctcagttcctggggactgacacgtacccaaacgggtacggggccctcgtcgggaccctacgtccccgaagtcccgttagggttacccaaggttcgggaccgtaagggtttccggggtcgtaccggggaactacggttaccttcgtaaccgttcctacccaaccctagttacccaaacggtacctaacgggtaccgttaacggtaacggttaccccgttaagggttaaacggtttaacgttttttaccggaacgttttaaacggtttttaaccgtttaccgtttaccggttaacgtaaccgggtaaccttaaaaccggttaaacgtttaaccggtcccggttaacccgtttacccgggtaacccttttcccggtaaacccggggttttttcccgggggaaccgggggtaaacccggggttaacccgggtaacggggggttaacccgggtaaaccggttaaacggtttaaaaccggggtaaaacccggtttaaaaccggggtaccgggtttaccggggtaacccgtttccgggaaaccccgtaacccggtttaccggttttaaccggtttacccgtttaaccgttttaccccgttacgttttaaccccccggtttacccccgg

SEQ ID NO: 191991 - DNA, 760 bp, Homo sapiens
  misc_feature: GYAE6OF01AH3O0.47.59.F04.1.454.CMB.1.raw
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagagctcacgtacacgaccggtgctcgatttagtacacacacttagggagttgggggaggaactgctcagttaggacccagagggaaccatggaagccccagctcagcttctcttcctcctgctactctggctcccagataccgaccggagtaagttattttgacacngtctccagccacctgtctttgtctccgaggggaancgccaccctctcctgcgaggtcagtcagagtgttcganagtctacgttagtctacggtaccaagacgaaccgtggccaacggtcctaccgacggtcctcctctacgtctggggaactcgtccaccgttccgaaacggtaccggggtcccgcggttaccgggaccctaaccgttaccccggacggtaacccggttacgggtttaccgacggggtaaccgggtgtaaccggggttcggggttaaccggtacgggggacctaacggggtttaccctttaccgtacgtttaccccgtacgtaaacccgtacgttaccgacggtacccgtacggtacccggtactaaccggtaccgttaggtaacgtttacgttacgttacgttaacgtttacgttacgtacgtacgtaacgtaacgttaactaacgttacgtccgtaccgtccgtacttacggtccgttacggggacgaacgggtccgtagggtacgaccgtagtaaccgaacgtacggtcggtacggtcacgtctacgacgttcgacttcttacgtcctccgtacccg

SEQ ID NO: 191992 - DNA, 792 bp, Homo sapiens
  misc_feature: GYAE6OF01BN847.47.59.F04.1.454.CMB.1.raw
  modified_base (172)..(172): a, c, t, g, unknown or other
  misc_feature (172)..(172): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (547)..(547): a, c, t, g, unknown or other
  misc_feature (547)..(547): n is a, c, g, or t
tcagagctcacgtacacgaccggtgctcgatttagtacacacacttagggattgggggagaactgctcagttaggacccagagggaaccatggaagcccagctcagcttctcttcctcctgctactctggctcccagactaccgacggagtaagttgtgttgacactagtcnccagcccaccttgtctttgtacnccgaaggggaancgcctacccttntacctgcacgggcctagtcaagtagttactagacaagtacctaatttacgccgttaggaccagtacgaagaaccgtggacacggtcctaccgacgtcctacctacgattaccgtaatggtactcggtaccctaccaccggacggtaccgtacgttaccggttttcccaagtaccgtacggttacctagggtaccgacgtaggtcggtaccggtacggtacgggtaactaggtaccggttctaacccggtcttaccgaaccgtaactaccgtaaacctagggtcccgtaacgaccgtagttacccggttaaggtaactttacgggtttntaacgtttacggttttaattaccgtgtacgtggtactaacggttacctaacgtacgttaaccgtccggtaccctaccgtttaacccgtacggttacccggaaccggtagggttaaccccaacgggtttaccgaaacgggttaaacggttaaaccgttaaaaccgttacgggttaacggttaccggtaaccgtccgtaacccgttaacacccgttttacggacggtttacccttcgttaaaccccg

SEQ ID NO: 191993 - DNA, 782 bp, Homo sapiens
  misc_feature: GYAE6OF01D74HX.47.59.F04.1.454.CMB.1.raw
tcagagctcacgtacacgaccggtgctcgatttagtacacacacttagggtaggttggggaggaactgctacagttaggaccagagggaccagtggaagcccagctcagcttctcttctccttgctactctggctccgtagataccaccggagaagttattttgacacagtctccagccacctgtcttgtctccaggggaatcgccaaccgtctacctggaccagggttccaacgtcgacggtacgtgttcgaccgagtccgttaacttagtaccttaggtaacccaaggtacgaaaccttggaccaaggccctccgacggcctacctcaactcgtggacttggactacgtccaacggcggcccgtctcgggctaacgtccccggaacgtccgtaacgggtttcgaacggttcggacgtaacggttcggggtacttcgggggaacctacgggtaacctttctaaccgtcctaccaaccgtactacccgaggaccctacgtacccggtaacgtacgtaccgttaggaaacgtttaacgtttggtaccttacggtttaactttaccgttacgttaaccgcgttaacgtaaacgttaacgtaccgttaccggtaccgttacccgtaccgttacgtaaccgttttcgggaccgggttaacgggaccggttacgggtaacgggaaccgtaacggtaaccgggtaaacttaccgggtaacggtacggtaacgtacgacccgtacgacgttccgtacttaacccgttacttaccgtcccgttaaccccg

SEQ ID NO: 191994 - DNA, 770 bp, Homo sapiens
  misc_feature: GYAE6OF01EGFRM.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggcctcccagataccaccggagaagttattttgacacagtctccagccaccctgtctttgtctaccgaaggggaaagacgcccaccctctcctgccgaggaccagtcagtagtgttggacagactacgttacgccgtaggtaaccaacacgaaaccgtggacccaggccctacccgaacggtccttacctacgacttactagtacgattcgacctaactaccgaaccgtcgggaccaggtcggaccacgtacccacgtacgtacggttactacgggtacggactaagggtcgtaagggttcggtacgggactaaggttaccctacggaccttacctactaaacctacgtacacggaaccgcccggttaaccggaacgtaccgtaccgttaaacggaagttttacgttaccgtacgttttaactttttaacgttacgttacgttcgaagtacgtacgtaccggtaacgtaccgtaacccggtaccgttccgttaccgtaccgttacggttacccgggacggggtaccgggtacgggtacggggtacggaacgttacgggttaaccggtaaccggaacgggtaccgttcgggtaaccgggtactaccgggtaccgttaaccgtacttcggttaggttacccc

SEQ ID NO: 191995 - DNA, 841 bp, Homo sapiens
  misc_feature: GYAE6OF01EO1HH.47.59.F04.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccgganaagtttattttgacacagtctccagccaccctgtctttgtctcgaggggaangcccacctctcctgctaggtcagtcagagtgttgacagtctacttagctaggtaaccaaggacgtaaacctggacccaggtcctaccccgaggtcctacccgtanacgttccggtagggtaactcggaccaacgttacccaaaacggtaccggggcccgtacgttacgggaccctaaccgtcccccgtaacgggcccgttaaagggtttccgaaacgggttcggacgtaacgggttcgggggtaccgttagggggaacctacggttacccttacccgtaacgttcctaacccgaaccgtaactacgaacggttccaaacgtacccgtaagggaccgtacccgtaaggttaaaccgttaagttttccgaactttaggttttaactttacgtacggttacaacggtaacccgtaaacgttaaaacgttaccggtaccggtcccgttaccgtaccgtttaccgtaacccggttttacggggaccggggttaaccggggttaacggaaccgggggttaggaaaccgtaacggttaaccgggaaaaacgttacgtccgggtttaggcccttaaccggaccgtaaccggtaacctttaccggtacgtttacccgttacgttaacccgttccccgttaaccccgg

SEQ ID NO: 191996 - DNA, 758 bp, Homo sapiens
  misc_feature: GYAE6OF01D9CUJ.47.59.F04.1.454.CMB.1.raw
  modified_base (339)..(339): a, c, t, g, unknown or other
  misc_feature (339)..(339): n is a, c, g, or t
  modified_base (410)..(410): a, c, t, g, unknown or other
  misc_feature (410)..(410): n is a, c, g, or t
tcagagctcacgtacacgaccggtgctcgatttagtacacacacttagggattggggggaggaactgctcagttaggacccagagggaaccatggaagccccagctcagcttctcttcctcctgctactctggctccagataccacggagtaagtttattttgaacacacgtcttaccacgcccacccttgttctttcgtcctaccgaaggggaaagacgccctacccttctccctggcgagggtcaagtcgagtaggttgttagaacatacgttacttagtcgttacggaaccgaagaacgaaccgtggaccaggcctaccgagcctcctacatctangtatcgaccaactaccgaacgacgggacctacgcggacctacgtacccagtacgtaggttaccaggtcggngtagggtcgggtacgtaagggactagtaccgttacacccttcacctaaacgtactaccgacgtacgacgtaaccgttacgaaccggtacgtaacgggttaacgtttacgtttaacgggtttaaccttttattacccgttaggtactacggtacgtaccggtatttacgggttaccgttcggtacccggtacctcccggtccttaaccggttacggtccgggggaaccgggtacgggtaaccgggtaggggtaggtaaacgtaacggtaaccggtaaaacggagggttcgggacttacggacccggaaccttacccgtacgttacccgttatttcccgttgtaaccccg

SEQ ID NO: 191997 - DNA, 813 bp, Homo sapiens
  misc_feature: GYAE6OF01CMELQ.47.59.F04.1.454.CMB.1.raw
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (481)..(481): a, c, t, g, unknown or other
  misc_feature (481)..(481): n is a, c, g, or t
tcagagctcacgtacacgaccggtgctcgatttagtacacacacttagggagttgggggaggaactgctcagttaggacccagagggaaccatggaagccccagctcagcttcctcttcctcctgcctactctggcctcccagactacccgaaccggaagtaagtttattttgaccactacgtcctccacgccctacccttgttctttgtccgtaccggaaggggaaacgccgaccctacccttctccgtgaccggtaggtcagtacaggtagttgttacgactcggtactttacgtttacgtacgtacggtaacctaaaggaaccgtaaccgtcggaccgacggtcctaccggaggtaccctcctacgtagtcgagggtatcgaactaccgacgacggaccggtcccngtccggactaccncgtaccggccgtagttcgaggtacggtccgtacgggtggtcggtaaggctacgtttacncctacctacgttacccaccgtataccgacgtaccgaacgtaccgtacggacgttaccgtaaggttaacgttacgtttacgttagtttaacgttacttacgttaacgacgtaacgtaacgttaaaccggtacttaccggaccgttaccgtacccgtttacccggtaccggtttacccgggtttccgggtaaaccgggggtcccgtaacggggtacgggtaaccgtaacggtaaacggtaaccggtaaacggtacggtacgggtacggaccggttacgaccgttaccgttacgttcctttacgtacccgttcgtacccggttccccttacccgg

SEQ ID NO: 191998 - DNA, 714 bp, Homo sapiens
  misc_feature: GYAE6OF01BP0E1.47.59.F04.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
  modified_base (288)..(288): a, c, t, g, unknown or other
  misc_feature (288)..(288): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctcccagacttccaccggagactatttgttttgacactagtctccagccaccctgtctttgtctcgagggaancgccaccctctcctgcgagggccagtcaggngtgttgcagtctactgcctggtaaccaacgtacgaaccgtggaccaggccnccgtaggcctcctcattccagtcgatgcctactaccaacgacgggccacgtcggacctactccgactccgtacgttcgaggtcgcgtaggcgaggttcaggggaactaggtccttacnccgtttaccacaacctataccggtaacnccgtaaccgtcgttacgaacgttaccgttaaggtaacgtttacgtttacgtacctttaaccttttaattccgttcgtagtaccggtacaacggttgtaacccgacgttacgtccccgttccgttaccgtcgggttaaccgggttaccgggcccggggtaacggggaccggttacgggggtaagtaaaccgggttacgtccgggaaacgtaaaccggggttacccggaggtttacccgggacggtctaaaccccgtaccgttacggttccgtttaccccgg

SEQ ID NO: 191999 - DNA, 737 bp, Homo sapiens
  misc_feature: GYAE6OF01BSBSS.47.59.F04.1.454.CMB.1.raw
  modified_base (724)..(724): a, c, t, g, unknown or other
  misc_feature (724)..(724): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagtaagttattttgacacagtctccagccaccctgttctttgtctccgagggaaagagccaccctctcctgcgacgggtcagtcagtagtgttgacacgtctacttagtcgtacggtaacaagaacgaaaccgtggccgacggccacccgacgcctccgtcacgttcgacgggtatcggctacgtaccgaaccggtacgggcccgcgtacggccacctccccgacgtccgtacggtaccaacgggtcggaccgtagggtacggggtacgtacggggaaccgtagtacccttacccgtacgttacccgtactaaacccgtatccgaccgacgtaacggtacctaccggtacgtaccgtaaggttaacgtttagtttacgtacgttaagtttacgttaacgttcgttacgtaaccgtaaccgttaaacgttaaaccttaacgtaccgttacccgtacccgttacccgttacgttaccgtttaccgggaccgggtaaccgggtacggtacggtaagtacgtacgtaaacggtaacgtacgtggtacggcgtcgactacgtacttcgtacgtcttaccncgttccgtacccg

SEQ ID NO: 192000 - DNA, 773 bp, Homo sapiens
  misc_feature: GYAE6OF01BOC7Z.47.59.F04.1.454.CMB.1.raw
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
tcagagctcacgtacacgaccggtgctcgatttagtacacacacttagggattgggggaggaactgctcagttaggacccagagggaaccatggaacgcccagctcagcttctcttcctcctgctactctggctccagataccaccggaagaaatagagatgaacgcagtctccagccacctgtctgtgtctccgaggggaaancgccaccctcgtcctgccgacggggccaggtacaagaacttacttccaaccttccttattacggcctaggtaacctaacaacgtaaccgtggtccgacgtcctccgacgccttccnctacttctagtcgtatcgacctacgtacccgaacgcggtacccgtacggtccgtaaccgtacctaccccggaagttaaccgggtacggttacggtaacgggtcggtacggtacggggtttcggggaaccgtttacggggaactacggttactttacccgaccgtttctacccgacctttacgtacgtacgccgtaacggaccgtaacggtaacgtacgtaacggtaacgtttacgtttcggtttaacttttaccgttttaacgtcgttaccgaacggtacgtacggttacgggtagttaccgttcgggttcccggtaccttcccggtacggtttaccttaccggggtttcggaaccggggtacgggaccggttacgggtaggtaacgtacggtaaccgtaaacggtcgtacgggtacgacgttaccgacttaccgtacgttccgttgttaccg

SEQ ID NO: 192001 - DNA, 920 bp, Homo sapiens
  misc_feature: GYAE6OF01AL4K1.47.59.F04.1.454.CMB.1.raw
  modified_base (208)..(208): a, c, t, g, unknown or other
  misc_feature (208)..(208): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagtaagttattttgacacagtctccacgccaccctgttctttcgtctccgaggggaaancgccaccctctcctgcgtagggtcagtcagagtgttagactagcttacgttagtacgtacggtaaccaaggaacgtaaaccgtcggaccgacggccctacccgaggtccttccgtactactctatgtactcgcactacccgaacgacggtccacgtcggcctacctcccgagtccgtagggttcgaggtcggacgtaggtcggtacggtccggtacgggtaactacgttaccgttaccgtacccttaccgtaaccctaaccctacgttacccggaacgtcgtaaccggtaccggtaacgtacccgggtacctttaaaggtaaaccggtttttacgttttaaccgggttttaaaccttttaacggtttaacccgtttacggtaaacccggttcggttaaccggtaacggggttttaccgggttacgggtttaacccgggttttcccgggtttaccccggggtcccccggttttacccggttacccggttttaaccccggggtttaacccggggtttttacccccgggggggaacggggggtttaaacccgggggtcccgggtaaggggggggttttaaacccggaaaaccgggttaaccccggttaaaacccggttaaacggggttacgggttcgggttaccgggttaacccgttaccggtaccccgtacccggtttaacgtttcccggtttcccgtttctttaacccccggg

SEQ ID NO: 192002 - DNA, 777 bp, Homo sapiens
  misc_feature: GYAE6OF01DFUZQ.47.59.F04.1.454.CMB.1.raw
  modified_base (123)..(123): a, c, t, g, unknown or other
  misc_feature (123)..(123): n is a, c, g, or t
  modified_base (214)..(214): a, c, t, g, unknown or other
  misc_feature (214)..(214): n is a, c, g, or t
  modified_base (512)..(512): a, c, t, g, unknown or other
  misc_feature (512)..(512): n is a, c, g, or t
tcagagctcacgtacacgaccggtgctcgatttagtacacacacttagggagttgggggaggaactgctcagttagacccagagggaaccatggaagccccagctcagcttctcttcctcctnctactctggcctccagactacccacggaagtaagtttatttgaccactagtctccacgccaccctgttctttcgtctaccgaaggggaaanacgcccaccctctcctgacgagggttcaaggtcagtagtgttagactaggtcttacttagtcgtacggtaaccaagaacgtaaaaccctggacccaaggacctacccgaacggtcctaccgtacaacgttggacgggtactcgtacaacttaacccgaaacggtcgggccaacgtcggacctacgtaccccgagtacgacggtacctaggtccggacgtacggttgggtacttaaccggggatacggttaacttaccgccttactaacaccaagttacacgtacacgaacttaaccgngtaacctaggtaaagttcgtttttcggaactttaaagtttaacgttacgttagtaaccgtaaacgtactaaaacggttaactaccggttcgtaacccgtaccggttctaacccggtttaacggtttccgggaacggggtaacgggtaacccggttagggtaccgtaaaaacgtcggtaaacggtaaaaccgttacgtaacggggtgtttaccaaacgtccttaacacggtttcttaacggcctttaacgcgttttccccgaaccg

SEQ ID NO: 192003 - DNA, 679 bp, Homo sapiens
  misc_feature: GYAE6OF01D0G0Y.47.59.F04.1.454.CMB.1.raw
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (209)..(209): a, c, t, g, unknown or other
  misc_feature (209)..(209): n is a, c, g, or t
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
tcagagctcacgtacacgaccggtgctcgatttagtacacacacttagggagttgggggaggaactgctcagttaggacccagagggaaccatggaacgccccagctcagcttctcttcctcctgctactctggcctcccagactaccacggagtaagttntttgacanagtctccagccaccttgttctttgtcctccgaaggggaancgcccaccctctccgtgcgtagggtcagtcgaggtagttgttgaccaggtaccttacgttagtctacggtaaccaaaggtacgaaaccgtcggacctaggcctacccgaggtcctcctagcgtcgtaggatcgactactaccgaacggcgggccngtacggccacgtcccgagtcctaggttcaggttcgacgtggtcggtcgagggactagtacctccncttcccacaccgtatacgtcacgaacgtccgtaaggaccgtaccgtagtaaccgtttagtttccacgtttagtttaacgttccgtagtacgaacgttaacaacgtttaaaccgtccgtcgtacccttcgtccctacggtaccgtttacgggaccgggacggtaccggagggtaccgactaaggtaccggaacgtacgtggtcgactcgcctacggtactcgttaccgttactaacctccgtcccgtaccg

SEQ ID NO: 192004 - DNA, 818 bp, Homo sapiens
  misc_feature: GYAE6OF01EWCZO.47.59.F04.1.454.CMB.1.raw
  modified_base (244)..(244): a, c, t, g, unknown or other
  misc_feature (244)..(244): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagactaccaccggagtaagttattttgacacagtctccagccaccttgtctttgtctaccgagggaagcgcccaccctctctgcgaggtcagtcagtgtgttagacngtacttacgttagtcgtacggtaaccaagtacgaaacctcggacctacgggccctacccgacggtcctccgtactacgtccgtgggatcgctaacgtcccgaaaacggccggggcccgtcgtacgggacctaccgtaccccgtacgaccccggttaaggtttccgacgggtacgacggtacgggtttcgggtacggacggggtaaccgtacggttaccccttacgacccttacccgtaccctaaaccggtctaaccggtaccgaacccgtaccgtaaccgtaacggaccgttaccggttaggtaacgtttaatttacgaacgttttacgttttaacttacggtacgttaaccgtaacgtaaacggttaaaccgtttaaacgttaccggttacgaccccgttcgttaaccgttaccgttaccgggtttaccggggacgggttaaccgggaaccggtacgggggacgtaaccgtacgggtaaaacggtaaacgggttaccgtacggtacgggacgtaccgaccgtaccgttagtttcccgtactttacccgttacgtcccgttccccgtaaccccg

SEQ ID NO: 192005 - DNA, 700 bp, Homo sapiens
  misc_feature: GYAE6OF01EXETH.47.59.F04.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
  modified_base (297)..(297): a, c, t, g, unknown or other
  misc_feature (297)..(297): n is a, c, g, or t
tcagagctcacgtacacgaccggtgctcgatttagtacacacacttagggattgggggaggaactgctcagttaggacccagagggaaccagtggaagccccagctcagcttctcttcctcctgctactctggctcccagactaccaccgganaagtttattttgacacagtctccagccaccctgtctttgctccgaaggggaaancgcccaccctctcctgcgagggtcagtcagagtgtagacagcttactagtcgtaggaccaagacgaactggaccaggctccgagctcctnatcgtggatgacacttaccgaacggacggggcccgtacgtcggacctacgtccccgacggtaccgtaggttccaagggttcggacgtaggtcggggtacgtacggggaactaggtaccttcaaccttcaccgacctatccgaacgtacctacggacctaggacgtcgtaagtaacgttactttcgaacttagttttaactcgtagtactacgaacttaaacgtaacttacgcgtacctccgactacgttaccggttaccgggacgggtaacgggtaccgaggggttaccgaacgttaagtaaaccggtaaaacggttacgtacgggtaggtacccgtacgacccgttaacctaggtttaccgtacgttacctttaaccgtacccggtttcccttaaccccggg

SEQ ID NO: 192006 - DNA, 731 bp, Homo sapiens
  misc_feature: GYAE6OF01CWU15.47.59.F04.1.454.CMB.1.raw
  modified_base (162)..(162): a, c, t, g, unknown or other
  misc_feature (162)..(162): n is a, c, g, or t
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
  modified_base (485)..(485): a, c, t, g, unknown or other
  misc_feature (485)..(485): n is a, c, g, or t
tcagagctcacgtacacgaccggtgctcgatttagtacacacacttagggattgggggaggaactgctcagttaggacccagagggaaccatggaacgccccagctcagcttctcttcctcctgctactctggacctccagactaccgacggagtaagtttntttgacacagtctccacgcctacctgtctttgctaccggaagggaatcgcccaccttctccgtgcgaggtcaggtcagtgtgtnacgagtcttagtcgtctaggtaaccaagtacaaacgtcgccgtaggccttcccgaagtccttaccacgtacgttccgnggggattccggactaccgtaccgaacgggccggtccgtccgtaacgcgaacccttccccgagtacccgtggttcgacggttcggcgtaacggtggggtactggggaactacggttaccccttagaacctttccgaacctacgtacgttacgaacggtaccncgggtacctaacggtactacccggtaaggtaaaccgttgtttaaccgtattaaaggttttacttaccgtcgtaactaacgtacttaaacggaacttacggtccccgtaacgttcccgacgtttacccgttcggtaaccgggtcgggacgtacccgggtagggttacacttaaggacggtaaacggtccgtaaggttcacgtccgtactacctcgttccgattcccgttaatcccgtccttaacccg

SEQ ID NO: 192007 - DNA, 711 bp, Homo sapiens
  misc_feature: GYAE6OF01BS9AD.47.59.F04.1.454.CMB.1.raw
  modified_base (207)..(207): a, c, t, g, unknown or other
  misc_feature (207)..(207): n is a, c, g, or t
tcagagctcacgtacacgaccggtgctcgatttagtacacacacttagggagttgggggaggaactgctcagttaggacccagagggaaccatggaagcccagctcagcttctcttctctgctactctggctccagattccgaccggagactatttgtttgacacagtctccacgcctacctgttcttcgtctaccgaaggggaaancgccacctctcctggcgacgggcagtcgagtaggttgtacggcgacgtacgttactacgaccgtaggtaaaccaaacgaacgtaaccgtcggaccacggtccgtacccgacggtcctaccgtacgacgttacctaaggtctaactcgaacctaacgtaaccgaacggtacgggaacctacggtaccgacgtaacctacccggtaacgaccggttacggtacgtacggtcggacgttacggggacgttacggtacgggttacggaacgtacgttaccgttacacgtttaccaacctacgtacacgtacgacctacggacttacggacgtaccgtaaagtcgtttaatttcgaccttttaagttacggtactgtaacgtacgaagtactaacggtataaccacgttccgacttacgtcgtaccggttcgggaacggttacggacggttaaggtacggagtacgtagacgacgttgtacggacgtcgtaccagaactgttcctaacg

SEQ ID NO: 192008 - DNA, 767 bp, Homo sapiens
  misc_feature: GYAE6OF01BYAJO.47.59.F04.1.454.CMB.1.raw
  modified_base (114)..(114): a, c, t, g, unknown or other
  misc_feature (114)..(114): n is a, c, g, or t
  modified_base (215)..(215): a, c, t, g, unknown or other
  misc_feature (215)..(215): n is a, c, g, or t
  modified_base (357)..(357): a, c, t, g, unknown or other
  misc_feature (357)..(357): n is a, c, g, or t
tcagagctcacgtacacgaccggtgctcgatttagtacacacacttagggattgggggaggaactgctcagtttaggacccagagggaaccatggaagccccagctcagcttcncttcctcctgctactcctggcctcccagatacccgaccggtagaagtttattttgaacacagtcctccagccaccctgttctttgtctaccgaggggaaanacgccaccctctcccgtagcgacgggtcagtcagtagtgttagacagtctacttaggctacggtaacaagacgaaaccgtggaccaggcctaccgagcctccactatcgaggtatcgacaacctccgaacgtacggcccgtntaccggacaccgtacccgagtacccgtacgggttacaagggttcgacgttacggtcgggttacctacgggggaccttaacggaccttcctaaccgttcctaccgaaccctagacgtacgactaagacccgttagaccgtactacggtaacgttatttacggacgttaagtttactacgttacggtactaacgtacgtaaaccttaaacgttacgcggttaccccgttccgaaccgtttaccgtaaccgtttaccgggacgggaaccgggttaaccgtaacggggtacggtaaaccgtacggtaaacggaaaaccgttaccgggtaggttacccgacccgttaacggacctaacgttaacgttccggtttacgtaacccgttttacgtcccgttaaccctttacccccggg

SEQ ID NO: 192009 - DNA, 807 bp, Homo sapiens
  misc_feature: GYAE6OF01D3TW3.47.59.F04.1.454.CMB.1.raw
  modified_base (206)..(206): a, c, t, g, unknown or other
  misc_feature (206)..(206): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagactaccaccggagtaagtttattttgacacagtctaccagccacccttgtcttgtctcgaagggaanacgcccaccctctcctgcgacgggtcaaggtcagacgtgttagactagcttacttagtctacggtaaccaagaacgaaaccctgggaccagggtccctacccggacggtcccttcctacgtacgttcgtcggggtatcggacgaactaccgaaaccgggccggggtcccgacgttacggccaccgttaccccaggttacccggtacggtttaccagggtcggtaccggtagggttccggggaccgttaggggactacggtctttacccgaccgtttcacccacgactccgacgcgtacgtaccgtaagaccgtaccgtaggtaacgttacgtttacgtacgtttaacgtttaacttacgttacgttaaccgtaacgtaccgttaaaaaaaccgttacgttacccgttaccgtacccgttaccgtaccgtttaccggttaccggtttacggggaccggggtaaccgggtaacgggtacggggacggtaacgtaacggtaaccggtaaacggttacggtaacggtcggttaccggtacgtacccgttacccgtaacgtttccgttacggtttaccccttacgtcccgtttacccgtaccccgg

SEQ ID NO: 192010 - DNA, 1089 bp, Homo sapiens
  misc_feature: GYAE6OF01BWGTH.47.59.F04.1.454.CMB.1.raw
tcagagctcacgtacacgaccggtgctcgatttagtacacacacttagggagttgggggaggaactgctcagttaggacccagagggaaccatggaacgccccagctcagccttctcttcctcctgcttactctggccttacccagactaccaccgggagtaacgtttattttacgacactacgtccgtaccaacggccctaacccgttgttccgtttacggtaccttacccggtaaagggggaaacgttccggaccctaacccttccgtcccgtaggccgtacggggtccaacggttcaaacggttcggttcgttacgaaccgtaccgttaccgttaaccgtttacgttcgttaacgggtaaacccaaaggtaacccggtaaaccgttgggacccagggttaccctaaccccggtaacgggtcccttaccccgttaacggacgttttacccgggtaggggttaatcccgtacccgtaacgttaaccccgaaaggttaacccgggggcccggttaacggtcggtaccctaaacccggtcccctaaacgggggtccccctttaacggggtttaccgacgggttttcgggtaccggttaaaccgggttcgggggtttaaccgaccgggggtaaaccttacgggtaaccccgtttaccgaccgttacgttaaccccgaaaacgttccggttacgaacccgggtaactacccggttaccggtaaccgggtaccgttaaccgggttaacggttaaacggttttaacgttttacgggtaacctttaaacggtttttaccgtacggtttaaccgttaccggttaaacggttaaacccggttaaacctttaaccgggtacgtttaacccggtaccccgttacggtaacccggttttaccggttaacccgggggttaccgggttaaaccgggggtaccgggtaacccggggttagggtaaccgggtacctaaaccggggtttaaacgaaacccgttacggggttacgggtacccggttacggtaacccgtcccgaaaccgtttcgttaacccgttaccggttaaccgttccctaaacccggtttccccgttaccccgg

SEQ ID NO: 192011 - DNA, 518 bp, Homo sapiens
  misc_feature: GYAE6OF02I6F6F.47.59.F04.1.454.CMB.1.raw
  modified_base (309)..(309): a, c, t, g, unknown or other
  misc_feature (309)..(309): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccggctcccaggctcctcatctgggatgcatccaacngggccgctggcatcccagccaggttcagtggcaggtggtctgggacagacttcactctcaccatcagcagcctagagcctgaagtatttgctagtttattactgtcagacaacgtaactactggcctccgctctacgtttcggcggtagggaccgagggtcgacagtagaacgacgtggtggctgcacatctgtctcacttcctcccgc

SEQ ID NO: 192012 - DNA, 551 bp, Homo sapiens
  misc_feature: GYAE6OF02IKMA3.47.59.F04.1.454.CMB.1.raw
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggcctcctnatcgtgggatgcatccaacgagggccnctggcactcccagccaggttcagtggcagtgggtctgggacngacttcactcacaccatcagcacgcctagacgccgtagaagttnttttcgacttacttttattactgttacagtcagcgtanactagtcggcctctcgtacgttcgggacgggacgggacgaggggtaggagacgtacgacggaacgtacgtggtggtcgtagaccacgtactcgttcgtccttctaccg

SEQ ID NO: 192013 - DNA, 571 bp, Homo sapiens
  misc_feature: GYAE6OF02FE0G9.47.59.F04.1.454.CMB.1.raw
  modified_base (217)..(217): a, c, t, g, unknown or other
  misc_feature (217)..(217): n is a, c, g, or t
  modified_base (334)..(334): a, c, t, g, unknown or other
  misc_feature (334)..(334): n is a, c, g, or t
tcagagctcacgtacacgaccggtgctcgatttagtacacacacttagggtagttgggggaggaactgctcagttagggacccagagggaaccatgggaagcccagcgtccagcttctcttcctccgtgctactctggctcccgagataccaccggagaacgttaatttttggacacagtcctccagccaccctgtctttcgtctccaggggaaagngccaccctctcctgcagggtcagtcagacgtgttgacagcgtacttagtctgggtaccaagagaaacctggccaggtactccaggctcctcatctgggatggcatccaacagggccnctggcatcccaagcctaggttcaaggtcgggcaggtgggtcgtgggactaggacttcgactctcaccgatcagccacgcctagacgcctaggaaacgtatttcgactagtttaatacttgtacagttacaaacgtaaactactcggtcctcgactacgtacgtttcggacggtacgggacctagggtcggacagtacgaacgacgtgtggctagcacagtcgtgtctcactctcccg

SEQ ID NO: 192014 - DNA, 501 bp, Homo sapiens
  misc_feature: GYAE6OF02GV2OW.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacagggccgctggcatcccagccaggttcagtggcagtgggtctgggacagacttcactctcaccatcagcagctagagcctgaagatttgctagtttatactgtcagcaacgtaatactggctccgctctacgttcggcggaggaccgaggtgacatgaacgactgtgcgtgcacatctgtctcactctcccg

SEQ ID NO: 192015 - DNA, 541 bp, Homo sapiens
  misc_feature: GYAE6OF02F0MOQ.47.59.F04.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccaggctcctcatctgggatgcatccaacagggccnctggcatcccagccaggttcagtgcagtgggtctgggacagacttcactctcaccatcagcagcctagacgcctagaagtactttggtactttattactgtcagcagcgtgtacgtttcgtcggcctccgctccgtacgtttcgggcgggtacgggaccgaggggtggagacgtacgaacggtaacgtaggtcggctgccaccattccgtgtccttctacttcccg

SEQ ID NO: 192016 - DNA, 540 bp, Homo sapiens
  misc_feature: GYAE6OF02GI4R8.47.59.F04.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagcctggtaccaacagaaacctggccaggctcccaggctcctcatctatgatgcatccaacgngggccnctggcatcccagccaggttcagtggcaggtgggtctgggacagacttcactctcaccatccagcagcctagacgcctagaagtattttcgacttagtttattacgtgtcagtactaacgtaatacgtggtcctccgctctacgttcggcgtacgggacgtagggtgactagtacgaacggaacgtgtacggctgacaccgtacgtcgtgtcttacgacttcccg

SEQ ID NO: 192017 - DNA, 592 bp, Homo sapiens
  misc_feature: GYAE6OF02H53VN.47.59.F04.1.454.CMB.1.raw
  modified_base (213)..(213): a, c, t, g, unknown or other
  misc_feature (213)..(213): n is a, c, g, or t
tcagagctcacgtacacgaccggtgctcgatttagtacacacacttagggaggttgggggaggaactgcctcagttaacggacccagagggaaccatggaagcccagcctcagcttctcttcctcctcgctacgtctggcctccgagataccatcggagaagttgtgttgacaccagtctccacgccacccctggtctttgctccaggggaangccaccctgtcctgcagggccagtccaggaactgttcaacgtcctacttagcctaggtacctaacagaaaacctggtcaggctaccagctctcatcatgatcgacactccgaacgaggggtccacgtggactagtccagacacggttcaggtggcagtgggactggacagacttcactcgtcaccgtatccgagcacgccgtacgacgtcctagtaacgtacgttacggtaactttaacgttacttacgtactacgtactacgtcgtaggtacgttcgtcggccctccgcttacgaccgtttcggcggacggtaccgtaggtaggacgagtacgaaacgacgtggtacggcgtcggcgaccgtagtccgtcgtctaccg

SEQ ID NO: 192018 - DNA, 513 bp, Homo sapiens
  misc_feature: GYAE6OF02IQR2P.47.59.F04.1.454.CMB.1.raw
  modified_base (204)..(204): a, c, t, g, unknown or other
  misc_feature (204)..(204): n is a, c, g, or t
  modified_base (354)..(354): a, c, t, g, unknown or other
  misc_feature (354)..(354): n is a, c, g, or t
tcagagctcacgtacacgaccggtgctcgatttagtacacacacttagggattgggggaggaactgctcagttaggacccagagggaaccatggaagccccagcgcagcttctcttcctcctgctactctggctcccagataccactggagaaatagagatgacgcagtctccagccaccctgtctgtgtctccgaggggaaanagccaccctctcctgcagggccagtcagagtattagcagcaacttagcctggtaccagcagaaacctggtcaggctcccaggctcctcatctatgatgcatccaacgagggccactggcatcccagacaggttcagtggcagtgagtcgngggacagtacttcactctcaccactcagcagcctagacgcctagaagtattttgcttactttattactgtcagcagcgtagactaactcggcctctctacgttcggacgggacggaccgagggtggagagtacgacgacgtacgtggtacggtctgacc

SEQ ID NO: 192019 - DNA, 527 bp, Homo sapiens
  misc_feature: GYAE6OF02GBSZR.47.59.F04.1.454.CMB.1.raw
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctccaggctcctnatctgggatgcatccaacagggccnctggcatcccagccaggttcagtggcaggtgggtctgggacagacttcactctcaccatcagcagcctagacgctgaagtatttgctattttatactgtcagacaacgtaatactcggcctccgctctacgttcggcggacggacgagggtggacagtagaacgtacgtggtacggcgtcgcaccgtattcgtgttcttctacttcctcccg

SEQ ID NO: 192020 - DNA, 531 bp, Homo sapiens
  misc_feature: GYAE6OF02HOIK5.47.59.F04.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctcctnatctgggatgcatccaacgagggccnctggcatcccagccaggttcagtgcagtgggtctgggacagacttcactctcaccatcagcagcctagacgcctgaagtatttgctagtttattactgttcagcaaacgttaatactggcctccgctctacgtttcggcggtacgggaccgagggtacgacagtacgaaacgacgtggtcggctgaccaccgatctgtcttcacttcctccccg

SEQ ID NO: 192021 - DNA, 758 bp, Homo sapiens
  misc_feature: GYAE6OF02F4P80.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggcctccagactaccagtcggagtaagttgttgttgacacagtcctccacgcccacccttgttctttgtcctaccggaaggggaaagcgcccaccttcctccgtgacggacggccagtcaagtaattactccaccttcctacgttacgccgttacggtaaccaacgaacgtaaaccgtggtaccgaacggtccctacccgaggtccttcctactattacctagtagagtcgacctacgtacccaacggacgggaccctacgtcggacctacctacccgaacgtacgtacggttacgaggtacggactaggtcggtaccgtcgggtacgggactaggtacgttcctaccgtccttaccaacctaactacgaaccgacgtcctacggacctacggtttcctaaggtaacgtttagtttcgacgtttaagttttactacgttcgtaactacgtagtagtaactacgtaaactaccggttaccggccttaccgtaccttacccggtaccggaaccgtaaccggggacctacggtaacggtacggtaaacgttaaaccgttaaaccggtacggtaccgggttagacccgttacggaacccgtaaccgtttacgttaccgttacggtttacccc

SEQ ID NO: 192022 - DNA, 510 bp, Homo sapiens
  misc_feature: GYAE6OF02GQ8MI.47.59.F04.1.454.CMB.1.raw
  modified_base (317)..(317): a, c, t, g, unknown or other
  misc_feature (317)..(317): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacagggcccntggcatcccagccaggttcagtgcaggtgggtctgggacagacttcactctcaccatcagcagcctagcgcctgaagtatttgctactttattactgtcagcagcgtagcaacgtcggcctctcacgtttcgggcgtacgggaccgagggtgagatcgaggaacgactggtggctgcacatctcgtcttctac

SEQ ID NO: 192023 - DNA, 544 bp, Homo sapiens
  misc_feature: GYAE6OF02IPJ62.47.59.F04.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttattttgacacagtctccagccaccctgtctttgtctccaggggaaanagccaccctctcctgcagggtcagtcagagtgttgacagcttacttagtctggtaccaagagaaacctggccaggcctcccaggctcctcatctgggatgcatccaacgngggccntggcatccagcaggttcagtggcaggtgggtctgggacagtactcactctcacatcagcagctagacgctagaagtatttgctagtttattactgtacagactaagttaaatacgtcgtcctccgtctacgtaccgtttcgggacgggtacgggtaccggagggtacggactagtagaaacgtacgtggtcggctgaccactacgtctgtcttactactcctcccg

SEQ ID NO: 192024 - DNA, 783 bp, Homo sapiens
  misc_feature: GYAE6OF02J5UXE.47.59.F04.1.454.CMB.1.raw
  modified_base (173)..(173): a, c, t, g, unknown or other
  misc_feature (173)..(173): n is a, c, g, or t
  modified_base (731)..(731): a, c, t, g, unknown or other
  misc_feature (731)..(731): n is a, c, g, or t
tcagagctcacgtacacgaccggtgctcgatttagtacacacacttagggagttggggaggaactgctcagttaggacccagagggaaccatggaacgccccagctcagtcttctcttcctcctgctactctcggcctaccagactaccgacggtagtagttattagaccacncgtcctaccacgtccctaccgttgttcgttacgaccgtaccggaagggaaactccgaccctacccttctccgtggacggtagggtctagtacgtaagtcggttgttacgacgtacgtacgttacgttacggtacgtaaccgggtaaccaacggtaaccgaacccgttcggacctaccggtccttacccgacggtccccttacgtacgtaacggtccggtagggacttaccggaccgtaccgaccggtaaccggtccggaccggtccgttaccggacccttaacccgtccggtaacggttaccgggtacggtttacgacgggttcggaccgttagggtcggtacgacggactaacgtctacctactccgaactaccgacgtcgaccgtcgtacgtacgtaacggtacgtacgttaaggttaacgtttacgttacgtaactttacgttaactccgagtaacccaagtaaccggtaacttacgcgttccgaccgtccgtaacggtccggttacggacgggacgtacgggtacgaggactacgacgtacgacgttgtccgtntacccgtacgacctattaccgttccgtacttcctaccgttaccgtcctaccg

SEQ ID NO: 192025 - DNA, 514 bp, Homo sapiens
  misc_feature: GYAE6OF02IRORK.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctcccagctcctcatctatgatgcatccaacaggggccactggcatcccagacaggttcagtggcagtgggtctgggacagacttcactctcaccatcagcacgcctagacgcctagaagtactttggacttttattacttgtcagcagcgtagcaactcggcctctctacgtttccgggcggacgggaccgaggggtggagagtcgaggacgaatggtggctgcaccgatctgtctc

SEQ ID NO: 192026 - DNA, 557 bp, Homo sapiens
  misc_feature: GYAE6OF02HLES7.47.59.F04.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccagctcctnatctgggatgcatccaagagggccnctggcactcccagccaggttcaggtggcaggtgggtcngggacagtacttcactctcacatcagcagctagacgctagaagtatttgcttagtttacttactgttactagactaaacgtaaatacgtggtaccctcgacctacgtaccgttcggacgggtacgggaccgtagggtcgacgtagtacgaaacgtacgtggtcggctcgactacctattcgtcgttacttcctactccgttcccg

SEQ ID NO: 192027 - DNA, 556 bp, Homo sapiens
  misc_feature: GYAE6OF02JCADM.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacattgttttgacacagtctccagccaccctgtctttgtctccaggggaaagagccacctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcacgcctagacgcctgaacgtatttgactactttattactgtcagtcagcgttagacctaacgtcggtccctcttctaccgtttcgggccgggtacgggtaccgtaggggtcggacggtagtaccgaaggtaacggtaacgttggtacggtacgtacggccgaacccgtagttcgttacg

SEQ ID NO: 192028 - DNA, 582 bp, Homo sapiens
  misc_feature: GYAE6OF02F6MDH.47.59.F04.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (382)..(382): a, c, t, g, unknown or other
  misc_feature (382)..(382): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgctccaggggaaagngccaccctctcctgcagggtcagtcagagtgttgacagctactagtctggtaccaagagaaacctggccaggcctcccaggctcctnactctgggatgacatccaacgaggggccgctcggcactccccagccaggttcaggtcggcaggtgggtctaggggacaggtacttcacgtcncaccatcaagcagcctagacgccgtagaagtatttgcttagtttattactgtcagactaaacgtaatcgtcggcctccgcttacgtacgtttcggacggtacgggtaccgagggtacggacgtagacgaacgtacgtcggtcggtacgtacgaccgtaacctagttaccgtcgttaccttccgtacgttccgttaccccg

SEQ ID NO: 192029 - DNA, 586 bp, Homo sapiens
  misc_feature: GYAE6OF02I5URC.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctccaggctcctcatctgggatgacatccaacgagggccgatggacactcccagccaggttcagtggcaggtgggtctgggacaggtacttcgactcgtcaacgatcgagacacgcctagacgctagaagtatttgactagtttactactgtacgtagtactaaagttaatacgtcggaccttccgacttacctacgtttccggacgggtacggtaaccgtagggtacgacgtacgtaggtaaaccgtacgtggtacggcgtacgaccgtaccgtagttcgtacgttcttacctacgttccctacccgg

SEQ ID NO: 192030 - DNA, 605 bp, Homo sapiens
  misc_feature: GYAE6OF02I33RR.47.59.F04.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaaggggaaancgcccaccctctcctgcgagggtcagtcagagtgttgacngctacttagtctggtaaccaagacgaaacctggaccaggcctcccgaggcctcctcactcgtgggatcgcactacccaacgacgggcccngtggaccactcccgagcctagggttcaggtcggctaggtcgggtactgggacaggtacttcgacttctcacctntcagcacgtctagacgcctaggaacttagtttcgacttaagtttactacgtcgtacacgtactaaacgtaactacgtcggtcctcgtcctcgtacgttcggacgggacggtcgtagggtacgatagtacgaacggtacgtcggtacgtacgtcgacctacgtacgtcgttacgttactactaccgttccgttacccg

SEQ ID NO: 192031 - DNA, 704 bp, Homo sapiens
  misc_feature: GYAE6OF02IS8O8.47.59.F04.1.454.CMB.1.raw
  modified_base (329)..(329): a, c, t, g, unknown or other
  misc_feature (329)..(329): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctaacttagtctggtaccaagagaaacctggccaaggcctacccgaggcctcctcatcgtagggatgcactaccgaacgagggcccncgtacgggcaacgtccccgaaggtcccgtaagggtttccgaggttcgggccgtaggttcgggggtcgtggggacaaggtactttcgaacctctacaacctatccgagtccacgtacccgtaagacgtaccgtaggaaacgttattttcgacttaacggtttttaacttacgttcgttacgaagtacctaaaacggttaaactaccggtacggtacccgtaccgtacctttaccgtaaccggtttcgggaccgggtaacgggtcccgtaaaggggttcggaacaacggttacggaaaacggtaccggtagggtacggtaccgtacggaccgaaccgtacttcggttacgtcctttactaccgttcccttaccccgg

SEQ ID NO: 192032 - DNA, 536 bp, Homo sapiens
  misc_feature: GYAE6OF02FYTPD.47.59.F04.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctccaggctcctcatctgggatgcatccaacagggccntggcatcccagccaggttcagtggcaggtgggtctgggacagacttcactctcaccatcagcagcctagacgcctgaagtatttgctagtttatactgtcagcagcgtagcaacgtcggcctctctacgtttcggcggacgggaccgaggggtcggagtacgtacgaggtaacgaacgttggtacggtctacggccaccgtacttcgtcgttccttctaccg

SEQ ID NO: 192033 - DNA, 521 bp, Homo sapiens
  misc_feature: GYAE6OF02FJ2SC.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccaggctcctcatctgggatgcatccaacagggccgctggcatcccagccaggttcagtggcagtgggtctgggacagacttcactctcaccatcagcagcctagacgcctgaagtatttgctagtttatactgtacagacaaacgtaatactggcctccgctcacgtttcggcggagggaccagggtgacgtatacgaacgtacgtgtggcctgaccacatctgtcttacgattcctcccg

SEQ ID NO: 192034 - DNA, 725 bp, Homo sapiens
  misc_feature: GYAE6OF02I036F.47.59.F04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaaggggaaanacgccaccctctcctgcaggtcagtcagntgtgacagctacttagtctcggtaaccaagacgtaaaccgtggaccacggcctacccgaggccttcctcaattcctatcgatcgactatcccgaaacgcgggccctagtcggaccaactcccgaagaccgttaaggttccgagttacggcctaagggttcggggactacggggactaggtaccttcgaaccgttcctaccgaaccgtagtaccaggtaccgacgtaccgtaaggaccgtccgtaaggtaaacggttacgtttacgggttaaccttttaacgttaccgttacggtaaccgttacgtaccggttacggtaccgggtttaggtaccggtttccgtacccgggttccttccccggttacgtttacccggttaccgggtttacggggaccgggttacgggaaccggttaggggtacgtacgtacgttaaccggaaacggttacgtgggtcgaccgtaggacctacgacttcgtacgttctcgtacc

SEQ ID NO: 192035 - DNA, 691 bp, Homo sapiens
  misc_feature: GYAE6OF02HL7PP.47.59.F04.1.454.CMB.1.raw
  modified_base (202)..(202): a, c, t, g, unknown or other
  misc_feature (202)..(202): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttatttgacacagtctccagccaccctgtctttgtctccaggggaaagngccaccctctcctgcagggtcagtcagagtgttgacagctacttagtctggtaccaagagaaacctggccaggcctcccgaggcctcctcatcgtgggatgacatcccgaacgacggggcccgcgtcggcacgtccccagccgtaggttccaggtcggcaggttggggtctagggacaggtacttcgacttcctacaccgatcacgtcacgtacctagacgtaccgtagaaacgttagttttacgacgttaagtttttaacgttacgttcggttacgtacgtacgttaaagttaaacttaaaacgttaaccgttacggtacccgttaccggttaccggtttaccgggtaacccggtaaacgggtaccgtaacccggtaacgtacgggaacgtaacgtttaaaccggtaacgttacggttacggacgttacggaccgtaaccgtacgttccgttacgttaccttacgtacctttcccgttccccgtaccc

SEQ ID NO: 192036 - DNA, 706 bp, Homo sapiens
  misc_feature: GYAE6OF02IXJXK.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggcctccgaggctcctcatcgtgggatgcactccaacgacggggccgcgtcggcactcccgagccgaggttcaggtcggcgaggttcgggtctagggggacaggtacttcgaactccgtacacccgataccgacgtaccgacggtacccgtaaggaacgtccgtaggtaaacgttagtttttaggaaccttaaggtttttaactttaccgttggttaccaaggtaccgtaaaacgtttaaacgtacggttaccggtacccgttaccggtaccttaccgttaccgggttttacgggacccggggaacggggttaacccgtaagggggttccggaacgttaacgtacggtaaaacggtaaccgttgggtaccggcgtacgacccgtaacctacgttcgttcgttaccttaccgttaccttcccgttaccccgg

SEQ ID NO: 192037 - DNA, 523 bp, Homo sapiens
  misc_feature: GYAE6OF02G24MA.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctcctcatctgggatgcatccaacagggccgctggcatcccagccaggttcagtggcaggtgggtctgggacagacttcactctcaccatcagcagcctagagcctgaagtattttgctagtttattactgtcagctaacgtaaatctggcctccgctctacgttcggcggacggaccgagggtcgacagtagaacgacgtggtggctgccacattcgtgtccttctacttcctcccg

SEQ ID NO: 192038 - DNA, 674 bp, Homo sapiens
  misc_feature: GYAE6OF02I5ZWJ.47.59.F04.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaanagccaccctctcctgcagggtcagtcagagtgttgacagctacttagtctagggtaccaagagaaacctggccaggcctcccgaggcctccgtnatcgtgggattgcatccaacgngggcccgntggcactccagcctaggttccagtcgggcaggtcgggtcgtagggactacgtacttcactcctaccacctatacccgagtccacggtccgtacgacgtccttaggaagttacgttttacgaccgttaagtttaactacgttaggtacagtacctaaacgttaaacgttccgtacgggacccttccggtacttaccgtacggtttaccggacggggtaaccgggtaaccggtacgggttacgggaacctacggtacggtaaaccgtaacggttcgggttacggtacgtaccgaccgttaacccgtagttcccgttacggtttccttacgtaccgtttcccgttaccccg

SEQ ID NO: 192039 - DNA, 530 bp, Homo sapiens
  misc_feature: GYAE6OF02HRI68.47.59.F04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtcttgtctccagggaaagngccaccctntcctgcagggtcagtcagagtgttgacagctacttagtctggtaccaagtagaaacctggccaggctcccaggctcctcatctgggatgcatccgaacgngggccgntggccatccccagccaggttcagtggcagtgagtctgggacagacccttnactctacacatacagcacgacctagacgtcctagtaagtattttgacttaacttttatacttgtacagtctagtatacataactcggccgtctctacgttcgacgaaggacacgactggagtagtaaacgtactggtacgctgactacagtcttgtctctac

SEQ ID NO: 192040 - DNA, 623 bp, Homo sapiens
  misc_feature: GYAE6OF02GASQF.47.59.F04.1.454.CMB.1.raw
  modified_base (207)..(207): a, c, t, g, unknown or other
  misc_feature (207)..(207): n is a, c, g, or t
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
tcagagctcacgtacacgaccggtgctcgatttagtacacacacttagggattgggggaggaactgctcagttaggacccaggagggaaccatggaacgccccagctcagcttctcttcctcctgctactctggcctcccagattccaccggagacatttgttttgacacagtctccagccaccctgtctttgtctccgaggggaanagcccaccctctcctgcgagggccagtcagagtgttggcagctacttagcctggtaccaacagaaacctggaccacggcctcccgaggcctcctcatcgtgggatgcactccgaaacgcgggccncgtggctactcccagcctaggttcaggtggctaggtcggggtctggggactaggtaccttcgactctaccaacctatccagccacgacctaggacgccgtagaagttntttcgactagtttacttactgtacagtactaaacgttaactacgtcggtcctccgtactcgttaccgtttcgggaccgggtacggaccggtaggggtacgacgtacgtacggaaaccggtaacgttacggtcgggtacctacggaccaccgtattccgtcggttaccttacgtacttaccccg

SEQ ID NO: 192041 - DNA, 560 bp, Homo sapiens
  misc_feature: GYAE6OF02JF5C8.47.59.F04.1.454.CMB.1.raw
  modified_base (210)..(210): a, c, t, g, unknown or other
  misc_feature (210)..(210): n is a, c, g, or t
  modified_base (421)..(421): a, c, t, g, unknown or other
  misc_feature (421)..(421): n is a, c, g, or t
tcagagctcacgtacacgaccggtgctcgatttagtacacacacttaggagttgggggaggactgctcagttaggacccagacgggaaccatcggaagcccctagcttcagcttctcttcctcctgctactctggctcccagataccaccggtagaagttattttgacacgtagtctccagtccacctgtctttgtctccaggggaaagngccaccctctcctgcaggggtcagtcagagtgttgacagctacttagtctggtaccaagagaaacctggccaggctcccaggcctcctcatctgggatgcatccgaacgacgggccgctggcacgtcccaggcctagggttccaggtggcaaggtgggtctaggggacaggacttcacgtctcgaccatcagcagcctagacgcctagaanacgtttaggactttattactcgtacgtacgcagtcgtagtagttcgtacgcctcgctctcttcggacggacggacgagggtgagtatacgaacggtacgtggtacgagtgacgacgtacgtcgtcgtcttctagtaccg

SEQ ID NO: 192042 - DNA, 747 bp, Homo sapiens
  misc_feature: GYAE6OF02IESMH.47.59.F04.1.454.CMB.1.raw
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccacccctctcctgcgaggtcagtcagagttgttagacagcttacgttacgttcgtacggtaaccaagaacgtaaccgtggccgaggccctacccgaggtcctccactatccgtagggactgacctaactaccgaaacggaccggggcccncgtacgggacctaaccncccgacgccgtaacggttcaggtcggacgtagggttcggggtcgtacgggaaccgacggttaccttacgtaacctttcccgaacctaaaccctaacgtccgaaggacccaacggtaccgtaacggacgtcccgtaaggtaaacgttagttttcgacttaagttttaacttaccgttgtacaacggtaacaaaacgtttaaactccggtaccgtacccgttcccgacttaccgtttaccgggttccgggtacggggaaccgtaaccgggtaagggttacggaacgttaagtaacgggaaaacggtaacgtgggtacggacgtacgaccctaacgtacgttacgttcgttaccctcgttaccttcccgtacccccg

SEQ ID NO: 192043 - DNA, 540 bp, Homo sapiens
  misc_feature: GYAE6OF02G65W4.47.59.F04.1.454.CMB.1.raw
  modified_base (311)..(311): a, c, t, g, unknown or other
  misc_feature (311)..(311): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagacattgttttgacacagtctccagccaccctgtctttgtctccaggggaagagccaccctctcctgcagggccagtcagagtgttggcagctacttagcctggtaccaacagaaacctggccaggctcccaggcctcctcatctatgatgcatccaacgngggccacgtggcactcccagcccaggttcagtggcagtgagtcgtgggacagtacttcactctacaccatcagcagcctagacgcctagaacgtactttggtactttattactgtcagcagcgtgagttcgtggccctcgctctaccgttcggcggtacgggccgaggggtggacgtatacgaaacggtacgtggtcggtacgtcggacctaccgtattccgtagttcc

SEQ ID NO: 192044 - DNA, 648 bp, Homo sapiens
  misc_feature: GYAE6OF02IW0PY.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggcctcccagataccaccggagaagttattttgacacagtctccagcccacctgttctttgtctccgaaggggaaagcgccaccctctcctgcgagggtcagtcagagttgttgacagctacttagtctggtaaccaaggacgaaacctggaccaggcctcccgaggcctcctcatctatgatgactactaccgaacgcgggaccacgtggacaccgtcccagaccgtaggttcaggtcggcgtaggtcggggtcgtaggggacctagtacttccgactctaccacctagtcagcacgtacctaggactcgtagaacgttacgtttcggtaacttttattaaccgtcgtacacggtactaggtacgttagaccgtttcgacggtcccctccgtcctaccgttaccgggtttccgggacggggtacggaccggtaggggtacggacgtagtaaccggaaacggtacggtggtaccggcgtacgtcccaacgttacgttccgttacgttcttactacccg

SEQ ID NO: 192045 - DNA, 576 bp, Homo sapiens
  misc_feature: GYAE6OF02GLD0P.47.59.F04.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctcccaggctcctcatctgggatgcatccaacagggccgctggcactcccagccaggttcaggtcggcaggtcgggtctgggacagtacttcacgtctcacctatcagcacgcctagngcctagaagtatttgactagtttatactgtcagactaaacgtaatacgtgccttccgctctaccgtttcggcggacggaccgtagggtacgactagtacggaaacgtacgtcggtacggtacctacggaccaaccgtacgttccgttacgttcctttacgtaccgttcccgttacccccgg

SEQ ID NO: 192046 - DNA, 545 bp, Homo sapiens
  misc_feature: GYAE6OF02H8MT0.47.59.F04.1.454.CMB.1.raw
  modified_base (316)..(316): a, c, t, g, unknown or other
  misc_feature (316)..(316): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccgaggctcctcatctgggatgcatccaacaggccntggcatcccagccaggttcagtgcaggtggtctgggacagacttcactctcacatcagcagcctagacgcctagaagtatttgactagtttattacgtgtcgagactaaacgtaaatactcggcctccgtactctacgtttcggacggtacgggaccgagggtacggacagtacgaacgtacgtgtacggctacgacaccgtattcgtgtcttacgtacttcctacccg

SEQ ID NO: 192047 - DNA, 559 bp, Homo sapiens
  misc_feature: GYAE6OF02HFIXV.47.59.F04.1.454.CMB.1.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (410)..(410): a, c, t, g, unknown or other
  misc_feature (410)..(410): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctgggaccaggcctcccgaggcctcctnatctgggatgcatccaacgagggccnctggcactcccagccaggttcaggtggcaggtgggtctgggacaggtacttcactctcaccatcgagcaagcctagacgcctgaagtntttgctaagttttactacgtgtcagactaaacgtaatactggcctccgacttcgtacgttcgggaccggagggtacccgagggtacgatagtacgaaacgtacgtcggtggctgaccacgtcgtcgtgttccttcgacttccgtccccg

SEQ ID NO: 192048 - DNA, 569 bp, Homo sapiens
  misc_feature: GYAE6OF02FP8CC.47.59.F04.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttgtgttgacacagtctccagccaccctgtctttgtctccaggggaaangcccaccctntcctgcagggccagtcagagtgttgacngctacttagtctggtaccaagagaaacctggccaggctcccaggcctcctcatcgtggatgcatccaacgagggccgctgggcactccccgagcccagggtttcaggttgggcaggttggggtctggggacaggactttccacttcctaccaccctatccagcaacgcctaggacgcctagaacgtattttacgctagtttatacttgtcagactaaacgtaatctggcctcgctcacgttcggcggaacggacgagggtcgactagtacgaacgtaacgtggtacggtcctacggccaccgtactccttgtccttactacttccccg

SEQ ID NO: 192049 - DNA, 536 bp, Homo sapiens
  misc_feature: GYAE6OF02FVNOF.47.59.F04.1.454.CMB.1.raw
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagagctcacgtacacgaccggtgctcgatttagtacacacacttagggattgggggaggaactgctcagttaggacccagagggaaccatgggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacgngggccntggcatcccagccaggttcagtggcaggtgggtctgggacagacttcactctcaccatcagcagcctagacgcctgaagtatttgctagtttatactgtcagcagtcgtagacaacgtcggacctctactacgttcgggacggacgggacgaggggtgagtacgtacgaggtaacggtaactggtcggtctgaccaccgtactcgtcgttcttctacg

SEQ ID NO: 192050 - DNA, 631 bp, Homo sapiens
  misc_feature: GYAE6OF02J19SJ.47.59.F04.1.454.CMB.1.raw
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagtttattttgacacagtctccagccaccctgttctttgtctccgaggggaaagcgccaccctctcctgcagggccagtcagagtgttggcagctacttagcctggtaccaacagaaacctggccacggcctcccaggtcctcctcactctaatgatgcactccaagacgggcccacgtggccactccccgaggcctaggttccaggtcggactaggtcggagttccgtggggaacacggtaccttctaacctctaccgactacgtcaacgctacgacctagaccgtcgtagtaacgtacgtttacgacttttatacgtcgtacgagcgagtcggttagtacgttccgtacggcccttcggacttccgttacggttcgggaaccgggtacgggaccgtagggtcgaacgtacgtaacggaaccggtagttcggtccggtacgcgtaacccgtacgtgttaccgttcggttaccttaccg

SEQ ID NO: 192051 - DNA, 755 bp, Homo sapiens
  misc_feature: GYAE6OF02GG0SW.47.59.F04.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttgtgttgacacagtctccagccacctgtctttgtctccgaaggggaaanagccaccctctcctgcagggccagtcagagtgttgacagcttacttagtctggtaccaagacgaaacctggaccaggcctcccgaggctcctcattctagtgtncactccaaacgacgggccaacgttcggtttaccccaggtccctagggtttccaagttcggactaggtcgtaccggtcggtacgggaactaaggtacggtttaccaaccgtcttaccaaaccccgtaattacccaaaacgaccggtcccgttagacccgtaaggttaccttaagggtaaacgtttagtttttacgaccgttttaagttttaacttaccgttagttaccgaacgttacgttaagttacgtacctaagttaaccggttacggtacccgtacccttaccgttaacccgttaccgggtaaccgtaaacggggaccttaaccggtaacggtacggtaacggttaaaccgttaaaccggttaacgttacgggttacggtaaccttacgggaaccctacctaacggtttaccgttaccggtttaccttaccgtactttacccccgg

SEQ ID NO: 192052 - DNA, 583 bp, Homo sapiens
  misc_feature: GYAE6OF02FHJ27.47.59.F04.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (398)..(398): a, c, t, g, unknown or other
  misc_feature (398)..(398): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctccaggctcctcatctgggatgcatccaacgagggccnctggcatcccagccaggttcagtggcagtgggtctgggacagacttcactctcaccatcagcagccgtagacgctagaagtntttgctagtttatctgtcaggctaaacgtaatcgtggtaccctcgctccgtacgtttcgggacgacgggtaccaggggttcgaacgtagttaggaaaaccgtacgttagggtcgggtacctacggacccgtaacccgtagttccgtttacggtccgttttaccgtactttcccgttaccccccgg

SEQ ID NO: 192053 - DNA, 571 bp, Homo sapiens
  misc_feature: GYAE6OF02IELCP.47.59.F04.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctcccaggctcctcatctgggatgcatccaacagggccnctggcatcccagccaggttcaggtgcaggtgggtctgggacagcttcacttcncacatcagcagcctagacgcctagaagtatttgctagtttattacgtgttacagactaaacgttaaatactaggccctccgtctctacgtttcggcggtaggaccgagggtgagtacgtacgaaacggtaacgtcggtacggtcgtacggacctaccgtacgttcgttaccggttacctttacgtacttcccgttacccccgg

SEQ ID NO: 192054 - DNA, 703 bp, Homo sapiens
  misc_feature: GYAE6OF02HVE1U.47.59.F04.1.454.CMB.1.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagtttattttgacacagtctccagccaccctgtctttgtcctccgaggggaaanacgccaccctctcctgccagggtcagtcagagtgttgacagctacttagtctggtaccaagagaacgtacggcgacgctccgacggctntccccccccccccatcgtggtagtgcactaccaacgacggcgcgtcggcgactccacgaccgtacggttacgtacggtcggcgacggtcgggttcgtacgggacgacgtacgttacgtacctacctaccgtacctaacgtcgacgacgacgtaccgtacgacgtaccgtacgtaacgttagttacgtacgttacgtttacgtttacgttacgtacgtacgtaacgtaaacgttaaacgtacgtacgtaccgttaccgtaccttaccgtaccgtttaccgggtaccgggtaacgggaccgggtacgggtacggtaacgtacgtaacggtaaccgtaacggtacggtacggtcgtacgtaccgtaccgtacgttacgttacgttccgtttactccgttacccgttacccg

SEQ ID NO: 192055 - DNA, 557 bp, Homo sapiens
  misc_feature: GYAE6OF02FQUZB.47.59.F04.1.454.CMB.1.raw
  modified_base (202)..(202): a, c, t, g, unknown or other
  misc_feature (202)..(202): n is a, c, g, or t
  modified_base (373)..(373): a, c, t, g, unknown or other
  misc_feature (373)..(373): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagaagttgtgttgacacagtctccagccaccctgtctttgtctccaggggaaangccaccctctcctgcagggccagtcagaatattcactcctacttagcctggtaccaacagaaacctggtcaggcctcccgaggctcctcatctatgatgcatccaaacgcggccacgtggcactcccagacaggttcaggtggcaggtgggtctgggacagacttcactcncacatcagcagcctagacgcctagaacgtacgtttaggtactttacgttactgttcagcgagtcgtagtagttcgtcggtccctccgtcttccgtacgtttcggggcggtacgggaccgtaggggtcgagacgtacgaaacggtacgtggtacgcgtagaccacgtattcgtcgttctctaccg

SEQ ID NO: 192056 - DNA, 562 bp, Homo sapiens
  misc_feature: GYAE6OF02I6UNB.47.59.F04.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (498)..(498): a, c, t, g, unknown or other
  misc_feature (498)..(498): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacattgttttgacacagtctccagccaccctgtctttgtctccaggggaaangccacctctcctgcagggccagtcagaatattcactcctacttagcctggtaccaacagaacctggtcaggctcccaggctcctnatctatgatgcatccaacgngggccagtggcactcccagacaggttcagtgcaggtgggtctgggacagtacttcactcgtacactatcagcacgcctagacgcctagaacgtactttggtaactttactacgttcgtacacgtcacgtacgtagctaacgtcgaccttctcgtaccgtttcgggacggacgggtaccgagggtggacgngtacgacggtaacgacgtcgggtcggcgtcgaccgtaccgtgtaccgttcgttccttacgtccg

SEQ ID NO: 192057 - DNA, 789 bp, Homo sapiens
  misc_feature: GYAE6OF02HQDTX.47.59.F04.1.454.CMB.1.raw
  modified_base (294)..(294): a, c, t, g, unknown or other
  misc_feature (294)..(294): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggcctccgaggcctcctanatcgtgggatgccaactccaacgagggcccgctcggccaactccccaaggtcccgaaggttccaggtcggaccgtaggttcggggtctaggggaacacggtacctttcacgttcctacccgaacctagtccgaagaccgtaacgtaccgttaaacgggacgtaccccgttaagggaaacggttactttttacgggaacctttaaagggttttttaactttaaccggttacggttaacgtacggtaaaccgttaaaacccggttaaaaagttccggttaccggggttaccccttacccgggttacccgtttacgtaacccgggtttttccggggaaccggggttaaccggggaacccggttaagggggtaacggtaaccgtaagttaaccgggaaaaccgttaacggtcgggtacggggtccctacgggtaccccgtaacgttaaccgttccgttaccggtttaccctttaccgtactttacccccgttaccccgg

SEQ ID NO: 192058 - DNA, 536 bp, Homo sapiens
  misc_feature: GYAE6OF02FT11E.47.59.F04.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggctccaggctcctcatctgggatgcatccaacngggccgctggcatcccagccaggttcagtggcaggtgggtctgggacagacttcactctcaccatcagcagcctagagcctagaagtagttttgctagtttattactgttcagactaacgtaaatactggcctccgctctacgtttcggcggacgggaccagggtcgactagtagaaacgacgtggtggctcgacaccgtactctacgttcttactacttcctacccg

SEQ ID NO: 192059 - DNA, 556 bp, Homo sapiens
  misc_feature: GYAE6OF02H50QB.47.59.F04.1.454.CMB.1.raw
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagctacttagtctggtaccaagagaaacctggccaggctcccgaggctcctnatctgggatgcatccaacagggccnctcggcactcccagccaggttcagtgcaggtggctgggacngacttcactctcaccataccaacncgtcctgcagtctagtaagtatttgctagtttattacgtgtctagactagtatctaatacgtcggcctctctacgttccggaccgtaagggaccacgacgtaggacgtaacgttaaacgacgtacggtacggtactcgactactacgttcctacggtccttacgtacttacccg

SEQ ID NO: 192060 - DNA, 667 bp, Homo sapiens
  misc_feature: GYAE6OF02FFGBJ.47.59.F04.1.454.CMB.1.raw
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
  modified_base (589)..(589): a, c, t, g, unknown or other
  misc_feature (589)..(589): n is a, c, g, or t
tcagagctcacgtacacgaccggtgctcgatttagtacacacacttagggattgggggaggaactgctcagttaggacccagaggaaccatggaagccccagctcagcttctcttcctcctgctactctggctcccagataccaccggagaagttatttttgacacagtctacagccacctcgtacttcgtcttccgtacgggtaacgtacggtaccgtaacccgtcctaccgtccgtaccgtacggttaccgacggtaccggtacggaccggtacggttacggtaaccgtaacgtaccgttaacgtttaaccggttaccggttaccggttaaccgtaacggttacgtaacccgtaggaccgtacgggaccgtaccggaaggttaacggtaaccggtaaggaacgtaaccggttagggtaacggtacggtacggtacgaccggaaccggacggcgtacgacgacggactccgaagcgacgtgagcgtacagtacgtgnggntaggcttacgntcacggcaancganacagacganacgcgagtacgtagtacgtacgtactactatgtacgacacatagtacacactcncacgtacgtacgacgacgacgagagagagagacgacgacgagacgacgacgacgactacgtcgtactactactcgtac

SEQ ID NO: 192061 - DNA, 757 bp, Homo sapiens
  misc_feature: GYAE6OF02HCP7A.47.59.F04.1.454.CMB.1.raw
  modified_base (200)..(200): a, c, t, g, unknown or other
  misc_feature (200)..(200): n is a, c, g, or t
  modified_base (330)..(330): a, c, t, g, unknown or other
  misc_feature (330)..(330): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccacctgtctttgtctcgagggaangccaccctctcctgcgagggtcagtcagagttgttgacagtctacgttagtctaggtaaccaaggacgaaccgtggcaggcctacccgaggcctcctcatcgtgggatgcactccgaaacgacggggccncgtcgggacctactccccgaggacccgtagggtttccaacgggttcgggacctagggtttcgggggtacctagggggacctacgtaccttccgaacttccgtacaacctaactacgacgtccgtacgtaccgtaacggacgtacccgtaggtaaacgtttagttttacggaacctttaagggtttttaacttaaccgttacggttacgaacggtaaccgtaaaagtttaaacgtaccggttaccgggacccttaccggtaccttaccgttacccggttttcggggaccgggttaaccggggtaaccggtacgggggttaacgtaaccgtaagttaaccggggtaaacgtaaccgttcgggtccggttaaccgccggttaccaaccgttagttccgtacgtttcccgtacgtacctttaccccgtccg

SEQ ID NO: 192062 - DNA, 583 bp, Homo sapiens
  misc_feature: GYAE6OF02GI9EO.47.59.F04.1.454.CMB.1.raw
  modified_base (204)..(204): a, c, t, g, unknown or other
  misc_feature (204)..(204): n is a, c, g, or t
  modified_base (404)..(404): a, c, t, g, unknown or other
  misc_feature (404)..(404): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagngccaccctctcctgcagggtcagtcagagtgttgacagctacttagtctaggtaccaagagaaacctcggccaggctccaggctcctcatctgggatgcactccaaacgacgggccacgtgggaccacgtccccgaagacgagggtttcaaggttggcgtaggtggggtctggggacaggtacttcacttctacaacctntcacgtcacgacctacgacgcctagaacgtacgtttgacttactttattactgtacagcagacgtacgactaacgcgtcctcgtctaccgtttcggacggtagggaccgagggtacgagtacgtacgaggaacggtaactggtacgcgtgaccgtacctacgtctcgttcttactaccg

SEQ ID NO: 192063 - DNA, 656 bp, Homo sapiens
  misc_feature: GYAE6OF02HYXXV.47.59.F04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagtttattttgacacagtctccagccaccctgtctttgctccgaggggaaangccaccctctcctgcagggtcagtcagagtgttgacagtctacttagtctggtaccaagacgaaacctggccaggcctcccgaggcctcctnatcgtgggatcgcataccgaaacggnggggcccnctcggcactccccgagccgtaggttcaggtgacgnggtcgggtctgggacagtaccttcacgtctaccacgatcgagctacgcgtagacgtccgtaagaacgttattttagaaagtttacttacgttgtactaacggtactaaacgttaaacttaccgtacggtccctaccggtaccttaccgttaccgtttccggggacgggtaaccgggtaccggtaggggtacgaacgtacgttaacgaaacgtacggttgggaccggtactacgacgtaaccctaagttccgttacgtttacctttaccgaccgtttccccgtaccccgtcc

SEQ ID NO: 192064 - DNA, 758 bp, Homo sapiens
  misc_feature: GYAE6OF02GWUM4.47.59.F04.1.454.CMB.1.raw
  modified_base (200)..(200): a, c, t, g, unknown or other
  misc_feature (200)..(200): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccacctgtctttgctccaggggaangccaccctctcctgcgacgggccagtcaagatattcactcctacttagcctaggtaccaacacgaaacctggtcacggcctacccgaggtcctacctcattctatgaatcgactaactaccgaacgacgggccaacgtggaccactacccgagaccgtagggttccaggttcggacgtagggttcggggtaccgttaggggaaccaaggttaccttacctaacgttccgtaaccaaccgtatccgaacggaccgtaacggtaccctaaggacccggtaccgttaagggtaaacggttaccgtttttagggtaacctttttaagttacccgttgtacccgtaagtaccgtaagggttaccggttacggtaacgttttccggtccggggtacccctttacccggtcctttacccggttaccgggtttaccggggaccggggttaacggggtaccggtaagggggtcgaacggttacgtaaccggaaaacggtcgttgggtacggaccttacgggactaaccgtcttaccggttactttaccggttactaccttaccccgg

SEQ ID NO: 192065 - DNA, 530 bp, Homo sapiens
  misc_feature: GYAE6OF02G27TB.47.59.F04.1.454.CMB.1.raw
  modified_base (203)..(203): a, c, t, g, unknown or other
  misc_feature (203)..(203): n is a, c, g, or t
  modified_base (455)..(455): a, c, t, g, unknown or other
  misc_feature (455)..(455): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagattccaccggagacattgttttgacacagtctccagccaccctgtctgtctctccaggggaaanagccaccatctcctgtagggccggtcagagtattagcatcaacttagcctggtaccagcagagaccgtgggcaggctcccgaggctcctcatctatgatgcgtccaccagggccacgtcggttcccagcctaggttcagtggcaggtgcgtcgtgggacagagttcactctcacctatcaacacgcctgcagtctagtaagtatttgactagtttattacgtgtacagtctagtatctaataacgtcgtccnctctaccgttcgaccgaaggcacgactggacgtaagtaaacgtacgtggtcgagtcgacacgtatctgtcttacg

SEQ ID NO: 192066 - DNA, 823 bp, Homo sapiens
  misc_feature: GYAE6OF02FKJUZ.47.59.F04.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagagaaacctggccaggcctcccgaggcctcctcatctggggatggcatcccaacgcggggccncgtggccacgtcccgaagcccgtaaggttcagggtcggacgtaggttcggggtcgtaggggacctaggtacctttacgacgttcctacccaaccccgtaattcccgaacgggccctaacggacccgttaaaggtaaccggtaccccgttaagggtaaacggttaacgttttttcgggaaccgtttaaggtttttaaacgtttaaccgtttacggttaccgtaacgtaacccgtaaaaccggtttaaaaactttaaccggttaccggggtaccccctttacccggtacccgtttacccggttaaacccggttttttacccgggggaacccggggggttaaccggggtaaacccgggttaacggggggttacgggtaaccgtaaggttacccgggaaaacgggtaaccggtttacggggtacgggtaccgttacggaacccgtaaccgttaacgttccggttaccgtttcccgttacgttaccgtttcccgttaccccccgg

SEQ ID NO: 192067 - DNA, 761 bp, Homo sapiens
  misc_feature: GYAE6OF02IA6RA.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagtttattttgacacagtctccagccaccctgtctttgtctccgaggggaaancgccaccctctcctgcgagggtcagtcagtagtgttgacagcttacttagtcgtaggtaccaagacgaaacctggaccaggcctcccgaggcctcctacgattcgtagggatgacctactacccgaaacggacggggcccgtacgtcggacctacgtaccccgaggccgtaggttacaggtcggacgtagggttcggggttacgtacggggactaacggttaccctttacgaaccgtttccctaaccaaccctacgttaccgacgtaccggtaacgtacccgtaaggtaccggtaccgttacggtaaacgtttacgtttttacggacgtttaaacggtttttacgtttaaccgttacggttaaccgtaacggtaaaccgtaaaacgtttaaacgttaccggtaccggtacccttaccggttacccgttaccgttaccggttttaccgggacgggtaaccgggtaaccggtagggtacgacgtacgtaacggaacgtacgtcggtcggactacgacctacgtacgttacgttcgttactacttaccttccgtacccg

SEQ ID NO: 192068 - DNA, 668 bp, Homo sapiens
  misc_feature: GYAE6OF02G60K3.47.59.F04.1.454.CMB.1.raw
  modified_base (376)..(376): a, c, t, g, unknown or other
  misc_feature (376)..(376): n is a, c, g, or t
tcagagctcacgtacacgaccggtgctcgatttagtacacacacttagggagttggggggaggaactgctcagttaggacccagagggaaccatggaagccccagctcagcttctcttcctcctgctactctggcctcccagataccatcggagaagttgtgttgacacagtctccacgcccaccctgttctttcgtcctaccgaaggggaaagacgcccacccctcctcctgcgagggccagtcagaatatacacctcctacttacgcctaaaaaaaaaaaaacggtccaaacaagaaacctggtacaggctccccaggctcctcatctatgatgcatccaaacaggccactcgggcactcccacgacacggttnagtggcaggtgggtcgtagggagagtacttcactctaccaccactacacgcacgactacgacgtccgtaggaagtacgtttacggtaaccttttattacttagtaccgataccgagtaccgttggtacgttcgtccggtacccgtcccggccttaccgtaccggttttccggggaccggaacgggggtacccgtaggggtacggggaagtaaccggtaacggtaaaaccggtacgtagggttacggtaccggtacgaacccgtaccgtaatccgttacggtccctttaaccg

SEQ ID NO: 192069 - DNA, 687 bp, Homo sapiens
  misc_feature: GYAE6OF02IBXX0.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggagaactgctcagttaggacccagagggaaccatggaagccccagctcagcttctcttcctcctgctactctggctccagataccatcggagaagttgtgttgacacagtctccagccaccctgttctttgtctccgaggggaaancgcccaccctctccctgccagggccagtcaagtaatattcaccttcctacttagccttaggtaccaacagaaacctggtacaggcctccaggcctcctctatcgtggatcgactatacccgaagcgggccgcgtcggacctacgtccccagcccgtaaggttcgaaggttcggacgtagggttcggggtccggtaggggaccaacggttaccttccgaccttacctaccaccctataccacggccaacgcccgttaaggaccgtaccgtaaggtaaacgttagttttacgacgtttaagttttacttaaccgttcggtacacgttaacctaaaacgtttaaactccggttacggtccctaccggtctaccgttaacggttccgggacgggtacgggacgtaggggtagactacgtaggaaaccgtgtacggtcggtccgttacgacctaaccgattccgtttacgtccttacctacgttccccg

SEQ ID NO: 192070 - DNA, 735 bp, Homo sapiens
  misc_feature: GYAE6OF02HA8WY.47.59.F04.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaanagccacctctcctgcagggtcagtcagagtgttgacagtctacgttagtctaggtaaccaagagaaacctggaccaggcctccaggcctcctanactcgtggggatcgactactacccgaaacgacggggcccngtcggactaacgtccccgaagccgtaaggttcaggtcggctaacggttggggtctcggggactacggtacttcgacttcgtccaaccgtattcccagcctaacggacctaacgacgtcccgtaagaacgtttacgttttcggactttaacggttttacttaacccgttgggtacctaaggtaacccgttaaaaacgttaaactttaccggtaccggtaccccgttacgaccgtttaccgttaaccggtttcccgggtacggggtaacgggtaccccgtaaggggtaccgtaaccaggttacggaaaacccggttaggttcggtaaccgggtacgtaacggacctaaccggttacgttaccgttaggttacccctttaactccgtttccccgtaccccgg

SEQ ID NO: 192071 - DNA, 729 bp, Homo sapiens
  misc_feature: GYAE6OF02IXFCO.47.59.F04.1.454.CMB.1.raw
  modified_base (202)..(202): a, c, t, g, unknown or other
  misc_feature (202)..(202): n is a, c, g, or t
  modified_base (722)..(722): a, c, t, g, unknown or other
  misc_feature (722)..(722): n is a, c, g, or t
tcagagctcacgtacacgaccggtgctcgatttagtacacacacttagggagttgggggaggaactgctcagttaggacccagagggaaccatggaagcccagctcagcttctcttcctcctgctactctggctcccagataccaccggagaagttattttgacacagtctccagccacctgtctttgtctccaggggaaangccaccctctcctgcagggtcagtcagagtgttgacagctacttagtctcggtaaccaaggacgaaacctggaccaagggtcctacccgaagggccttccctcaacttccggttggggaacttcggacctaacgttacccgaaacgacgggggcccctacgttgggacctaacgttccccgaaaggtccccgtagggttttacccaaggttcggggcctaacgggttccgggggtacttacggggggacctaagggtaaccctttcgaaccttccgtaccgaacctagtaccacgggaccacggtcctaacggacgtacccgtgaaacggttaccttttagggaacttttaacggtaccttggtacccttaagaccgtaacggtccgtagttacgtttccgtcggtacccgttccgcttacgtaccgttttacgggcggggttaacgaccgtaagggtcgatacgacgtaacgtacgtagtcgggaactcggacctaacgtctaccgttcgtacgttacngttcccg

SEQ ID NO: 192072 - DNA, 573 bp, Homo sapiens
  misc_feature: GYAE6OF02H32F7.47.59.F04.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (286)..(286): a, c, t, g, unknown or other
  misc_feature (286)..(286): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (444)..(444): a, c, t, g, unknown or other
  misc_feature (444)..(444): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagacatttgttttgacacagtctccagccaccctgtcttgtctcagggaaanacgccacctctcctgcagggccaggtcagngtgttggcagctacttagcctggtaccaacagaacctggccaggctccgagctccnatctatgatgcataccaagacgggccacgtgggacctactcccagccctaggttcagtgctagtgagtcgtagggacagactcactctcaccatcagcacncagngctagaagtacgtttaggactttattactgtcagtcgagtcgtagacgttcgnggtcctaccgcttcgtaccgtttcgggacgggacgggtacctaggggtcggaagtaacgttaaccgaaaccgggtaacgttcggacggttaccgtacggaccctaaccgtaacttccggttacttaccg

SEQ ID NO: 192073 - DNA, 542 bp, Homo sapiens
  misc_feature: GYAE6OF02GSHAN.47.59.F04.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtctccagccaccctgtctttgtctcaggggaaangccaccctctcctgcagggccagtcagaatattcactcctacttagcctggtaccaacagaaacctggtcaggcctcccaggcctcctcatctatgatgcatccaacncgggccacgtggcactcccagacaggttcaggtggctaggtgggtctgggacaggtacttacactctacacctntacacgcgacgcctagacgtacgtagtaagtatttgactacttttacttacttgtcagctagtcgtagacacgtcggtcctctctacgttcggcggtaggacgagggtggagtcgtgacgacgtacgtggtcggtctcgacctacgacttcgtgttcc

SEQ ID NO: 192074 - DNA, 579 bp, Homo sapiens
  misc_feature: GYAE6OF02GX278.47.59.F04.1.454.CMB.1.raw
  modified_base (240)..(240): a, c, t, g, unknown or other
  misc_feature (240)..(240): n is a, c, g, or t
  modified_base (417)..(417): a, c, t, g, unknown or other
  misc_feature (417)..(417): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgtgacngctacttagtctggtaccaagagaaacctggccaggctcccgaggcctcctcatcgtgggatgcactccaacgagggccgcgtgggccacgtccccagccaggttcaggtggcaggtcggggtctggggacagacttcacgtctaccactatcagcacgcctagacgcctagaagtntttgactagtttacttactgtacacgtactaaacgtaatacgtcggtccctacgctcgtacgtttcgggacggtacgggaccgtacgggtgacgagtacggaaacgacgtggtacgcgtcgacctacctacgttcgtgttccttacgtacctccgttccccg

SEQ ID NO: 192075 - DNA, 563 bp, Homo sapiens
  misc_feature: GYAE6OF02HGY3R.47.59.F04.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (485)..(485): a, c, t, g, unknown or other
  misc_feature (485)..(485): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggccagtcagaatattcactcctacttagcctggtaccaacagaaacctggtcaggctcccaggctcctcatctatgatgacatccaacngggcccacgtggcatcccagacaggttcaggtggctaggtgggtctggggacaggtacttcactctcaccatcagcagcctagacgcctagaacgtacttgactttattactcgtctacgcagcgtgtcgttctgtcccgtccgctcgtacgtttcgggacggtacgggaccgnggggtggagacgtacgaaacggtacgtaggtcggcgtcgacctaccgtacgttccgttcgttcttaccgtattccccg

SEQ ID NO: 192076 - DNA, 753 bp, Homo sapiens
  misc_feature: GYAE6OF02IYKPT.47.59.F04.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (684)..(684): a, c, t, g, unknown or other
  misc_feature (684)..(684): n is a, c, g, or t
  modified_base (712)..(712): a, c, t, g, unknown or other
  misc_feature (712)..(712): n is a, c, g, or t
tcagagctcacgtacacgaccggtgctcgatttagtacacacacttaggagttgggggaggaacgtgctcagttaggacccagagggaaccatggaagcccagctcagctctcttcctcctgctactctgctccagataccaccgagtaagttattttgacacagtctccagtccacctgtctttgctccgagggaaangccacctctccgngcaggtcagtcagngtgttaganacgcttacgtacgtctggtaccaaggtacgaaaccttggaccacgggcctaccccgaagggccttacccgtactagttcggtacggggtatactaccgaaccgttcccgaaacggaccggggttcccgcggtttaccggccgtaaacccgttaccccggacggtaccccggttaacggtttaccgaacggggttcggtaaccggtaacggggttcgggggttacccgtaggggggaaaacctacggttaacccctttcggtacccgttaccgtaacccgtaacccgttaaccgtcgtaaccggggaccttaccgtaaccgttaaccgtacgaccgttaacggaacgtttacgtttacgacgtttaacgtttacgttagtccgttatacgtacgtaaacgtacttagaccgtctccgtacgttcagttcggtacggacgttaggcggaanacgtagtacgaagtaccgtggtaccggntacgactacgttagtcgtacgttcacttacgcccgttaccg

SEQ ID NO: 192077 - DNA, 776 bp, Homo sapiens
  misc_feature: GYAE6OF02FTWZX.47.59.F04.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagngccaccctctcctgcagggtcagtcagagtgttgacagctacttagtctggtaccaagagaacctggaccaggcctccgaggcctccncatcgtggggatcgctactccaaacgcggggcccngttacgggcacgtccccaggtccctaagggttccaaggttcggctagggtcggggtcgtacgggggactaagggtaccctttccgaccgttcctacccgtaacctaacgttacccgaacgggtacccaacggtaccccgttaacgggaaccgttccccgtaaggttaaacggttacggttttttaccggtacgtttaaacgtttttaacgttaaccgtttcggttaccgtaacgtaaccgtaaaccggttaaaacttaccggttacggttaccccgttaccggtccgtttaccgttaccggttttaccgggacggggtaaccgggtaccggtacggggttcgaaccgtacggtacggaaaccggtaaccggttagggtaccgtacggtacgtacctaaccgttcgttacggttaccgttccgttaccgttacccgttcccgttaccccg

SEQ ID NO: 192078 - DNA, 578 bp, Homo sapiens
  misc_feature: GYAE6OF02F9PZ6.47.59.F04.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggccaggctccaggctcctcatcgtgggatcgctactccaacgngggcccncgtggcactcccgagcctagggttccaggtggcaggtcggggtctaggggacaggtacttcactctacacctatcacgcacgcctagcgcctgaagtagtttcgtacttagtttattactgttacacgtactaaacgttaaatactcggcctccgcttctacgtttcggcggtacgggacgtacgggtagacgtagtagaacgtacggtggtacggtctgaccgtactactcgtgttccttcgtacttccctacccg

SEQ ID NO: 192079 - DNA, 758 bp, Homo sapiens
  misc_feature: GYAE6OF02JJBM0.47.59.F04.1.454.CMB.1.raw
  modified_base (86)..(86): a, c, t, g, unknown or other
  misc_feature (86)..(86): n is a, c, g, or t
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
tcagagctcacgtacacgaccggtgctcgatttagtacacacacttagggagttgggggaggaactgctcagttaggaaaaacccngagggaaccatggaagccccagctcagcttctcttcctcctgctactctggctcccagataccaccggagaagttattttgacacagtctccagcccaccctgtctttgctccgaggggaaangccaccctctcctgcgagggtcagtcagagttgttnacagccttacgttagtcgtaggtaccaaagacgaaaccgtggaccaggcctacccgaggcctcctcatcgtggggattcggacactacccgaacgacgggcccgcgtcggcctaacgccccgacggtcctacgggttcacgtcgggccacggttggggtaccgtagggacgtaacggttcccttacgtacctctaccgaccctagtccccgagccgtaagcccgtagtaccgtaccgtacggtaacgtttacgtttcgaccggtttagtttaaccggttaccttcggttaccgaaaccggtaaccgtttaaaccgtaaaacgttcccggtacgggtaccccttacccgtccgtttaccgtaccggttttacccggggacgggtaaaccggggtcgtacgggggtaacacgttaacgttaccgggaaaccggttacggtcgggttaccggtaacgcggtacccgtaacttaccggtacgttccgttacgtacccgttacgtcccggttacccgg

SEQ ID NO: 192080 - DNA, 874 bp, Homo sapiens
  misc_feature: GYAE6OF02ILUEK.47.59.F04.1.454.CMB.1.raw
  modified_base (208)..(208): a, c, t, g, unknown or other
  misc_feature (208)..(208): n is a, c, g, or t
tcagagctcacgtacacgaccggtgctcgatttagtacacacacttagggattgggggaggaacgtgctcagttaggacccagagggaaccagtggaagccccagctcagcttctcttctcctgctactctggcctcccagataccaccggagaagttattttgacacagtcctccagcccaccctgtctttgtcctcgagggaaagngcccacccttctccgtgcgacgggtcagtcaggtgttgtagactaggcttaacgttagtctagggtaaccaagacgtaaaacccgtggacccgaaggcctaccccggaggtcccctttcccgaccgtaagtccggttaggggacttcggaccctaacgtacccgaaacgcggggtaccctccgttgggacctaacgtcccccgaaggtcccgttaaacgggttccgaaaggggttccgggacgtaacgggtttccgggggtacttacgggggaacgtaccggttaacgtttcccgaactttccgtaacccgaaacgtacgtccgaagtaccggtaacgtacgtaacggtacgtacccgttagtaacgttaccgttttacgacgttaacggttttaaccgttcgttaacggttaccgtaacgtaacctaaaaccggtttaaacgtaccggtttaaccgggttaccctaccggttaccttacccgggttaaccgttttcccggggaacccgggttaccgggtaacccgggtacgggttaaccggtaacggtaccggttaaccgggtaaaacggtaccggttaccgggtaacgggtccgtaacggtacccgtacgttaacgttaccggtacgtttaaccggttaccgttacccgtttacccgttccccg

SEQ ID NO: 192081 - DNA, 809 bp, Homo sapiens
  misc_feature: GYAE6OF02IAY0G.47.59.F04.1.454.CMB.1.raw
  modified_base (205)..(205): a, c, t, g, unknown or other
  misc_feature (205)..(205): n is a, c, g, or t
  modified_base (325)..(325): a, c, t, g, unknown or other
  misc_feature (325)..(325): n is a, c, g, or t
tcagagctcacgtacacgaccggtgctcgatttagtacacacacttagggattgggggagaactgctcagttaggacccagagggaaccatggaagccccagctcagcttctcttcctcctgctactctggctcccagataccaccggagaagtttattttgacacagtcctccagcccaccctgtctttgtctccgaggggaangccaccctctcctgcagggtcagtcagtagtgttgacgagctacttagtcgtggtaccagcaggacgaccgtgggacagggcctcccgaggtccctcctcacttacctagttacgggtcnccgtaaccgttaccccaaccggtacggggcccctaacggttcgggttaacctccccgaggtaccccgtaaggtttccgaagggttcggaccgtaggggttcggggttaccggtacggggtaaccaagggttaccggttaccctaccgtttaccgtacccgaacccgtagttacccgaacggtacccgtaaccggtcccgttacggtaacccgttacgggttaccgttaacgggttaaaacggttttacgttttacggtaacccttttaaacgttttttaaaccgtttaaaccgtttacggttaccgtaacgttaccgtaacgtaccggtacgtaccgtaaccggttcgtaccccgttacgttaccgttaccgtttccggggacgggtaccgggtaccggtagggtacggacggtacgtacggaacggtaacggtaccgttaggtcggtaccgtacgtaccctaacgtacgttcgttacgttccg

SEQ ID NO: 192082 - DNA, 807 bp, Homo sapiens
  misc_feature: GYAE6OF02HN0FJ.47.59.F04.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagatacccacggagaagttattttgacacagtctccagccaccctgtctttgtcctccaggggaaancgccaccctntcctgccgagggtcagtcagngtgttanacagtccttattagtctaggtaccaagagaaaccgtgggaccaaggccttcccgaggtcctacctacgacttcggtgggtatagccctaacttacccgaaaaccgtcggggacccctcggtcgggacctaaccttccccggaccggtacccgtaaggggtttaccgaaggttacgggccgtaagggttcgggggttaacctcgggggaacctaaccggttaccctttaccgaaccgttacctacccgaacccgtaattcccggaagaccctaccggaccgttaacggaccgtacccgttaaggtaaacgttacgttttcgacgtttaagttttacgttaacgtacgttaccgtacggtaactaaacggttaaactaccggtacggttaccctacccggtccttaccggtaaccggtttccggggaccgggtaaccggggaccgggtaacggggtacggtaacgaacgtaacggtaaccggtaaccggtacggtaccggtacgtcggtacccgaccgtacgttccgttacggttccttaccggtacccgttcccgtttaaccccgg

SEQ ID NO: 192083 - DNA, 625 bp, Homo sapiens
  misc_feature: GYAE6OF02GH7ZL.47.59.F04.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaccngttttttcagctccagctcctcatctggatgcactaccaacgacgggccgcgtggcactcccacgcctacggttcgagtcggcgtaggtgggtcgtgggacgacgtacttctactctacctaccactacgacgacacgacctacgacgtacgtagtaagtatttacgtacttaactttacttacttcgttactacgtacgacgtacgtacgacgaacgtcgtacctccgtacgttaccgtttcgggtacgggacgggtacggtacgggtacggtacgtacgtacgtaacggaacggtaacgttaggtacggtacgtacggtaccaccgtacgttcgttacgttccttacttacccg

SEQ ID NO: 192084 - DNA, 593 bp, Homo sapiens
  misc_feature: GYAE6OF02IMIRK.47.59.F04.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (452)..(452): a, c, t, g, unknown or other
  misc_feature (452)..(452): n is a, c, g, or t
  modified_base (541)..(541): a, c, t, g, unknown or other
  misc_feature (541)..(541): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccaccggagtaagtattttgacacagtctcagccacctgtctttgtctcaggggaaangccacctctcctgcacggccagtcagagtgttgcagccttacgttagcctggtaaccaacgagaaacctggccaaggctacccgaggccttacctcatccttatgaatcgctataccgaanacgggccacgtcggctactcccagcctaggtcagtgcagtgatcgaggcagacttcagttcaccatcgtcagcgagtccagctccgtagactacgtttcgactacgttttatacgttcgtactacgtaccgnggtaccgtaacgtaccgacgtccggtacctacgtaccgtaaccgtttccgggcgggttaaccgggacgtacggggtaggacgttaacgnggaaacgtaccgtaacggtggttcggactgcctaacctcgttccgtcgtacc

SEQ ID NO: 192085 - DNA, 738 bp, Homo sapiens
  misc_feature: GYAE6OF02HHJ6V.47.59.F04.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
  modified_base (705)..(705): a, c, t, g, unknown or other
  misc_feature (705)..(705): n is a, c, g, or t
tcagagctcacgtacacgaccggtgctcgatttagtacacacacttagggagttgggggaggaactgctcagttaggacccagagggaaccatggaagccccagctcagcttctcttcctcctgctactctggctcccagataccaccgganaagtttattttgacacagtctccagccaccctgtctttgtctccgaaggggaaanacgcccaccctctcctgcagggtcagtcagagttgttagacagtcttacgttagtctaggtaccaagaacgaaaccgtggaccacggcctaccccgaggtcctcctcagttcgtgggacttgacctactacccgaaacggcggggccccgtacgtcgggccaccgtccccgaaggtccccgtaggtttccgaggtcgggccgtagggttcggggtacgtaggggactacggtaccgttcctaccttccgacctaccgactccgaggtccctaacgtaccctaaggacccgtaccgttaaggtaacgtttacgttttcggactttaacggtttttacttacgttcgtaactacggtaaccttaaacgttaacttccggtccgggccccttaccggtacccttccgttaacggtttcccggggacgggtaccggtacggtacggggtacgaacgtaggtaacgggaaactcggttaggccggtcctacgaccctaccgtntcggttacgttaccgttactaccgttctacccg

SEQ ID NO: 192086 - DNA, 778 bp, Homo sapiens
  misc_feature: GYAE6OF02JNNAT.47.59.F04.1.454.CMB.1.raw
  modified_base (114)..(114): a, c, t, g, unknown or other
  misc_feature (114)..(114): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (392)..(392): a, c, t, g, unknown or other
  misc_feature (392)..(392): n is a, c, g, or t
  modified_base (633)..(633): a, c, t, g, unknown or other
  misc_feature (633)..(633): n is a, c, g, or t
tcagagctcacgtacacgaccggtgctcgatttagtacacacacttagggagttgggggaggaactgctcagttaggacccagagggaaccatggaagccccagctcagcttcncttcctctgctactcgtggctcccagataccaccggagtaagttattttagacacagtctccagccaccctgtctttgctccgaggggaangcccaccctntccgtgcgngggtccagtcagtgtgtcgacacgtctacttagcgtaggtaaccagaacggaaccctgggaccctaggtcctacccgaggtccctcctacagttcgtacggggataccgcgtaactaccccggtaaaagccggggtcccgtcgttaaccggaccaccgttaaccccgnggtaccccgaagggggttttacccagggttccgggaccttacggggtacgggctttacgggggacaaccgttttccgttcggaaccgtttacccgtccccaaacgtaccgttacgaacgggtcccgaagtacccgtaacggtaaccgtccggtacggtaaacgttacgtttagtaccgttaggttttacttacgttacgtagacgtaactaacgttaaacgtacctaacgtcccgttaccncgttaacctggtttaccgggcggttaacggacggttacgggtacgagtaacggacggtaaacgcggttaacggcgggtacctaacgtccgtaacccgtaccgtttacgtacggttaccctttacgaccgttacccgttaacccgg

SEQ ID NO: 192087 - DNA, 604 bp, Homo sapiens
  misc_feature: GYAE6OF02GCC8V.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaagngccaccctctcctgcagggtcagtcagagtatagcagcaacttagcctggtaccagcaagaaacctgggacacggctcccgaggcctcctcatctagtggtcgcactccaccgagggccacgtcggtactcccgagtccctaggttaccaggtcggcgaggttgggtctggggactaggtacgttcactctcgaaccatcacgctacgcctgcgtagtcgtgtaagttatttcgcttaagtttacttacgtcgtactagtactagttactactaagttaacgtcggccgtactccgtaccgttccggaccgtaaagggaccgtaccgacgttggaacgttaacgttaaaccgaagttcggtacgtcgtacggccacgtacttcgttcgtacttctaccg

SEQ ID NO: 192088 - DNA, 596 bp, Homo sapiens
  misc_feature: GYAE6OF02GYN5O.47.59.F04.1.454.CMB.1.raw
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtcctccgaggggaaagacgccaccctctcctgcacgggtcagtcagagtgtgacagctacttagtctgtaccaagacgaacctggaccaggcctaccgaggcctcctnacgtcgtgggatcgacatccaacgcggccncgtggcactcccgagccgtaggttcaggtcggcgaggtgggtctgggacagtcttcnctcncacntacgnccagctagcgctagtagttatttgacttagtttatcgtagtctataacgtaacgtaaatcgccggtccttcgtcttacgtaccgttcggggacggtacgggaccgtagggtcgaaccgagtacggaacggtacggtggttacggactaccgaccgtaccgtcttcggttaccttaccgtaccttacgtcccgttacccg

SEQ ID NO: 192089 - DNA, 714 bp, Homo sapiens
  misc_feature: GYAE6OF02GWY2J.47.59.F04.1.454.CMB.1.raw
  modified_base (205)..(205): a, c, t, g, unknown or other
  misc_feature (205)..(205): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaagngccaccctctcctgcagggtcagtcagagtgttgacagctacttgtctggtaccaagacgaaaccgtggaccaggcctcccgaggtcctcctcatctatgatgctactaccgaacgcgggccacgtcggctactcccgaagactaggttcaggtcggctaggtcgggtacgnggacncgtctacacgtcacacngtaccgacgccgacgaccgtacgacgtccgtaagttagttacgttttcgtaacgtttaaccttttaacgtttaccgttacgttacgtaacgtacggtacggtcgttcggttacggtttccgttccgggtacccgtttccccgttccgtttacccgttacccgggtttttaccggggaccggggttaaccggggtaccgggttaacgggggttacgggtaaccggtaacggtaaacccggttaaaaccggttaacggttacgggttacggtaccggtacggtcctaaccgtacgtttcgttacggtttccttaccg

SEQ ID NO: 192090 - DNA, 728 bp, Homo sapiens
  misc_feature: GYAE6OF02ILBCW.47.59.F04.1.454.CMB.1.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
tcagagctcacgtacacgaccggtgctcgatttagtacacacacttagggagttggggaggaacgtgctcagttaggaccagagggaaccatggaagccccagctcagccttctcttcctcctgtcctactctggacctccagactacccaccggtagaagtttattttagacacagttcctccagcccacccgttgtctttagtcctccgaggggaaacncgcccacccttctcctgccgaggccagtcagtaatnttccacgttcctacgttagcctacggtaaccaacagtaaaccgtggtaccgaggtccctccgaggtcctccgtacgaattcctaagtcgaactgtctaacgtacccaacggtacggcccaacgttcgactaccgtacccgagaccgtacggttnaagggtcgacggtcgttaggggtctacggggaaccttaagtacccgttacaaccttcgttaacgaacccngtttaccacgtcacgtacgtacgtacgtaccgtaggtaaacgttcgttaacgttacgtttagttacgtacgtcgtaacgtcgacgtgtacgttagttccgtaggccgttaccgtcgtaccttacggttccgtacggtacgggtacgtacggggtagtacgtacgtaaccggtaacctacggttacgtcggtaccgtacgtccgaccgttaacgttccgttacgtttaccgttcgttaaccgttcccg

SEQ ID NO: 192091 - DNA, 653 bp, Homo sapiens
  misc_feature: GYAE6OF02IOVRF.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaanagccaccctctcctgcagggtcagtcagagtgttgacagctacttagtctggtaccaagagaaacctggaccaggcctcccgaggcctcctcatcgtgggattcgcactaccaacgacggggcccgctgggccactccccgaggccctaagggtttccaagggttcggcgtaggttcggggtctggggaactacggacctttcgacttcctaccaacccgatccgaacgccagtccctagacggtcctagaaacgttattttgacttagttttaacttacgttgttcgaagtacctaaacgttaaacttacgttcggacccttcccgtcttaccgttacgtttccgggacggtaacggggaccgtagggttaaccggacgtagtacggaaacgtacgtggtacgcgtcgacaccgtacttcgtacgttccttactaccgttccgtacccg

SEQ ID NO: 192092 - DNA, 706 bp, Homo sapiens
  misc_feature: GYAE6OF02GFLI9.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagatacccaccggagaagttattttgacacagtctccagccaccctgtcttgtctccaggggaaangccaccctctcctgcagggccagtcagaatattcactcctacttagcctggtaccaacagaaacctggtacaggctcccgaggcctcctcatctatgatgacatccaacgacgggcccacgtggccactcccaagtacctagggttccaaggttcggacgtaggttcggggtacgtaggggacctaggtaccctttcaaccttccgtaccaaccctatccaacgccaacggtccgttaagacgtccctaggaaacgttaccgtttaggtaacttttaacgttaccgtgttacacgtcctacgggtcgttacggtacgtttccgtcgggtccccttcccggtaccttaccgttaccgtttcggggaccgggtaacgggtacccggtaaggggtacggaacgtacgttaaccgaaacccggttacgttaccgggttcggtacccgtacggtacctaacccgttacgttaccgttccggtttacctttaccgtaccgtttcccccg

SEQ ID NO: 192093 - DNA, 827 bp, Homo sapiens
  misc_feature: GYAE6OF02JA14V.47.59.F04.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (368)..(368): a, c, t, g, unknown or other
  misc_feature (368)..(368): n is a, c, g, or t
  modified_base (479)..(479): a, c, t, g, unknown or other
  misc_feature (479)..(479): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctccagataccacggagaagttattttgacacagtctccagccacctgtctttgtctccgaggggaancgccaccctctcctgcgagggtcagtcaagnggtgttagactagccttacttaggtccttacgggtaaccaaggtaacgaaaccgtcggaccaaggtcctacccgaggtccctcctacgtacttccggtgggtactcggacctaactcccgaaacggcggggtacccncggtcggacctaccgtcccgacggtacccgtaggttcgagggtcgaccggtaggttcggggtactacggggaacacggttacccgttcaccggttactacccaacccgttntaccgacgtacgtaccgtacccgtaacggtaaccggtccgttaaacgtaaggtttaccttttacggtaaccggtttaacggttttacgtaccggttaagttacccgggtaaacgttaacccgttaaaaaccggttaacgttaccccgggttaccgggttaccctcccggtttacctaaccgggtttaaacccgggttgggggacccggggttaaacggggacccgggtaggggttaaccgaccgttttaacgggaacgtaaaaccgggtgttaaccggggggtcacggttacccgacgttaccgtagttaccgttccgttacgtttaccggtacctttcccgtacccg

SEQ ID NO: 192094 - DNA, 651 bp, Homo sapiens
  misc_feature: GYAE6OF02FM8DL.47.59.F04.1.454.CMB.1.raw
  modified_base (205)..(205): a, c, t, g, unknown or other
  misc_feature (205)..(205): n is a, c, g, or t
  modified_base (322)..(322): a, c, t, g, unknown or other
  misc_feature (322)..(322): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagcccaccctgtctttgtctccgaggggaaangccaccctctcctgcagggccagtcagatattcactcctacttagcctggtaccaacacgaaacctggtcaggctcccgaggcctcctcatctatgatcgcactccaacgcgggccncgtggcacgtccccagtcccaggttcaggtcggctaggtgggtctggggactaggtactttcacttctaccaccataccgacgcgtacgccgtagacgtaccgtaggtaacgttagtttagacgttaagttttacttaccgttgttacgaacgtactaaacgttaaactaccgttcggacccttaccgtcgttacctacgttttccgggacgggtacgggtaccgtagggtacggacgtacgtacgaaacggtacggttggtcggtaccgtacgaccgtaaccgttacgttaccgttcggttcctttaccgttacgttacccgttcccg

SEQ ID NO: 192095 - DNA, 794 bp, Homo sapiens
  misc_feature: GYAE6OF02HSWJX.47.59.F04.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
tcagagctcacgtacacgaccggtgctcgatttagtacacacacttagggattggggggaggaactgctcagttaggacccagagggaaccatggaagccccagctcagcttctcttcctcctgctactctggctcccagattccaccggagactattgttttgacacagtctccagccaccctgtctttgtctccgaagggaaancgccacctctccngcacgggccagtcagtgtgtgcagctactagccgtaggtaaccaacgaacgtaaaccgtcggaccaacgggtcctaccccgaaggtcctccctacgtaacttcgtaaactacgaactcggtaccaacgttaacccgaaaccggaaccggggacctaccggtacggacctaccttaccccgacggtacccgtacgggtttcaacggttcggaccgtaggtacggagtttaccggtaacgggaaccgtaagttaccgttaacgaaccctttacggaccctaaaccgtaagttaccgaacgtacccgtaaacggtacccgtaacggtaaccgtaccgttaaaggtaaacgttacgttttaccggtccttaaacgttttaacgttaccgtagttaccgaagtacgtaacggtacgtaaaccggttaccaaacggttcccggtaccgttaccttaccgggtttacggttaccgggaccggggtaacgggtacccgtagggggtcgaaacgtcgtaacgggaacggaaccgttaacggtgggtacgtaccgtcggacctaaccggttacttcggttaaccg

SEQ ID NO: 192096 - DNA, 817 bp, Homo sapiens
  misc_feature: GYAE6OF02I7SEL.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacacagtcctcagccaccctgttctttgctccgaggggaanagcccaccctctccgtgcgtacgggccaaggtcaacgtaattattccgaactccttaactttaggccttacggtaaccaacacggtaaacctggttacaacggcttaccccgaggtacctcccctacgtattacccttaatcgtaacgtcgtacctacttacccgaaacggtacgggtacctacgtcgggaacctaccgacccctaagaccggtaggtttacagggtaccggcggttaacggtcggggtaccgttacggggaacctaaggtaaccgtttaccgaacctttaccggtaccctaaaccgtacgtttccgaaacgtccaacgtacccgttaggaaccgtaccgttacggaaatttaacccgggtttacgttaaacttttaaccggtttaccgtagtttaccgacggttacgtacggttacccgttgggtaacgtttcccggtacgttaccccgaccgtttccggtacccttaacgggtttaccggggacgggaccgggttaacggacgggggtttagaacggttccggtaaaaccgaacggttacccggtagggtcccggtaggttacccgacgtacccggtatttaccgttagttcccgttaaccg

SEQ ID NO: 192097 - DNA, 631 bp, Homo sapiens
  misc_feature: GYAE6OF02HQDQO.47.59.F04.1.454.CMB.1.raw
  modified_base (206)..(206): a, c, t, g, unknown or other
  misc_feature (206)..(206): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagagctcacgtacacgaccggtgctcgatttagtacacacacttagggagttgggggaggaactgctcagttaggacccagagggaaccatggaacgccccagctcagcttctcttcctcctgctactctggcctcccagataccaccggagaagtttatttgacacagtctccagccacctgtctttgtctccgaggggaaancgcccaccctctcctgccagggtcagtcagtcgtgttgacagtctacttagtctaggtaccaaggacgaacctggaccaggcctcccgaggcctcctcagtcgtgggactgctactccgaacgcgggccctctcggccacgtccccaggccctaggttcaggttggcaggtggtcgagggactagtacctcaacttcncaccatcgagccacgctacgngcctagtacgtagtttgacgttacgtttatacgttagtctacgtactaacgtaactacgtcgtccgtaccgtcctacgtaccgtttcgggacggtacgggtaccgtacgggtacgtacgtacgtacgtaaaccgtacggtggtacgtacgtacggtacctaccgtacgttccgttacgttaccgtttacctacgttcccttacccg

SEQ ID NO: 192098 - DNA, 679 bp, Homo sapiens
  misc_feature: GYAE6OF02FKKQD.47.59.F04.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (441)..(441): a, c, t, g, unknown or other
  misc_feature (441)..(441): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagcccaccctgtctttgtctccgaggggaaancgccaccctctcctgcagggtcagtcagngtgttgacngctacttagtctggtaccaagacgaacctggtacaggcctcccgaggtcctccgtcagttctatgactagctacgtacccgaacgaccgggccacgtcggacctacgtacccgagaccgttacggttcgaggtcggacgtacgggttcgggtacgtaggggacctaaggtacctttacgaccgttacctacccacctntaccgacggaccacggtacctaaggcgtaccgttaggtaaacggttacgttttagggtaaccttttagtacttgtacgacgacgagttcgttaggtacgttacgtcgggtcccttacgtcgttccgttacggttccggggacggacgggtaccgtaggggtacgacggtactaaccggaaacggttacggtggtccggctacgaccgtaccgtacgttcgttcttaccggtctacccg

SEQ ID NO: 192099 - DNA, 849 bp, Homo sapiens
  misc_feature: GYAE6OF02HB6XF.47.59.F04.1.454.CMB.1.raw
  modified_base (220)..(220): a, c, t, g, unknown or other
  misc_feature (220)..(220): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctcccagactaccacgtggaagaaatagagatgacgcgagtctccacgcccacccgttgttctttgtccgtaccggaagggggaaanaccgccctacccgttctccgtggaccgtagggtcagtcgagtaggttgtacgaacgtagtccttaacgtgtcgtacggtaacaaacggtaacgtaaaccgtcggaccgacgggtccctaccccgaggtcccttccgtctacgttactagtcgacgtcgtacctaaccgtaccgaaccggacgggtacccctaacggtccggtaccctaaccgtaccccgaacggtacccggttacggttaaccggtacggtaccgggtacgtaacggttcggtaacgggttccggttaacggggaaacttaccgtacccgttaccacccgtttcctaacctaccgtaacgtacgacgaaccgtccggtacgtaacggtaccgtacgggtaattaacggttcgtttaggtacctttagttttaacttacggtacgttaaacggtaccgtaaacgttaaacggttaaccttccggtaacccggtcccgtttaaccccgtcgttaaccccgtttacgggttaccggggaaccgggtttccgggaacgggttaccgggtaacgaacccgggtaaggttaaccggaaaccggttacggttacggttcggaccgttacgacccgtaacggttcctaggtttccgg

SEQ ID NO: 192100 - DNA, 751 bp, Homo sapiens
  misc_feature: GYAE6OF02J0ZA1.47.59.F04.1.454.CMB.1.raw
  modified_base (208)..(208): a, c, t, g, unknown or other
  misc_feature (208)..(208): n is a, c, g, or t
tcagagctcacgtacacgaccggtgctcgatttagtacacacacttagggagttgggggaggaactgctcagttaggacccagagggaaccatggaagccccagctcagcttctcttcctcctgctactctggcctccagataccgaccggagaagttattttgaacacagtctccagccacctgttctttgtctccgaaggggaaancgcctaccctctcctgcgaggtcagtcagtagtgttagacagtctaacttagtctaggtaaccaaggacgaaaccttggaccacggtctaccgaggtccttccacgtagttccgtagggactcgtacgaacgtacccgaaaggtaccgggccggtccgtagggaccctacgtaccccgaggtacccgtagggttacacgggttcggacgtagggttcgggtcgttaacggcgaacgttaccgttccaccggttcaccgtactacgtacgacgtcgaagccgtaacggcgacgttaacgtagttactttgaccgtttaaagtttacgttacgccgttagtaacccgttataaacgttaaacctacgtaccggtcccttaccgtacttaccgttaccggggtaacggtaccgggaacgggtaccggaagggttaccgtaacggtacgtaaaccggaacggtttaccgcgggttaacggtacgtaacggtacccgtacgttaccgttcggtaccttacggtaccttacccgggttcccgttccccg

SEQ ID NO: 192101 - DNA, 809 bp, Homo sapiens
  misc_feature: GYAE6OF02FUSNU.47.59.F04.1.454.CMB.1.raw
  modified_base (204)..(204): a, c, t, g, unknown or other
  misc_feature (204)..(204): n is a, c, g, or t
  modified_base (335)..(335): a, c, t, g, unknown or other
  misc_feature (335)..(335): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaangccaccctctcctgcgagggtcagtcagagtgttgacagctacttagtctggtaaccaagacgaaacctggaccgagggcctcccgaggtcctcccgtcatcgttggggactcgactacgtccaaaccggnggggacccgcgtcgggctacgtccccgaagtcccgtagggttccacggttcgggacctagggttcggggttcgtaggggaaccgacggttacccgttcaccgttccttacccgaaccttaacgtccaacggtccgacgacccgtaaggaccggtacccgttaggtaaacgttagttttacggaccctttaacgttttaacgttacgttacgttaccgtaacggacccgttagggttaccgttacggaaccggttaacgttccgggtaccctttcgtttacccgttaacccgggttttacccgggggcgggggttaaaccggggtacccggtaaggggggtttccgggaaagggttaccgttaacgggaacgggtaaaccggttaacggtttacgggtcggggtaccgttaccgggtacccaacccggtttaaccggtttccggttaccggttttcccgtttaacgttacccccg

SEQ ID NO: 192102 - DNA, 836 bp, Homo sapiens
  misc_feature: GYAE6OF02GZQVA.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaangccaccctctcctgcagggtcagtcagagtgttgacagctacttagtctggtaccaagacgaaacctggccaggctcccaggcctcctcatcgtgggatgcatccgaacgtaggggcccgcgtgggccactccccgagcctacggtttccaaggttcggcctaagggttcggggtaccttaggggggacctaaggtacccgttttaccgaaccgtttcccgtacccgtaaccctaacgttcccgtaacgggcctaaaccggtaccccgtttaaacgggaaccggttaccccgttaaagggtaaaacggtttacgtttttttacgggaacccgtttaaagggtttttttaaccttttaaccggttacggtttaaaccgttaaacgggtaaacccggttaaaaaaccggtttaaaaacgtttacccggttaaccgggttcccccgtttaccccgggttaacccttttacccgtttaaacccggtttttaccgggggacccggggtaaacggggttaaccccgggtaggggttaccgggtaacgtaacggttaacgggaaaccgttacggttaggtacggtacgttcgaccgtaacgtacgttcgttacgtcctttactacgtttcccgtaccccg

SEQ ID NO: 192103 - DNA, 902 bp, Homo sapiens
  misc_feature: GYAE6OF02JUNOH.47.59.F04.1.454.CMB.1.raw
  modified_base (631)..(631): a, c, t, g, unknown or other
  misc_feature (631)..(631): n is a, c, g, or t
tcagagctcacgtacacgaccggtgctcgatttagtacacacacttagggattgggggaggaactgctcagttaggacccagagggaaccagtggaagccccagctcagcttctcttcctcctgtctactctggctcccgagactaccaccggagtaagttatttcgacacagtcctccgacgccctacccgtgttccttttcgtaccgttacccgaagggggaaacgacgcccctaaccccttccttcccgttacggtaccgtaacggggtcccgtaagttaccgaggtacggtttacggttgaaccggtaacggtaccttaacgtttaaccggttccgttaccgggtaaacccgaaaggtaaaccgtaacccggtagggtaccccaaggggtaccccttaccggtacggtaccccttaccgtacctaaccggttccggtagggtaacttccggaacccgttaccgaacccgttaaccgggtaccgggccgtaccggtaccggtaccgttaaccgtacccccggaccgtccggttaaccggtttacccgtacgggtacgggtaacccggtcgggttacgggggtaccggttacgggaaaccctttaaggttaccccgttcgtttaaaccnccggtttaacccaaccgtacggtaccgtaccggactacccggtaacgtacgtaggttacccgttaggttaaccgtttaacgtttacgtacgttaacgtttacgttacttcgtacggaacgtacgtaaacgtactaccgtacgttaccgtccgtcgtaccgttcgtaccggtacgggcggtaccgtaggttaccgaagtccgaggtaacgtcgtacggtacgacgtcgtaacgtctacggttagttccgtaattcccggtactccgtacccg

SEQ ID NO: 192104 - DNA, 718 bp, Homo sapiens
  misc_feature: GYAE6OF02HTI8K.47.59.F04.1.454.CMB.1.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (379)..(379): a, c, t, g, unknown or other
  misc_feature (379)..(379): n is a, c, g, or t
  modified_base (439)..(439): a, c, t, g, unknown or other
  misc_feature (439)..(439): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagatacccaccggagaagtttattttgacacagtcctccagcccacccttgttctttgtctaccgaggggaaagacgcccaccctctccctgcgaggtcagtcagngtgttgacngcttacttagtctggaccaagacgtaacctggccaggtcctcccgaggccttccctnatcgtgggtatgcctactaccgaacggacgggccncgtggcactcccacgccgtaggttcgaggcggacncggttcggggtcgtacggggactacgtccgtttacctccgtctaccgaacctatccgacncgtaccgaccgtaggaccgtctaacggtaacgttacggtttggttaactttagttactcggttacncgtacncggttccggtagttaccgttcgtacggttcccgttaccgtccgttccgttaccggttacgggtcccggggtaaacgggtaccgggtaggggttacgggtaaccgtagttaacccggtaaacggtaacggttacggtccggttaccgtaccgtaccggttacctaccgtttccgttaccggttaccctttccggtacctttacccccg

SEQ ID NO: 192105 - DNA, 823 bp, Homo sapiens
  misc_feature: GYAE6OF02F3UGP.47.59.F04.1.454.CMB.1.raw
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (460)..(460): a, c, t, g, unknown or other
  misc_feature (460)..(460): n is a, c, g, or t
tcagagctcacgtacacgaccggtgctcgatttagtacacacacttagggagttgggggaggaactgctcagttaggacccagaggaaccatggaagccccagctcagcttctcttcctcctgctactcgtggctcccagactaccaccggagaagttgtgttgaccgactagtctccagccctaccctgtctttgtcctcgagggggaaatcgcccaccctctccgtcgcgaacgggccacgtcgaagtaacttacgttccaaccgttccttaacttacggccgtacggtaaaccaaaccgacgtaaaccgtcggttccaacgggtcccttcccggaacgggtctccccgtataccttactatcgacttgacctacgtaacaacgcgggtaccncgtacgctactaccganacgcggttcagtcggacaggttcggtctagggacctacgtaccgttanccgtaccgactaacctgtaccacgtacacggttccgaaggtcgtaacccgtaggttaacccttaggtttaccggttaacttttaccgtaaacgtttcggtaacctacggtacacccgggttacgtacggggtttacttaccgggtttaccggaaccccgtttccggtaacccttttaaccgggtacccggttttaaccggggggaaccggttaacccgggggtaacccgggttaagggggtaccggtacgttaaacgggtaaaccccgtaaacccgggggttactacgggttaacccggttggaaccccgttaccgtaaccgttacgtccggttttacccgggtacttccccgtttaacccgg

SEQ ID NO: 192106 - DNA, 827 bp, Homo sapiens
  misc_feature: GYAE6OF02HIO9J.47.59.F04.1.454.CMB.1.raw
tcagagctcacgtacacgaccggtgctcgatttagtacacacacttagggattgtggggaggaactgctcagttaggacccagagggaaccatggaagccccagctcagcttctcttcctcctgctactctggctcccagataccaccggagaagttatttgacacagtctcagccaccttgtctttgtctcgaagggaaagcgcccacctctcctgcgagggtcagtcagagtgttcgacagtcttacgttagtcgtcggtaaccaaagaacggaaaaccgttcgggaccgtaacgggcccttacccggaggtcccctcccgttacacgtttcgtgggggtacttacggacctaaccttacccggaaacggcggggccccgtcggttccggggaccttaaccgtccccgaacggaccccggttaaggggtttcccgaacgggggttcggaccgtaagggggtttccggggttacggtaccgggggtaaactaaccggggttaccctttaccgtaaccccgtttcctaaacccgtaacccgacgttaccggaacgaccgtaacccgggtaccgtaacggtaccggtacccttaagggtaaatttcgtttacgtacgtttacgttttaattaccgttacgttacaacggtaaacctaaacgtaaacgttccgtaccgggtcctacccgtaccgttacggttaccggtttacgggccgggtaaccggtacggtaacgggtacgaacgtacgtaacggtaaccgtaacgggcgttaccggacttacgaccgtaccttcggtaccttacgttccgttactccgttaccccg

SEQ ID NO: 192107 - DNA, 586 bp, Homo sapiens
  misc_feature: GYAE6OF02GF4L0.47.59.F04.1.454.CMB.1.raw
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccaggggaaagagccaccctctcctgcagggtcagtcagagtgttgacagtctacttagtctggtaccaagagaaacctggccaggctccaggctcctcatctgggatgcatcccaacgagggcccacgtcggcactcccacgcccgtaggttcaggtggctaggtggggtcgtgggacaggtccttcactcnccacatcagcagcctagagctgaagtntttgctagtttactacttgtacagtacaaacgttaaactcgtcgcccttccgacttactaccgtttcggacgggtacgggaccgtagggtagaacgtagtacgtaacgacgttgggacggtacgtcggactaaccgtcgttacgtcgttaccttacgtaccttccgttaccccg

SEQ ID NO: 192108 - DNA, 879 bp, Homo sapiens
  misc_feature: GYAE6OF02IUP8P.47.59.F04.1.454.CMB.1.raw
  modified_base (201)..(201): a, c, t, g, unknown or other
  misc_feature (201)..(201): n is a, c, g, or t
tcagagctcacgtacacgaccggtgctcgatttagtacacacacttagggattggggggaggaactgctcagttaggacccagagggaaccatggaagccccagctcagcttctcttcctcctgctactctggctccagataccaccggagaagttattttgacacagtctccagccacctgtctttgtctccaggggaangccaccctctcctgcagggtcagtcagagttgttgacagcttacttagtctaggtaccaagacgaaacctggaccaggcctcccgaggcctacctcacttcgtagggactcgactactaccgaaacgacgggcccgtctagggcctaacgttcccccgaaggtaccccgtaagggtttccgaaggttcgggactaagggtttcggggtacgtacgggggaactaggttacctttcgaccttccgtaaccaccgtaagttccaacggtccgaacggtacccgttaagggaccgttaccgttaacggtaaacggtttacgtttttacgggaacgtttaaagggtttttaaccgttttaaccggttaggtttaacccgtaaacgggttaaacccgtttaaaaccgtttaaaacgttaccggtttaccgggtacccctttaacccggtacccttttaccggttaaaccccgggtttttaccggggaaccgggggtaacccggggtaaccccgggttaaggggttaccgggtaaccttaaacgggtttaccgggtaaaaacccgggttcgggtttaacgggttaccggggtaccgttaaccggtaacccgtaaccgttaaccgtttaccgttaccggttttacccgtttaaccgttaccccggtttcccggttaaccccccgg

SEQ ID NO: 192109 - DNA, 856 bp, Homo sapiens
  misc_feature: GYAE6OF02JCX4N.47.59.F04.1.454.CMB.1.raw
  modified_base (203)..(203): a, c, t, g, unknown or other
  misc_feature (203)..(203): n is a, c, g, or t
tcagagctcacgtacacgaccggtgctcgatttagtacacacacttagggagttgggggaggaactgctcagttaggacccagaggaaccatggaagccccagctcagcttctcttcctctgctactctggcctccagataccaccggagagttattttgacacagtctccagccacctgtctttgtctccgaaggggaaagngcccaccctctcccgtagcgagggtcagtcgagtagtgttagaccaggtcctacgtttacgcgttagggaaccaaggacgaaaccgtcggccaaggccgttacccgacggtcctcccgtcacgttccgtggggaatcgtacacgtacccgaacgacggggcccgtacgtcgggaccacttacccgacgtacctagggtaccgtacgtacgggtcgtacggttacgggtcggtcgggaacgtaaccggtacgttaaccgtacccgtaccgtttacccgaacccgtaagttccccgaacgggtaccctacggttacccgtaacggtacccggtacccgttaacggtaaaggtttaacgttttaccggtaccgtttaaccggttttacgtttaacctttacggtacccgttaagggtaacccgtaaaccggtttaaagtttaccggttaaccggtcccgtacccgttccgttaacccgtttccggtttaacccgggtacggggttaaccggggtacgggtaacggggttaaccgaacggtaaccgttacggttaaaaccgacggttacgggtaccggttacggtcccggtaccgaacccgttacggttacccgttacggttccctttaccttaccggttccccgtttaacccccgg

SEQ ID NO: 192110 - DNA, 744 bp, Homo sapiens
  misc_feature: GYAE6OF02I60R1.47.59.F04.1.454.CMB.1.raw
  modified_base (113)..(113): a, c, t, g, unknown or other
  misc_feature (113)..(113): n is a, c, g, or t
  modified_base (200)..(200): a, c, t, g, unknown or other
  misc_feature (200)..(200): n is a, c, g, or t
tcagagctcacgtacacgaccggtgctcgatttagtacacacacttagggattgggggaggaactgctcagttaggacccagagggaaccatggaagccccagctcagcttcncttctcctgctactctggctcccagataccatcggagtaagttgtgttgacacagtctccagccacctgtcttgctccgaggggaangcccacctctacctgcgagggtccaggtcaggtagttgttcgaactacgtcttaacgttagtcctaggtaaccaaggtaacgaaacccgttggaccctacgggtcctacccggaacggtcccttacctaccattccggtggggattcggacctaacgtaccccgaaaaggccgggggcccgtacgttacggggacccaccttaccccgagggtaccccgtagggtttcaacgggtcgggtactacgggttcgggggtaccgtaggggtaccgtagttaccttaccgaccttcaccctaacgactcggagacgacgtacctacgaacgtccgtagtaacgttagtttacgtacgttaacgtttacttaacgtgtactacgtaaactaaacgttaaaccgttactaccgggtacctccggtaccttcgttaaccggttccgggtaacggtaccgggtaccgtacgggtagtaccgtacggtaacggtaaaccgttcggacggtacgcgtaccgactacgtacgttcgttacgtcttaccctaccgg

SEQ ID NO: 192111 - DNA, 680 bp, Homo sapiens
  misc_feature: GYAE6OF02JOX60.47.59.F04.1.454.CMB.1.raw
  modified_base (575)..(575): a, c, t, g, unknown or other
  misc_feature (575)..(575): n is a, c, g, or t
  modified_base (658)..(658): a, c, t, g, unknown or other
  misc_feature (658)..(658): n is a, c, g, or t
  modified_base (672)..(672): a, c, t, g, unknown or other
  misc_feature (672)..(672): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagtaagttattttgacacagtctccagccacctgtctttgtctccgaggggaaacgtacgccaccctctccttgcgacgggtctagtccaggtacgtgttacgacgacggtcctacgtttagtccgtaggttaccaagaacgaaaccgttggacccaagggcctacccgtagggccttacccgtactacgttccggtggggtaactcggtaccccatacccaacggcggggccctcggtcggactcctccggctacgtcgggttctaggtggaccgaggtgacgtttgccggagtaggtactcgtctccctacggaccttacggcaactgtccagacttaggtctacggtaagtcttttggacttactttacgttatctttacggactaactcggtactttacgggacttacggtccggtaccgtntaaccgtccggttaacccgcggtaacgtaccggagtagtacgggattaccgtaacggaccgttggtacctgtcacccgttacncttcgtccggttancctacccg

SEQ ID NO: 192112 - DNA, 766 bp, Homo sapiens
  misc_feature: GYAE6OF02JCRSH.47.59.F04.1.454.CMB.1.raw
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
tcagagctcacgtacacgaccggtgctcgatttagtacacacacttagggattgggggaggaactgctcagttaggacccagagggaaccatggaagccccagctcagcttctcttcctctgctactctggctccagataccaccggagaagtttattttgacacagttctccagcccacccgttgttcctttgtcctccgaaggggaaancgtaccacccttctcctgccgagggtcacgtcagtacgtgttcgaccagacctagttagacttcggaacaaggtaacgaacctgggtccacggtccnccccgaaggtcctccgtacagtccggtagggactgccgaacttcccgaaacggtcgggccctacgcggactaacccgtccccaacgttcggacgtttaacgacggtcggctaagggttcgggtactacggggaataccggtccttacgacttaccccgtcaaccgttacgtaccggacgtacgtaccggtacccggtaacgttaccgaccggttacggttaaacggtttacgtttagggttaaccgttaaggttttaccttaacgttagttacggtaaacgttaaccgtaaacggttaaccgtacgtccggttacccgtaccgttaacgttaccgttacggtttaccggtacgggtaacgtacgggtaggtaacgtacgtagtacgtaaacgtgtacggtacgtacgtccgaactaccgtacgtcttacggttaccttacgtaccgttaccgtacccg

SEQ ID NO: 192113 - DNA, 629 bp, Homo sapiens
  misc_feature: GYAE6OF02FHXBK.47.59.F04.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (390)..(390): a, c, t, g, unknown or other
  misc_feature (390)..(390): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccaccggagaagttattttgacacagtctccagccaccctgtctttgtctccgaggggaaangccaccctctcctgcagggtcagtcagagtgttgacagctacttagtctggtaccaagagaacctggccaggctccgaggctccnatcgtgggatcggacactccaacgacgggcccngtggcacgtcccgagccgtaggttccaaggtcggactaggtcgggtctggggaccagtacctcactcnccaccagtcacgcacgcctagcgtcagaacgttgtttgcgttaagtttacttacgtgtacagtaactaacgtaacttcgtccgggtaccttccgaccttccgtacgtttacgggccgggtaacgggtaccgtaggggtcgaacgtacgtacgggaaacctcggtcggtggtaaccggtcgacccgtaactacggttccgttaccgttacgtttaccgtaccgtttccccgttaccccgg

SEQ ID NO: 192114 - DNA, 828 bp, Homo sapiens
  misc_feature: GYAE6OF02F7IFE.47.59.F04.1.454.CMB.1.raw
  modified_base (205)..(205): a, c, t, g, unknown or other
  misc_feature (205)..(205): n is a, c, g, or t
tcagagctcacgtacacgaccggtgctcgatttagtacacacacttagggattgggggaggaactgctcagttaggacccagagggaaccatggaagccccgagctcagcttctcttcctcctgctactctggctccagataccaccggagaagtttattttgacacagtctccagccaccctgtctttgtctccgaggggaaangcccacccgtctcctgacgagggtcagtcaggtagtgttgacagcttacgttagtcttaggaaccaaggacgtaaaccgtggacccgaagggtccctaccccgtaggtaccctcccgtacacgttcgtacggggtactcggacctaccgttacccgaaacggacggggtcccgtaccgttcgggacctaacccggttaccccgaacggtacccgttaccgggttaactaaccgggttgggaaccggtcgggttcggggtacggtttacggggaacctacgggtttaacccgttaccgaaccgttcccgtaccaaccccgtagtacccgaacgcccgtaacgtaccgtaacggaccggtacccgtaaggtaaaccgttagttttcgaacgtttaagttttacgttacgttcggttaacgtaacgtaccgttaaacgttaaacttccgtaccgggtaccttcccgtaccgttacccgttaccggttcgggaacccggggtacgggtaacccggtagggttacgtaacgtacggtaacgtaaaccggtacggttcgggtacgtccggtacgacccgtacgttacgttacggttacgttaccgttacgtaccgttcccgttaccccg

SEQ ID NO: 192115 - DNA, 823 bp, Homo sapiens
  misc_feature: GYAE6OF02FZZ5M.47.59.F04.1.454.CMB.1.raw
  modified_base (211)..(211): a, c, t, g, unknown or other
  misc_feature (211)..(211): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggcctccagataccaccggagtaagttattttgacacagtctccgagcccaccctgttctttcgtcctccgaaggggaaancgcccaccctctcctgcgagggccagtcgagtagtgttcggcacgtacttacgttacgccgttacggtaaccaacgaacggtaaacccgtggaccctaggggtcccttaccccggaacggtccttccccgtacgtacttaccgtagtacgtacttacggacctaacgtacccgtaaacggccggggtacccaacggttaccgggaccaaaccggttcccccgaacggttcccccggtaaggggtttccgtaacgggttccgggaccgttaacggttcgggtacgggttaacggttaccggggaaactaaccgtttcttaacccggtaactttcccgaacctaccgaacttccgaacgtaccgaaccgtccggtaacgaccggttaccgttaaggtaaccgttttacgtttaccgtacctttaacgtttttaacgttaccgttcgtacgttacgaccgtttacgtacgggtaactaccgtaaccggttcgtaccctttggtacccgttcgggtttccgggaccggggtaacgtaccgggtagggtcgaacgtacggtacgacggttaaccgtcggtcgtacggtcgactacccgtagtacttcggtcttaccg

SEQ ID NO: 192116 - DNA, 673 bp, Homo sapiens
  misc_feature: GYAE6OF02H8Y8J.47.59.F04.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
tcagagctcacgtacacgaccggtgctcgatttagtacacacacttagggattgggggaggaactgctcagttaggacccagagggaaccatggaagccccagctcagcttctcttcctcctgctactctggctcccagataccatcggagaagttgtgttgacanagtctccagccaccctgtctttgtctcgaggggaaangccaccctctcctgcngggccagtcagatattcactcctattacgctacggtaccaacgagaaacccgtggtacacggcctccaggtcctcctcgatctagtgactcgccgttccacgacgggcctacgttcggtttcccagtccgtaggttcgaggtcggacaggtcgcggttacgtgggactaacggtacgttccgaacttccgtacaaccgtataccgaactacgcctgactacgttcgtaaggtaacgtttatttacgacgttaagtttttactacgttacggttacgtagtacgtaagtttacacgttaaacgtaccgtcggtacccactttacccgtacgttacccgggaccgtaacgggacctaccggtaagttacggaacgttaacgttaaacgcgttaacggtcgtaacgttccgaccgtaccttacgttcgttaccggttactttaccgtccttaccccg

SEQ ID NO: 192117 - DNA, 702 bp, Homo sapiens
  misc_feature: GYAE6OF02GFME4.47.59.F04.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (357)..(357): a, c, t, g, unknown or other
  misc_feature (357)..(357): n is a, c, g, or t
tcagagctcacgtacacgaccggtgctcgatttagtacacacacttagggattgggggaggaactgctcagttaggacccagagggaaccatggaagccccagcgcagcttctcttcctcctgctactctggcctcccagacgaccactggagaaaatgtgatgacgctagtcctccagcccaccctggtctgtcctccgtacgaaggggaaancgacccaactatcctccgtggtacgggcccggttanaaggtagttacttgccattacgaaactttcgccgtaggtacccagtacgagtacgaccgtggggcagggtcctacccgaggccttccgactacgtctagtgggtacnctacctacccgacgacgggccctagtcgggttaacctccccgagtcccggtaggttccggtaggtcggaactggggtcgggttacgtgggactaagtcgttacacccttcgactaccatccgacgacgtcgccgtagcgtaacgtcgtaaggtaacgtttacgtttcgtaactttaacgtttttaactttatacgtttacgacgttaacgtaagttaacgtaacgtttaccgtacggtccgttacgttccgtaccggtaacggacggtacgacggtagtacggtaacgtaagtaaaccggtcgttacggtacgcgtaccggctaaccggtcttacgtctttaccg

SEQ ID NO: 192118 - DNA, 703 bp, Homo sapiens
  misc_feature: GYAE6OF02F2JA6.47.59.F04.1.454.CMB.1.raw
  modified_base (206)..(206): a, c, t, g, unknown or other
  misc_feature (206)..(206): n is a, c, g, or t
  modified_base (594)..(594): a, c, t, g, unknown or other
  misc_feature (594)..(594): n is a, c, g, or t
tcagagctcacgtacacgaccggtgctcgatttagtacacacacttagggattgggggaggaactgctcagttaggacccagagggaaccatggaagccccagcctcagcttctcttcctcctgctactctggctcccagactaccaccggagaagttattttgacacagtctccacgccaccctgtctttgtctccgagggaaancgcccaccctctcctgcgacggtcagtaccgagacgttgtacgacacgtacttaccgtttaagtcttacgggtaacctaaaggaactaaacccgttcggaccaaggtcccgtacccgaaggtccttccccgtactcgttacggtcgggtaacttcgaccgtacgtaacccgaaacggtcgggtcccgacgtacggtaccacccgttaccccgagcccgttaggttaccaggtcggtacgtacggtcgggtacgtacggactacgtaccttacgactaccgtcaccgttacacgacgtctacgtctaacgctaccgtagtaacgttgttacgttaacctttagtaaccgtgtaccgagtacgtcgcgttagccgttcgcgtcccgtacnccgttacgtacgttccgggacgaccgcgggtacgagtaacgtacgtacggaaacgtcggtgtacggtcctaggcctaacgtcgtacgttccgtcctaacgtcctacccg

SEQ ID NO: 192119 - DNA, 816 bp, Homo sapiens
  misc_feature: GYAE6OF02HQ4LM.47.59.F04.1.454.CMB.1.raw
  modified_base (121)..(121): a, c, t, g, unknown or other
  misc_feature (121)..(121): n is a, c, g, or t
  modified_base (211)..(211): a, c, t, g, unknown or other
  misc_feature (211)..(211): n is a, c, g, or t
  modified_base (536)..(536): a, c, t, g, unknown or other
  misc_feature (536)..(536): n is a, c, g, or t
  modified_base (768)..(768): a, c, t, g, unknown or other
  misc_feature (768)..(768): n is a, c, g, or t
tcagagctcacgtacacgaccggtgctcgatttagtacacacacttaggggattgggggaggaactgctcagttaggacccagagggaaccatggaagcccagctcagcttctcttctccngtctactctggctaccagataccacggagaagtttatttgacactagtctaccagtccaaccctgtctttagtcctccgtaaggggaaanacgcctacctactccgtagcgaacgggttcaagtacgacggtaacgttggttacgaacgtacggtaccgttaacgtttacgtaccgttaagggtaaccctaaaaggtaacgtaaaaccggttggaccaacggtccttacccggaaggtcccttaccgtataagtaccggtaggtaaccgttcgaccaaacgttacccgaaagggtaccggcgttacacggtacaccgtacccgtagacccgttagggttaccaagggtttcggacgtttaagggccggttaaccgtagggggaacctaacgggtaccctttacggaccgtttaancccggtaaacgttcaccgtaaagggtacctaacgtacgtaacggacgtaacgtaacggtaaacttggtttaacgtacgttaagtttaacgttacgtaacgttacgtaacgaaacgttaacgttaaactacgttaccggtacctacgtacgtacgtttaaccgtacggtaccggtaagggttacccggtaaggtaaccgttacgaagacggtaagtacgtaagtacccggtanaaccgacggaaccttgtaccggtcttacgtaactccggtacccttacg

SEQ ID NO: 192120 - DNA, 757 bp, Homo sapiens
  misc_feature: GYAE6OF02F43L9.47.59.F04.1.454.CMB.1.raw
  modified_base (209)..(209): a, c, t, g, unknown or other
  misc_feature (209)..(209): n is a, c, g, or t
  modified_base (331)..(331): a, c, t, g, unknown or other
  misc_feature (331)..(331): n is a, c, g, or t
tcagagctcacgtacacgaccggtgctcgatttagtacacacacttagggagttgggggaggaactgctcagttaggacccagagggaaccatggaagccccagctcatcttctcttcctcctgctactctggcctcccagactaccaccggagaagttattttgacacagtctccagccaccctgtctttgtctccgaaggggaaagngcccaccctctcctgcacgggtcagtcagagtgtgacagctacttagtctggtaaccaagagaacctggccaggcctcccgaggctcctcatccgtgggactgacacgccaacgcggggccncgtggctacgtccaggtcctaggttccaggttggacgtagggtcggggttaccgtaggggaccgtaggtaccctttacgaccttactacccaacctacgtaccaacgcctacgaccgtacgaacgaccgtacggtaacgttacgtttacggtacgttaagtttaacgtttacgttacgttacgtaacgtaacgtaaaccgttaaacgttaaccgtaccggttacccgtacccgttaccgttaccgttaccgtttaccgggtaccggggtaacggggtaaccggtacgggttacgggaacgtaacggtaacggtaaacggtaacggtacggtacggtaggtacccccccccccccccccccccggtacgtacccgtacgttaccgtttaccggtttaccgtttaccgttaccgttcccgttaccccg

SEQ ID NO: 192121 - DNA, 807 bp, Homo sapiens
  misc_feature: GYAE6OF02GRPBI.47.59.F04.1.454.CMB.1.raw
tcagagctcacgtacacgaccggtgctcgatttagtacacacacttagggattgggggaggaactgctcagttaggacccagagggaaccatggaagccccagcctcagcttctcttcctcctgctactctggcctcccagataccactggaagaaatagagatgacgctagtctccacgcccacctgtctgttgtcctccggaagggaaaagcgtccaccctctcctgcgacgggccagtcagagttattacgacgtagacctaaccgttacgaccgtacgggttacccaggacctaaacggaaaccgttcggggactaccgggccctaccccggacggttccctccctcgtacttaccggtagttcgggtaccgtacctaacccgaccgacccggtaccgggtacccgtaacggttacggggttaacccctaccccgtaaccggtacccgttaacggggtttaccgtaaggggttccgaacggttacggggtacgggggtttacgtaacggggaacgtaacgtaccggttccttaccgacccgttacctaccgtactaccgtacgtaccgtaacggtccgtcgacgtcggttacgtacgttaagttcgtttcgttaagttttaaactttactttagttactcgttaacgtgttaaacttaattaacgttacgtacggtaccgtttaccggttacgtccggtaaccgtacgggaccgtagtaaccggtaaggtaacgttaaacggtaaccgttaaggtccggttacgaccgtacgttacccgtactttacgtccgtttctttaccg

SEQ ID NO: 192122 - DNA, 809 bp, Homo sapiens
  misc_feature: GYAE6OF02HY9D7.47.59.F04.1.454.CMB.1.raw
tcagagctcacgtacacgaccggtgctcgatttagtacacacacttagggattgggggaggaactgctcagttaggacccagagggaaccatggaagccccagctcagcttctccttcctcctgctactctggcctccagataccaccggagaagttattttgaccacagtcctccagccaccctgtctttgtctccgagggaagcgccaccctctcctgcagggtcagtcagacgtgttagacagtctaacttagtcgtacggtaaccaaggaacgaaacccttgggacccaaggggtcccctaccccgaaggtcctaccccgttcgaacttccggtaggggaacttcggacctaacgttaccccggaaacggacggggcccgtacgttacggaccgtaaaccttcccccgaagggtccccgtagggttttaccgaacgggttggaccgtaagggtcggggttcgtagggggactacggttaccgtttccgaaccttccgtacacccgtagtaccgacgtacctaacggtcccgtaacggtacgtcccgtaaggtaacgttagtttacggtcttaagggtttactttaccgtaggttccgaagtaaccgttaaacgttaacgtaccgtaccggcccttacccggtcttacccgtaccgtttcgggacccggggtaacgtacccggtaggggttaccgaaccgtaggtaaccgggtaacggttaaccgttggggtaccggtaccgtacgtacccgtaccgtaagttcccgtaccggttacccttacggttacccgttcccgttaccccg

SEQ ID NO: 192123 - DNA, 839 bp, Homo sapiens
  misc_feature: GYAE6OF02HEQUD.47.59.F04.1.454.CMB.1.raw
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
  modified_base (820)..(820): a, c, t, g, unknown or other
  misc_feature (820)..(820): n is a, c, g, or t
tcagagctcacgtacacgaccggtgctcgatttagtacacacacttagggattgggggagaactgctcagttaggacccagagggaaccatggaagccccagctcagcttctcttcctcctgctactctggcctcccagataccaccggagagttatttgacacagtcncacgccacctgtcttgctccgagggaancgccaccctctcctgcgaggtcagtcagtagttgtagacagtcttacgttagtcgtacggtaaccaaggtaacgtaaacccgtgggaccctaagggcccttaccggaacggtccttacccgtactaacgttccgggtgggtaaactcggaccctaacgttaccccgaaaacgggtcggggtcccgtcggtaacggcctaaccctacccggaacggtcccgtaagggtttcccgaacgggttcgggaacgtacgggttcgggttacccgtaggggtaaaccgtacggttacccctttacgaaccttacccggtaaccgtaaaccacgtttacccgggaacgtacccgtaaccggttaccgtacggtaacccgttaccgtaacggggtttaaaaactttcgggttttagaaccgttttaaacggttttacgtaccgtttcgggtaacctaaacgggttaaccggtaaaaactttaccggtacgtccgtaccccgttccggtaccttaaccggtttcgtcggggaaccggtcgggaccggtaggtacgaacctagtaccgggtaaaccgtggttccgggaaggttcaacccgttccggtaactttacgggttccacgttttaccgntacccttacccggttcccg

SEQ ID NO: 192124 - DNA, 216 bp, Homo sapiens
  misc_feature: GYAE6OF01CSSVR.44.23.C01.1.454.CMB.1.raw
  modified_base (216)..(216): a, c, t, g, unknown or other
  misc_feature (216)..(216): n is a, c, g, or t
tcagacagtatatacacgaccggtgctcgatttagtacacgtgattagggattgggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagn

SEQ ID NO: 192125 - DNA, 256 bp, Homo sapiens
  misc_feature: GYAE6OF01EZFM8.44.23.C01.1.454.CMB.1.raw
  modified_base (214)..(256): a, c, t, g, unknown or other
  misc_feature (214)..(256): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctggacacagcggcctgggctgcctggtcaaggctacttccatatactgtctgagcggctggcaaggcgcatagnnnnnnnnnnnnnnnnnnnnnnnnnnnnnnnnnnnnnnnnnnn

SEQ ID NO: 192126 - DNA, 419 bp, Homo sapiens
  misc_feature: GYAE6OF01BJNHZ.44.23.C01.1.454.CMB.1.raw
  modified_base (414)..(419): a, c, t, g, unknown or other
  misc_feature (414)..(419): n is a, c, g, or t
tcagacagtatatacacgaccggtgctcgatttagtacacgtgattagggattgggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccagggaccgcggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcatagnnnnnn

SEQ ID NO: 192127 - DNA, 532 bp, Homo sapiens
  misc_feature: GYAE6OF01BOCH1.44.23.C01.1.454.CMB.1.raw
  modified_base (271)..(271): a, c, t, g, unknown or other
  misc_feature (271)..(271): n is a, c, g, or t
  modified_base (526)..(527): a, c, t, g, unknown or other
  misc_feature (526)..(527): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtagaaaccagactggaaggtagacgtcccgtcaggttcagtgccagtccaggtggtgggccggagtccactctcaccattagcgacctgcggcctgaagtattctgctaacttatttctgtcagcagtatcatagtcgtccccgttctacgttttcggccgtaggggaccaaggctaggaaactacgaaacgactgtgctgcaccatctgtcttcatccttccccatctnntatac

SEQ ID NO: 192128 - DNA, 283 bp, Homo sapiens
  misc_feature: GYAE6OF01C0FV9.44.23.C01.1.454.CMB.1.raw
  modified_base (220)..(283): a, c, t, g, unknown or other
  misc_feature (220)..(283): n is a, c, g, or t
tcagacagtatatacacgaccggtgctcgatttagtacacgtgattagggagttgggggaagaggaagactgacggtcctcccaggagttcaggtgctcgggcaccttgggcacgggggaggtgtgtcacaagatttgggctctgggcacagcggcctgggctgcctggtcaaggctacttcctcgatcgcgtctgagcgggctggcaaaggcgcatagnnnnnnnnnnnnnnnnnnnnnnnnnnnnnnnnnnnnnnnnnnnnnnnnnnnnnnnnnnnnnnnn

SEQ ID NO: 192129 - DNA, 219 bp, Homo sapiens
  misc_feature: GYAE6OF01DRU7A.44.23.C01.1.454.CMB.1.raw
  modified_base (218)..(219): a, c, t, g, unknown or other
  misc_feature (218)..(219): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 192130 - DNA, 219 bp, Homo sapiens
  misc_feature: GYAE6OF01CV5FX.44.23.C01.1.454.CMB.1.raw
  modified_base (217)..(219): a, c, t, g, unknown or other
  misc_feature (217)..(219): n is a, c, g, or t
tcagacagtatatacacgaccggtgctcgatttagtacacgtgattagggattggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnn

SEQ ID NO: 192131 - DNA, 264 bp, Homo sapiens
  misc_feature: GYAE6OF01BMSIA.44.23.C01.1.454.CMB.1.raw
  modified_base (261)..(264): a, c, t, g, unknown or other
  misc_feature (261)..(264): n is a, c, g, or t
tcagacagtatatacacgaccggtgctcgattagtacacgtgattagggattgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttcctatatactgtctgagcgggctggcaaggcgcatagnnnn

SEQ ID NO: 192132 - DNA, 607 bp, Homo sapiens
  misc_feature: GYAE6OF01BWC5C.44.23.C01.1.454.CMB.1.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtggacagtcgagatgacccagtctccttccttcctgtcttcttctgttggaggcagcgtcaccatcacttgccgggcgagtcaggtcgttttcggngctgttgcctggtttcaacaaaaagggggnaggcccctaaggtcctcgtctctcgtgaaaccagactggaaggtagagtcccgtcaggttcagtgccagtccaggtggtgggccggagtccactctcaccatttaagcgaactgtcggccgtcgtaggaattcttgctaacttaaacttttctttgtcgtagacgacgtattactataagtgtccccggttcccttactttaggtttccggacgggtaacccggaacgaacgttcggtaaacgtaactaaccgaaaacgtaacgttcgggtacgtcgtacgaccctaactacttcggttcttcctactcttccccgtcccactacttgtacgtaa

SEQ ID NO: 192133 - DNA, 221 bp, Homo sapiens
  misc_feature: GYAE6OF01EEPMA.44.23.C01.1.454.CMB.1.raw
  modified_base (218)..(221): a, c, t, g, unknown or other
  misc_feature (218)..(221): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnn

SEQ ID NO: 192134 - DNA, 220 bp, Homo sapiens
  misc_feature: GYAE6OF01AM80N.44.23.C01.1.454.CMB.1.raw
  modified_base (218)..(220): a, c, t, g, unknown or other
  misc_feature (218)..(220): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnn

SEQ ID NO: 192135 - DNA, 221 bp, Homo sapiens
  misc_feature: GYAE6OF01A6C90.44.23.C01.1.454.CMB.1.raw
  modified_base (218)..(221): a, c, t, g, unknown or other
  misc_feature (218)..(221): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnn

SEQ ID NO: 192136 - DNA, 221 bp, Homo sapiens
  misc_feature: GYAE6OF01ECMJ8.44.23.C01.1.454.CMB.1.raw
  modified_base (218)..(221): a, c, t, g, unknown or other
  misc_feature (218)..(221): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnn

SEQ ID NO: 192137 - DNA, 243 bp, Homo sapiens
  misc_feature: GYAE6OF01CP2W0.44.23.C01.1.454.CMB.1.raw
  modified_base (223)..(243): a, c, t, g, unknown or other
  misc_feature (223)..(243): n is a, c, g, or t
tcagacagtatatacacgaccggtgctcgatttagtacacgtgattagggtagttgggggaagaggaagactgacggtcctcccgaggagttcaggtgctgggcaccttgggcacggggaggtgtgtcacaagatttgggctcgtgggcacagcggccctgggctgcctggtcaaggacctacttccacgtctactgctgagcgggctggcaaggcgcatagnnnnnnnnnnnnnnnnnnnnn

SEQ ID NO: 192138 - DNA, 130 bp, Homo sapiens
  misc_feature: GYAE6OF01DT52V.44.23.C01.1.454.CMB.1.raw
  modified_base (130)..(130): a, c, t, g, unknown or other
  misc_feature (130)..(130): n is a, c, g, or t
tcagacagtatatacacgaccggtgctcgatttagtacacgtgattagggattgggcacagcggccctgggctgcctggtcaaggactacttcctatatactgtctgagcgggctggcaaggcgcatagn

SEQ ID NO: 192139 - DNA, 515 bp, Homo sapiens
  misc_feature: GYAE6OF01CAE63.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (393)..(393): a, c, t, g, unknown or other
  misc_feature (393)..(393): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaaggggngaggcccctaaggtcctcgtctctcgtgaaaccagactggaaggtagagtcccgtccaggttcagtgccagtccaggtggtggccgagtccactctcaccattagcgacctgcggcctgaagnttctgcaacttatttctgtcagcagtatcatagtgccccgttctacttttggccaggggacccaagcctaggaaatcaaacgactgtggctgcacntntgtcttcatcttccgcatctgnta

SEQ ID NO: 192140 - DNA, 419 bp, Homo sapiens
  misc_feature: GYAE6OF01AIX7Q.44.23.C01.1.454.CMB.1.raw
  modified_base (415)..(419): a, c, t, g, unknown or other
  misc_feature (415)..(419): n is a, c, g, or t
tcagacagtatatacacgaccggtgctcgatttagtacacgtgattagggattgggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacagcggccctgggctgcctggtcaaggctacttcctatatactgtctgagcgggctggcaaggcgcatagnnnnn

SEQ ID NO: 192141 - DNA, 223 bp, Homo sapiens
  misc_feature: GYAE6OF01BTLP9.44.23.C01.1.454.CMB.1.raw
  modified_base (219)..(223): a, c, t, g, unknown or other
  misc_feature (219)..(223): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 192142 - DNA, 252 bp, Homo sapiens
  misc_feature: GYAE6OF01ES50J.44.23.C01.1.454.CMB.1.raw
  modified_base (213)..(213): a, c, t, g, unknown or other
  misc_feature (213)..(213): n is a, c, g, or t
  modified_base (219)..(225): a, c, t, g, unknown or other
  misc_feature (219)..(225): n is a, c, g, or t
  modified_base (228)..(252): a, c, t, g, unknown or other
  misc_feature (228)..(252): n is a, c, g, or t
tcagacagtatatacacgaccggtgctcgatttagtacacgtgattagggagttggggggaagaggaagactgacggtcctcccaggagttcaggtgctgggcaccttgggcacggggaggtgtgtcacaagatttgggctctgggcacagcggccctgggctgcctggtcaaggctacttcctatatactgtctgagcgggctggcaaggcncatagnnnnnnnatnnnnnnnnnnnnnnnnnnnnnnnnn

SEQ ID NO: 192143 - DNA, 219 bp, Homo sapiens
  misc_feature: GYAE6OF01EF1GC.44.23.C01.1.454.CMB.1.raw
  modified_base (218)..(219): a, c, t, g, unknown or other
  misc_feature (218)..(219): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnn

SEQ ID NO: 192144 - DNA, 218 bp, Homo sapiens
  misc_feature: GYAE6OF01CWHGF.44.23.C01.1.454.CMB.1.raw
  modified_base (218)..(218): a, c, t, g, unknown or other
  misc_feature (218)..(218): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagn

SEQ ID NO: 192145 - DNA, 515 bp, Homo sapiens
  misc_feature: GYAE6OF01CG55T.44.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (512)..(512): a, c, t, g, unknown or other
  misc_feature (512)..(512): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccngactggaaggtagagtcccgtcaggttcagtgccagtccaggtggtgggccggagtccactctcaccattagcgacctgcggcctgaacgtattctgctaacttatttctgtcagcagtatcatagtgcccgttcacttttcggcaggggaccagactggaaatcaaacgactgtgctgcacgatctgtctcatcttcccgcatctgntac

SEQ ID NO: 192146 - DNA, 580 bp, Homo sapiens
  misc_feature: GYAE6OF01CXHK0.44.23.C01.1.454.CMB.1.raw
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctccaggttcgagatgtgactatcgagatgaccaagtctccttcctcctgtcttcttctggttggaggcagcgtcaccatcacttgccggcagtcaggtcgtttcgngctgttgctgttcaacgaaaaggggnacggccctaaggtcctcgtctcgtcgtagaaaccagactggaaggtagacgtcccgtcgaggttcagttgccagtccagggtggtcggcgagtccatctcacctatagcgacctggccggcctgaacgtattctgctaactttattctgttccagaccagtatctaattgtctccccgtttatacgttttcgggaccgtaacgggaccaaggtcgtaggaaacttcaaaacgtactggtacggctaggaccaccgtattccttacggttcctttaccactttcccttacccccgctaagttccctagtacttaacg

SEQ ID NO: 192147 - DNA, 221 bp, Homo sapiens; identical to SEQ ID NO: 192133
  misc_feature: GYAE6OF01AP7J8.44.23.C01.1.454.CMB.1.raw
  modified_base (218)..(221): a, c, t, g, unknown or other
  misc_feature (218)..(221): n is a, c, g, or t

SEQ ID NO: 192148 - DNA, 441 bp, Homo sapiens
  misc_feature: GYAE6OF01BNM9K.44.23.C01.1.454.CMB.1.raw
  modified_base (425)..(425): a, c, t, g, unknown or other
  misc_feature (425)..(425): n is a, c, g, or t
  modified_base (427)..(441): a, c, t, g, unknown or other
  misc_feature (427)..(441): n is a, c, g, or t
tcagacagtatatacacgaccggtgctcgatttagtacacgtgattagggagtttggggagtatctacttaataggtgggagcacctactacaacccgtccctcaaggacgtcgagtcaccatatcgagtagacacgtccaagaaccagttctccctgaagctgagctctgtgaccgccgcggacaccggccgtgtattactgtcgcgagagtagggcagttcgtcaccaactactttgaccactggggccagggaacccctggtcaccgtctcctcacgcctccaccaagggcccatacggtcttcccctggccaccctcctaccaagacgccaccctcgtcgggggccacagccggccctgggctgcctggtcaaggactacgttcctatatactgtctgagcgggctggcaaggcgcatagntnnnnnnnnnnnnnnn

SEQ ID NO: 192149 - DNA, 554 bp, Homo sapiens
  misc_feature: GYAE6OF01C8G0G.44.23.C01.1.454.CMB.1.raw
  modified_base (273)..(273): a, c, t, g, unknown or other
  misc_feature (273)..(273): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (546)..(546): a, c, t, g, unknown or other
  misc_feature (546)..(546): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaaagggggngacggcccctaaggtcctcgtctctcgtgaaaccagactggaaggtagacgtcccgtccaggttcagtgccagtccgaggtggtgggccggagtccacgtctcacattagcgacctgcggctgaagtntctgctaacttattcngtcagcagtntcatagtcnccccgtttntacttttggccaaggggaccaagctaggaaacttacgaaacgactggtcggtactcgccacccgattcttggtcctttacacttccttccccgcctatccngtattaac

SEQ ID NO: 192150 - DNA, 228 bp, Homo sapiens
  misc_feature: GYAE6OF01ELGGU.44.23.C01.1.454.CMB.1.raw
  modified_base (219)..(228): a, c, t, g, unknown or other
  misc_feature (219)..(228): n is a, c, g, or t
tcagacagtatatacacgaccggtgctcgatttagtacacgtgattagggagttgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnnnnnnnn

SEQ ID NO: 192151 - DNA, 614 bp, Homo sapiens
  misc_feature: GYAE6OF01A7N0V.44.23.C01.1.454.CMB.1.raw
  modified_base (267)..(267): a, c, t, g, unknown or other
  misc_feature (267)..(267): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggtgctgttgcctggttcaacgaaaaggggngaggccctaaggtcctcgtctctcgtgaaccagactggaaggtagagtccgtcaggttcagtgccagtcaggtggtgggcgagtccactctcactatacgcgactgcggctgaagattctgctaacttattctgtcagctagtatcatacgtcgtccccgtttctacttttcgggacctaacgggggaaccctaaggtccgtaagggtaaaacttacgaaaaccggtaacttacgggtacggtaccttacggacctaacccgtaatttcccgttaggtttaccctttacgtaacctttccccgtttaccccccggaccttaactttcccgttaggtaactttaaacg

SEQ ID NO: 192152 - DNA, 579 bp, Homo sapiens
  misc_feature: GYAE6OF01AJZ4C.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggnaggcccctaaggtcctcgtctctcgtgaaaccngactggaaggtagagtcccgtcaggttcagtgccagtccaggtggtgggccggagtccactctcaccattagcgacctgcggcctgagattctgcaacttattctgtcagcagtatcatagtcgtccccgttcactttttcgggcctacgggggacccaaggtccgtagggaaactaccgaaaacggtaacttggtacggccttacgaccacccgtaattccgtaggttcctttaccacttcccgtttcccccgcctaacttcctgtaattaacg

SEQ ID NO: 192153 - DNA, 219 bp, Homo sapiens; identical to SEQ ID NO: 192129
  misc_feature: GYAE6OF01EDD5P.44.23.C01.1.454.CMB.1.raw
  modified_base (218)..(219): a, c, t, g, unknown or other
  misc_feature (218)..(219): n is a, c, g, or t

SEQ ID NO: 192154 - DNA, 222 bp, Homo sapiens
  misc_feature: GYAE6OF01CGVU1.44.23.C01.1.454.CMB.1.raw
  modified_base (218)..(222): a, c, t, g, unknown or other
  misc_feature (218)..(222): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnn

SEQ ID NO: 192155 - DNA, 221 bp, Homo sapiens
  misc_feature: GYAE6OF01C97AD.44.23.C01.1.454.CMB.1.raw
  modified_base (219)..(221): a, c, t, g, unknown or other
  misc_feature (219)..(221): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnn

SEQ ID NO: 192156 - DNA, 520 bp, Homo sapiens
  misc_feature: GYAE6OF01AUE5Q.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
  modified_base (438)..(438): a, c, t, g, unknown or other
  misc_feature (438)..(438): n is a, c, g, or t
  modified_base (491)..(491): a, c, t, g, unknown or other
  misc_feature (491)..(491): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaagggggnaggccctaaggtcctcgtctctcgtgaaaccngactggaaggtagagtcccgtcaggttcagtgccagtccagggtggtgggccggagtccactctcaccatagcgacctgcggcctgaacgnttctgctaacttatttctgtcagctagtatcatagtcgcccgttntacttttggccagggaccaagctaggaaactacaaacgactgtagctgcactntctgtctcatccttccgctatctgtntac

SEQ ID NO: 192157 - DNA, 421 bp, Homo sapiens
  misc_feature: GYAE6OF01DLP43.44.23.C01.1.454.CMB.1.raw
  modified_base (416)..(421): a, c, t, g, unknown or other
  misc_feature (416)..(421): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgataggccctggtaccagcgagtggtacctctactactactctctggacgtctggggccagggaccgcggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatagnnnnnn

SEQ ID NO: 192158 - DNA, 544 bp, Homo sapiens
  misc_feature: GYAE6OF01CO8Z5.44.23.C01.1.454.CMB.1.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (395)..(395): a, c, t, g, unknown or other
  misc_feature (395)..(395): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccngactggaagtagagtcccgtcaggttcagtgccagtccaggtggtcggccggagtccactctcaccattagcgacctgcggcctgaagtntctgcaacttatttctgtcagcagtatcatagtcgtccccgttctacgttttcggaccgtaaggggaccaaggtcgtaggaaactacaaacgtaactgtggctggcaccatctcgttcttcacttccttcccgacctatctgtattaac

SEQ ID NO: 192159 - DNA, 539 bp, Homo sapiens
  misc_feature: GYAE6OF01DROV2.44.23.C01.1.454.CMB.1.raw
  modified_base (272)..(272): a, c, t, g, unknown or other
  misc_feature (272)..(272): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccagactggaaggtagagtcccgtcaggttcagtgccagtccaggtggtgggccgagtccactctcaccattagcgacctgcggcctgaagtnttctgctaacttatttctgtcagcagtatcatagtcgtccccgttntacgttttcggccgtaggggacccaaggtctaggaaactcaaacgactgtggctgcacctatctgtccttcacttcccttcccgctattcctgattac

SEQ ID NO: 192160 - DNA, 148 bp, Homo sapiens
  misc_feature: GYAE6OF01DCCD1.44.23.C01.1.454.CMB.1.raw
  modified_base (132)..(148): a, c, t, g, unknown or other
  misc_feature (132)..(148): n is a, c, g, or t
tcagacagtatatacacgaccggtgctcgatttagtacacgtgattagggagttgggcacagcggccctgggctgcctggtcaaggactacttccacgtctactgctgtagcgggctggcaaggcgcatagnnnnnnnnnnnnnnnnn

SEQ ID NO: 192161 - DNA, 581 bp, Homo sapiens
  misc_feature: GYAE6OF01D5LKG.44.23.C01.1.454.CMB.1.raw
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (406)..(406): a, c, t, g, unknown or other
  misc_feature (406)..(406): n is a, c, g, or t
tcagacagtatatacacgaccggtgctcgatttagtacacgtgattagggattgggggaggtcagaccctgtcaggggacgagcatggacatgagggtccccgctcagctcctggggctcctgctgctctggctcccaggttcgagatgtgacagtcgagatgacccagtctccttccttcctgtcttcttctgttggaggcagcgtcaccatcacttgccgggcgagtcaggtcgttttcggngctgttgccttggttacaaacgaaaaagggggnacggcccctaaggtcctacgtctctcgtgaaaccagactggaaggtagacgtcccgtcaggttcagtgccagtccaggtggtgggccggagtccactctcaccattacgcgacctgcggcctggaagtntctgctaacttatttctgtcagtcagtactacatagtcgtcccccgtttctaccgttttcgggccgtaacggggacccaaggcgtaggaaactacgaaacgacgttggtacggctcgacctaccgtacttcttcgttccttacacttcccttccccgacctattctgtattaacg

SEQ ID NO: 192162 - DNA, 663 bp, Homo sapiens
  misc_feature: GYAE6OF01CI0DN.44.23.C01.1.454.CMB.1.raw
  modified_base (275)..(275): a, c, t, g, unknown or other
  misc_feature (275)..(275): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgccttggtttcaaacgtaaaaagggggngacggcccctaaggtcctcgtctctcgtgaaaccagactggaaggtagagtcccgtcaggttcagtgccagtccaggtggtggggccggagtccactctcaccattagcgacctgcggcctgaagtnttctgctaacttatttcngtcagcagttatctattacgtcgtccccgtttctacgtttttcgggacccgtaacgggggaaccctaaacgggccgttaaggggaaaaacttacccgaaaaaaccggtaacgttacgggttacgggaccttacggacctaaccccgttaagtttcccgttacggtttcccttttacccgaaacgttttcccccgtttaccccccggtacccttaacgtttccctttagggtaaactttaaacg

SEQ ID NO: 192163 - DNA, 532 bp, Homo sapiens
  misc_feature: GYAE6OF01BT9M4.44.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtaaaaccngactggaaggtagagtcccgtcaggttcagtgccagtccaggtggtgggccggagtccactctcaccattagcgacctgccgctgaagattctgctaacttatttctgtcagcagtatcatagtcgccccgttctacttttggcctacggggaccaagcgtagggaaatacaaacgaactgtgctgcaccatctgtcttcacttccttcccgccactctgtattatac

SEQ ID NO: 192164 - DNA, 223 bp, Homo sapiens
  misc_feature: GYAE6OF01BGAOP.44.23.C01.1.454.CMB.1.raw
  modified_base (219)..(223): a, c, t, g, unknown or other
  misc_feature (219)..(223): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnnn

SEQ ID NO: 192165 - DNA, 164 bp, Homo sapiens
  misc_feature: GYAE6OF01C6ZNY.44.23.C01.1.454.CMB.1.raw
  modified_base (133)..(164): a, c, t, g, unknown or other
  misc_feature (133)..(164): n is a, c, g, or t
tcagacagtatatacacgaccggtgctcgatttagtacacgtgattagggagttgggcacagcggccctgggctgcctggtcaaggactacttccacgtctactgctggtagcgggctggcaaggcgcatagnnnnnnnnnnnnnnnnnnnnnnnnnnnnnnnn

SEQ ID NO: 192166 - DNA, 617 bp, Homo sapiens
  misc_feature: GYAE6OF01B3A4J.44.23.C01.1.454.CMB.1.raw
  modified_base (270)..(270): a, c, t, g, unknown or other
  misc_feature (270)..(270): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacgaaaagggggngaggcccctaaggtcctcgtctctcgtagaaaccagactggaaggtagacgtcccgtcaggttcagtgccagtccaggtggtgggccggagtccactctcaccattacgcgacctgcggcctgaagnttctgctaacttatttctgtcagctagtatctatacgtcgtcccccgtttctaccgtttttcgggcccgtaagggggaacccaaaggtccgttaagggaaaacttaccgaaaaccggtaaccttgggtacgggtacctcggacctaacccgtattacccttggttccctttacctaactttcccctttccccggaccctaatttccttagtaacttaacg

SEQ ID NO: 192167 - DNA, 534 bp, Homo sapiens
  misc_feature: GYAE6OF01A7NW5.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtggcatcgagatgacccagtctccttccttcctgtcttcttctgttggaggcagcgtcaccatcacttgccgggcgagtcaggtcgttttcggngctgttgcctggtttcaacaaaaagggggnaggccctaaggtcctcgtctctcgtgaactagactggaagtagagtccgtcaggttcagtgccagtccaggtggtgggccggagtccactctcaccattagcgacctgcggcctgaacgattctgcaacttatttctgtcagcagtatcatacgtcgccccgttcacttttcggccgtaggggaccaaggctaggaaactcgaaacgtactggtggctgaccacattctgtccttctattccttccccgctatctgtattaac

SEQ ID NO: 192168 - DNA, 223 bp, Homo sapiens
  misc_feature: GYAE6OF01CS3O5.44.23.C01.1.454.CMB.1.raw
  modified_base (218)..(223): a, c, t, g, unknown or other
  misc_feature (218)..(223): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggatacttccacgtctactgctgagcgggctggcaaggcgcatagnnnnnn

SEQ ID NO: 192169 - DNA, 561 bp, Homo sapiens
  misc_feature: GYAE6OF01AJTL0.44.23.C01.1.454.CMB.1.raw
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (415)..(415): a, c, t, g, unknown or other
  misc_feature (415)..(415): n is a, c, g, or t
tcagacagtatatacacgaccggtgctcgatttagtacacgtgatttagggtaggttggggagtcagaccctgtcaggggacagcatggacatgagggtccccgctcagcctcctggggctcctgctgctctggctcccaggttcgagatgtgacatcgagactgaccctagtctccttccttcctggtcttcttctgttggaggcagcgtcaccatcacttgccgggcgagtccaaggtcgttttcggngctgttgcctggtttcaacaaaaggggnaggcccctaagggtccctcgtctctcgtgaaaccagaactggaaggtagagtcccgtccaggttcagtcgccagtccaggtcggtcgggccggagtccacgtctcgaccattacgcgacctgcggcctgaagattcngcaacttattctgtcagctagtatcatacgtcgcccctttcacttttcgggcctagggggaccctaaggcgtagggaaacttcgaaacggactggtaggcgtagcaccgtatcctggtcttcacttcccttcccgccatctgctac

SEQ ID NO: 192170 - DNA, 543 bp, Homo sapiens
  misc_feature: GYAE6OF01ATZH5.44.23.C01.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnaggccctaaggtcctcgtctctcgtgaaaccngactggaaggtagagtcccgtcaggttcagtgccagtccagggtggtgggccggagtccactctcaccattacgcgacctgcggcctggaagattctgactaacttatttctgtcagcagtatcatagtcgtccccgttntacgttttgggacctaggggaccaaggcgtaggaaactcaaacgactggtggctgcaccatctcgtcttacacttccttcccgactattcctgattaacg

SEQ ID NO: 192171 - DNA, 590 bp, Homo sapiens
  misc_feature: GYAE6OF01BS3DM.44.23.C01.1.454.CMB.1.raw
  modified_base (270)..(270): a, c, t, g, unknown or other
  misc_feature (270)..(270): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaaggggnaggccctaaggtcctcgtctctcgtgaaaccagactggaaggtagagtcccgtcaggttcagtcgcagtccgaggtggtcgggccggagtccactctacacctattacgccgacgtggccggtcctagaacgtacttctcgtactaactttatttcgtcgtacagtactagtactactaatacgtccgtccccttacttacgttttcgggaccggtaagggaaccaaggtcgtaaggtaaactacgaaacgtacgtggtacggctcgaccactacttctcgttcttacacttcccttacccgactattcgtagtattaac

SEQ ID NO: 192172 - DNA, 543 bp, Homo sapiens
  misc_feature: GYAE6OF01DS343.44.23.C01.1.454.CMB.1.raw
  modified_base (534)..(534): a, c, t, g, unknown or other
  misc_feature (534)..(534): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatgggagtggattggtgacatccattatactggggcgacgtactactctccgtccctcaagagtcgtctcaccatttcgagggacacgtccatgaaccgtcttctccctagaactgaccctccgtgaccgccgcgacacggtccgtttattctgtgcgaggcgagactggtctttcaatcgtagtgggccgtggcctacccgtggtccacgttcgtctcccgtcacgtccttccgacccacgggcccngttccccgg

SEQ ID NO: 192173 - DNA, 220 bp, Homo sapiens
  misc_feature: GYAE6OF01DU4PU.44.23.C01.1.454.CMB.1.raw
  modified_base (218)..(220): a, c, t, g, unknown or other
  misc_feature (218)..(220): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnn

SEQ ID NO: 192174 - DNA, 714 bp, Homo sapiens
  misc_feature: GYAE6OF01ACDLB.44.23.C01.1.454.CMB.1.raw
tcagacagtatatacacgaccggtgctcgatttagtacacgtgattagggattgggggagtcagaccctgtcaggggacagcatggacatgacgggtccccgctcagctccgtgggctcctgctgctctggctccaggttcgagatgtgacatcgagactcgaccctagtcctccttccttcctgttcttcttcgtggttggacggcagcgtcaccatcgtacgttcggccgggacgtagtcgtacgggttcgttttcggcgtctggttcgtcgttacggttaacgaaacggtaaaacgggggcgacggtacccgttaacggtcctacgtctcgtacgtacgaaaccgagtacgtaggaacggtacgtacgtcccgtacgagttcgagtcgccgtaggtcggtagggtcgggtcggggccggtactcctacgtcctactaaccgtagttacgccgtaccgtcggaccggtacctaggtaacgtactttccgtagtacctttaacgtttcttcgtacgtactaacgtactaagtactacgtaacgttccgtcccgttccccgttagttaccggttaccggacggtaaccggtaacctaacggtacgtaacggaaactacgaaacgtcgtggtcggactccgacctaacctcgttaccgttcgtaccgttacctaccttcccgttacccgtacttagtcttacgtaagtttaaacg

SEQ ID NO: 192175 - DNA, 478 bp, Homo sapiens
  misc_feature: GYAE6OF01CSXMP.44.23.C01.1.454.CMB.1.raw
  modified_base (206)..(206): a, c, t, g, unknown or other
  misc_feature (206)..(206): n is a, c, g, or t
  modified_base (446)..(446): a, c, t, g, unknown or other
  misc_feature (446)..(446): n is a, c, g, or t
  modified_base (451)..(478): a, c, t, g, unknown or other
  misc_feature (451)..(478): n is a, c, g, or t
tcagacagtatatacacgaccggtgctcgatttagtacacgtgatttagggtagttggggaaagtcagcctataatggaaagcaccagcgtaataacccatccctcaagagtccggactcaccatcctcccgtcgaccacgtccaagagacagatgtccctgagtctgacgtctgtgaccgccgcggacgcggcctgtgtatttcngtgcgagaggccctggtacccagcgagtggtaccctctactactacgtctctaggacgtctggggccaaggggaccgcggtcaccgtctcctcagcctccacaggccccagtccggtccttccccctggcctacccctcctcccaaagacgacaaccctaccgtcgggggcacgagccggccctgggctgccttggtcaaggctactcctatatactgctcgacgcgggctggcaaggcncatgnnnnnnnnnnnnnnnnnnnnnnnnnnnn

SEQ ID NO: 192176 - DNA, 560 bp, Homo sapiens
  misc_feature: GYAE6OF01ANXMF.44.23.C01.1.454.CMB.1.raw
  modified_base (274)..(274): a, c, t, g, unknown or other
  misc_feature (274)..(274): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaaacgaaaagggggnacggccctaaggtcctcgtctctcgtgaaaccagactggaaggtacgacgtcccgtcaggttcagtcgccagtccagggtggtgggccggagtccactcctcacctattacgcgacctggccggcctagaagtacttctgactaacttattctgtcagtctagtatacatacgtcgtcccgttctacgtttcggccgtacgggaccaggtctaggaaactacgaaacgacgtgtacggctgaccacgtactctgtcttcacttcccttcccacctatctgattaac

SEQ ID NO: 192177 - DNA, 612 bp, Homo sapiens
  misc_feature: GYAE6OF01C7W5J.44.23.C01.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
  modified_base (451)..(451): a, c, t, g, unknown or other
  misc_feature (451)..(451): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggnagtcaggtcgttttcggngctgttgcctggttcaacgaaaaggggnaggccctaaggtcctcgtctctcgtagaaaccagactggaaggtagagtcccgtcaggttcagtgtcngtccaggtggtgggccgagtccactctcaccattacgcgtacctggccggcctagaagtattcgtagtactaactttatttctgtcagtcagtatcattacgtcgtccccgtttntaccgttttcgggcccgtaagggggacctaaggtaccgttagggaaaacttccgaaaacggtacgtaggtacggcttacgaccctaccgtaattccgttacgttccttttaccaacctttccccgtttcccccggaccttacgttccttagtaactttaac

SEQ ID NO: 192178 - DNA, 533 bp, Homo sapiens
  misc_feature: GYAE6OF01B6W6S.44.23.C01.1.454.CMB.1.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggttcaacgaaaaggggnaggccctaaggtcctcgtctctcgtgaaaccngactggaaggtagagtcccgtcaggttcagtgccagtccaggtggtgggccggagtccactctcaccattacgcgacctgcggcctgaagnttctgctaacttatttctgtcagcagtatcatacgtcgtccccgttctacgttttcggccaggggaccaaggcgtaggaaactacgaaacgtactgtcggctgcacctatctgttctttactcttcccgcatctntatntac

SEQ ID NO: 192179 - DNA, 519 bp, Homo sapiens
  misc_feature: GYAE6OF01EV8Z9.44.23.C01.1.454.CMB.1.raw
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttgttttcggtgctgttgcctggtttcaacgaaaaagggggnaggccctaaggtcctcgtctctcgtgaaaccngactggaaggtagagtcccgtcaggttcagtgccagtccaggtggtgggccggagtccactctcacctattacgcgacctgcggcctgaagnttctgactaacttatttctgtcagctagtatcatagtcgccccgttntacgtttggcctaggggaccaagctaggaatcaaacgactgtggctgcacntctgtctcntcctccgcatctgnta

SEQ ID NO: 192180 - DNA, 647 bp, Homo sapiens
  misc_feature: GYAE6OF01C0U6O.44.23.C01.1.454.CMB.1.raw
  modified_base (272)..(272): a, c, t, g, unknown or other
  misc_feature (272)..(272): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaacgaaaaggggnaggcccctaaggtcctcgtctctcgtgaaaccagactggaaggtagagtcccgtcaggttcagtgccagtccaggtggtgggccggagtccactctcacattagcgacctgccggcctgaagtnttctgctaactttatttctgtcagtcagttatcagttacgtcgtccccgtttctaccgtttttcgggaccgtaacgggggaaccctaaggtaccgttagggaaaacttacccgaaaaacggtaccgttaggtacgggtaccgtacggcccgtaacccgtaacgttcccgtttacggtttccctttacccgtaaccgtttccccgtttaccccccggtacccttaacgttccccgttagtaactttaaaccg

SEQ ID NO: 192181 - DNA, 518 bp, Homo sapiens
  misc_feature: GYAE6OF01EI0IE.44.23.C01.1.454.CMB.1.raw
  modified_base (271)..(271): a, c, t, g, unknown or other
  misc_feature (271)..(271): n is a, c, g, or t
  modified_base (440)..(440): a, c, t, g, unknown or other
  misc_feature (440)..(440): n is a, c, g, or t
  modified_base (484)..(484): a, c, t, g, unknown or other
  misc_feature (484)..(484): n is a, c, g, or t
  modified_base (516)..(516): a, c, t, g, unknown or other
  misc_feature (516)..(516): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaagggggngaggcccctaaggtcctcgtctctcgtgaaaccagactggaaggtagagtcccgtcaggttcagtgccagtccaggtggtgggccggagtccactctcaccattagcgacctgcggcctgaagattctgctaacttatttctgtcagcagtatcatagtcgccccgttntactttcggccaggggaccaagtctaggaaactcaaacgactgngctgcacatctgtctcatccttccgcatctgnta

SEQ ID NO: 192182 - DNA, 536 bp, Homo sapiens
  misc_feature: GYAE6OF01AK68X.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
  modified_base (503)..(503): a, c, t, g, unknown or other
  misc_feature (503)..(503): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaagggggnaggccctaaggtcctcgtctctcgtgaaaccngactggaaggtagagtcccgtcaggttcagtgccagtccagggtggtgggccgtagtccactctcaccattacgcgacctggcggcctagaacgtattctgctaactttntttctgtcagctagtatcatacgtcgcccgttnacgttttggccgtagggaccagcgtaggaaatcaaacgtactggtcgctcgcaccgtntctgtcttcattccttcccgctatctgacttaa

SEQ ID NO: 192183 - DNA, 519 bp, Homo sapiens
  misc_feature: GYAE6OF01ANXVP.44.23.C01.1.454.CMB.1.raw
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaggggngaggcccctaaggtcctcgtctctcgtgaaaccagactggaaggtagagtcccgtcaggttcagtgccagtccaggtggtgggccggagtccactctcaccattagccgacctgcggcctgaagnttctgctaacttatttctgtcagcagtatcatagtcgccccgtttctacttttggccaggggaccaggcgtagaactcaaacgactgtgctgcaccatctgtcttcattctcccgcatctgnta

SEQ ID NO: 192184 - DNA, 680 bp, Homo sapiens
  misc_feature: GYAE6OF01B730M.44.23.C01.1.454.CMB.1.raw
  modified_base (273)..(273): a, c, t, g, unknown or other
  misc_feature (273)..(273): n is a, c, g, or t
  modified_base (398)..(398): a, c, t, g, unknown or other
  misc_feature (398)..(398): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaaagggggnaggcccctaaggtcctcgtctctcgtgaaaccagactggaaggtagacgtcccgtcaggttcagtgccagtccaggtggtgggccggagtccactctcaccattacgcgacctgcggcctgaagnttctgactaacttatttctgtcagcagtatctatacgtcgtccccgttctaccgtttttcgggccgtaacggggaaccgaaacggtaccgtacgggtaaaaacttaccgaaaaaccggtaaccgttacgggttacgggtaccgttaccggaacccgtaaccccgtaacgtttacccgtttacggtttcccgttttacccgttaaccttttaccccccgttttaccccccggtaccccgttaaacccgtttacccgtttaacgggttaaacttttaaaacccg

SEQ ID NO: 192185 - DNA, 130 bp, Homo sapiens; identical to SEQ ID NO: 192138
  misc_feature: GYAE6OF01D9PQU.44.23.C01.1.454.CMB.1.raw
  modified_base (130)..(130): a, c, t, g, unknown or other
  misc_feature (130)..(130): n is a, c, g, or t

SEQ ID NO: 192186 - DNA, 551 bp, Homo sapiens
  misc_feature: GYAE6OF01BLCK9.44.23.C01.1.454.CMB.1.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (547)..(547): a, c, t, g, unknown or other
  misc_feature (547)..(547): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaacgaaaaggggnaggccctaaggtcctcgtctctcgtagaaaccagactggaagtagacgtcccgtcaggttcagtcgccagtccgagggtggtcgggccggagtccactctcaccattacgccgactgcgctgagtntcngctacttattctgtcagcagtntcatagtcgtcccgttnacgttttcggccgtaggggaccaaggtcgtacggaaattaccgaaaacgacgtgtacggtctcggacctacgattcctgttcttcacgttcctacccgctatcctagnttac

SEQ ID NO: 192187 - DNA, 606 bp, Homo sapiens
  misc_feature: GYAE6OF01C5W8C.44.23.C01.1.454.CMB.1.raw
  modified_base (447)..(447): a, c, t, g, unknown or other
  misc_feature (447)..(447): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaaagggggagaggcccctaaggtcctcgtctctcgtgaaaccagactggaaggtagagtcccgtcaggttcagtgccagtccagggtggtgggccggagtccactctcaccattagcgacctgcggcctgaagattctgctaactttatttctgtcagcagtatcatacgtcgtccccgtttntaccgtttttcgggccgtaacgggggaaccctaaaggtcgttagggaaaacttaccgaaaaccggtacttaggtacggtacctaggtacccaacccgtaacttccgttggttccctttactacttccctttcccccgacctattcctaggtattaaacg

SEQ ID NO: 192188 - DNA, 940 bp, Homo sapiens
  misc_feature: GYAE6OF01A7ZUR.44.23.C01.1.454.CMB.1.raw
tcagacagtatatacacgaccggtgctcgatttagtacacgtgattagggattgggggagtcagaccctgtcaggggacagcatggacatgagggtcccccgctcagctccctggggacgtcctccgtcgtcgtcgtccttcggtcggtcccctacccggttacgggttacggaagtagttggtacgaactacgtacggaagtagtaccgaaaccgtaacgttccctttccccttttccccttcgttcgtttccttttccttcgtttgggttagggacgacgcggtccgtacccaactactaccttacgtccggggccgggacgtacgtacggtcgggtttttccggttttcggctcgtttggttcccgtccggttttcggttaaaccaaaaaaacggggggaaaagggggtcggacccccgttaaccccggttaaccggttcccgttaccgttccttccggttacggtaaaaccccgaaaaccggtacgtacggtaaaggggtaaacggtaacggtcccccggttaccccgtacgggttacggtacgtagggtcccgaccggtaccgtaccgggtagggggttcggggtcccggggaccggttaccctacccgtaccgtttccaaccccgaacgtttaaggttaccggaccccgttacgggtccgggccccggttacgtaaagggaaactttccgtttcgacgtaaacccttttaacttttccgtttcggtcgtaacgacgtacgttaacgttacctacgtaacggtttcggtcccccccggtttaccgttacgtttttaccgggttaccggaccggggtaaacccggaactacgtacggtaaaagtaaccaaacccggtaaactggtgggcctacgtcgaaccctactattcgttcgttcctactacctttcccccggacccaatcttggtaattaac

SEQ ID NO: 192189 - DNA, 559 bp, Homo sapiens
  misc_feature: GYAE6OF01B6U1H.44.23.C01.1.454.CMB.1.raw
tcagacagtatatacacgaccggtgctcgatttagtacacgtgattagggattgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccgagggagggaatggagtggattggtgacagtcctattatacgtggggcgtacgtactactctccgtcctcaagacgtcgtctcactatttcgacggtacacgtccatcgaaccgtcttactccctagaaactcgaccctcgtacgacccgcgcgacacggtccgtttattctgtgcgaggcgagtacgtgtcttacaattctagtcggggtccgtggcctacccgtggtcctacgttcggtccttccgtcacgtccttaccaaccgacgggcccagttccccggg

SEQ ID NO: 192190 - DNA, 591 bp, Homo sapiens
  misc_feature: GYAE6OF01CMIBZ.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaagggggnacggccctaaggtcctcgtctctcgtgaaaccagactggaagtagacgtcccgtcaggttcagtgccagtccagggtggtgggccggagtccactctcaccattacgcgacctgcggcctgaatnttctgctaacttatttctgtcagctagtatctatacgtcgtccccgtttctacgttttcggccgtaacggggacctaaggtccgtagggaaacttacgaaaaccgtaacgtacggtacggaccttcggacctaacccgtagttccttacggttcctttctacttcccgttccccgcctaacttctgtaattaac

SEQ ID NO: 192191 - DNA, 546 bp, Homo sapiens
  misc_feature: GYAE6OF01EZ6P9.44.23.C01.1.454.CMB.1.raw
  modified_base (241)..(241): a, c, t, g, unknown or other
  misc_feature (241)..(241): n is a, c, g, or t
  modified_base (378)..(378): a, c, t, g, unknown or other
  misc_feature (378)..(378): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaacaaaaggggagaggccctaaggtcctcgtctctcgtgaaccagactggaaggtagagtcccgtccaggttcagtgccagtccgaggtggtcgggccggacgtccactctcaccattacgngacccccccccctgccggcctgaagattctgtactaacttatttctgtcagcagtatctatagtcgtcccgttctactttcggcgagggaccaagacgtaggaatacaaacgaactgtgcgtgcacctactctgtcttctactccttcccgacctactctgtattaac

SEQ ID NO: 192192 - DNA, 563 bp, Homo sapiens
  misc_feature: GYAE6OF01BYX0I.44.23.C01.1.454.CMB.1.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (558)..(558): a, c, t, g, unknown or other
  misc_feature (558)..(558): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggttacgaaaaaaggggngacggcccctaaggtcctcgtctctcgtagaaaccagactggaaggtagacgtcccgtcaggttcagtgccagtccgagggtggtgggccggagtccactctcacattacgcgacctgcggcctgaacgattctgctaacttatttctgtcagctagtatcattacgtcgtccccgttctacgttttcggccgtacggggaccaaggtcgtaggtaaactacgaaacgacgtggtcgctcggccacctagtccgtgttcttcacttcccttcccgctacttctgtaattnttaac

SEQ ID NO: 192193 - DNA, 571 bp, Homo sapiens
  misc_feature: GYAE6OF01EJ3SL.44.23.C01.1.454.CMB.1.raw
  modified_base (420)..(420): a, c, t, g, unknown or other
  misc_feature (420)..(420): n is a, c, g, or t
tcagacagtatatacacgaccggtgctcgatttagtacacgtgattagggattgggggagtcagaccctgtcaggggacagcatggacatgagggtccccgctcagctcctggggctcctgctactctggctccgaggtgccagatgtgacatccagatgacccagtctccatccctccctgtctgcatctgtcggagacagagtcaccatcacttgccggacaagtcagagcattagaactctttaaatggtatcagcagaggcagggaagcccctcaactcctgatctatgctgcgtcctatttgacaaagtgggtcccatcaaaggttcagtggcagtggatcgtggacaggtatttcacttctacacctatcagcagtctgactaacctgaactatttcgactagtctttaatttntggtacaagtagtaagtacgtaacgtaattacgtcccgtactaccgttaaccggttttccgggaacgggtaacggggtaaccctaggttttaggacgggtagtaacgttaaacccaaaacggtaacttaggtcgggtcttacggaaccccg

SEQ ID NO: 192194 - DNA, 429 bp, Homo sapiens
  misc_feature: GYAE6OF01CUHPR.44.23.C01.1.454.CMB.1.raw
  modified_base (335)..(335): a, c, t, g, unknown or other
  misc_feature (335)..(335): n is a, c, g, or t
  modified_base (424)..(429): a, c, t, g, unknown or other
  misc_feature (424)..(429): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggccaggggaccgcggtcaccgtctcctcacgcctccaccaagggcccatccggtccttccccctggccaccctcctccaagngccacctcgtggggcacgacgcggccctgggctgcctggtcaaggctacttcctatatactgtctgagcgggctggcaaggcgcatagnnnnnn

SEQ ID NO: 192195 - DNA, 418 bp, Homo sapiens
  misc_feature: GYAE6OF01CW8TI.44.23.C01.1.454.CMB.1.raw
  modified_base (415)..(418): a, c, t, g, unknown or other
  misc_feature (415)..(418): n is a, c, g, or t
tcagacagtatatacacgaccggtgctcgatttagtacacgtgattagggattggggaagtcagccacaatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggccaggggaccgcggtcaccgtctcctcagcctcaccaagggccccatcggtcttccccctggcaccctcctccaagagcacctctggggcacagcggcctggctgcctggtcaaggactacgttccatatactgtctgagcgggctggcaaggcgcatagnnnn

SEQ ID NO: 192196 - DNA, 539 bp, Homo sapiens
  misc_feature: GYAE6OF01CFB3L.44.23.C01.1.454.CMB.1.raw
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (445)..(445): a, c, t, g, unknown or other
  misc_feature (445)..(445): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacgatcgagatgacccagtctccttccttcctgtcttcttctgttggaggcagcgtcaccatcacttgccgggcagtcaggttcgttttcggngctgttgcctggtttcaaacgaaaaagggggnaggccctaaggtcctcgtctctcgtgaaaccngactggaaggtagagtcccgtcaggttcagtgcagtccagggtggtggggccgagtccactctcaccattagcgacctggccggcctgaatattctgctaactttatttctgtcagctagtatcatagtcgccccgttnacgttttgggctaggggaccaaggctaggaaactacgaaacgactgtggctcgacacctattctagtcttcacttcctcccgctatctgaatta

SEQ ID NO: 192197 - DNA, 558 bp, Homo sapiens
  misc_feature: GYAE6OF01CVW26.44.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccngactggaaggtagagtcccgtcaggttcagtgccagtccaggtggtggccggagtccactctcaccattacgcacctgccggcctggaagtnttctgctaactttatttctgtcagcagtatcatagtcgtccccgtttctactttttcgggcccgtaagggggacccaaaggtccgtagggaaacttacgaaaacgtactaggtggactgccaaccgattctgttcttcattccttcccgctatcctgattaa

SEQ ID NO: 192198 - DNA, 630 bp, Homo sapiens
  misc_feature: GYAE6OF01CKRR9.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaagggggnaggcccctaaggtcctcgtctctcgtgaaaccagactggaaggtagacgtcccgtccaggttcagtgccagtccaggtggtgggccggagtccatctcaccattagccgacctggccggcctgaacgtattctgctaactttatttactgtcagcagtactactattacgtcgtcccccgtttctacctttttcgggaccgtaacgggggaccaagtaccgtagggtaaactaccgtaaaccggtaacgttacggtacgggtaccgttcgaccgtaaccctaacgttccgttacggttcctttacctaactttcccgtttcccccggtaccctactttaccgttagtaatttaaaccg

SEQ ID NO: 192199 - DNA, 595 bp, Homo sapiens
  misc_feature: GYAE6OF01D72XH.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggtttcaacgaaaagggggnaggccctaaggtcctcgtctctcgtgaaaccagacgtggaaggtagagtcccgtcaggttcagtgccagtccaggtggtgggccggagtccactctcacctattagcgactgcggcctgaagtattctagtctaacttatttctgtcagctagtatcatacgtcgtccccgtttctacgttttcgggaccgaggggacctaagtccgtaaggtaaactaccgaaaacgtaacgtgtacgggacgtacgaccgtaaccctnttacgttcgttcccttactacgttacccgtttcccccggaccttacgttcctcggtaaattaacg

SEQ ID NO: 192200 - DNA, 540 bp, Homo sapiens
  misc_feature: GYAE6OF01B8A0I.44.23.C01.1.454.CMB.1.raw
  modified_base (387)..(387): a, c, t, g, unknown or other
  misc_feature (387)..(387): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggaggggaatgggagtgggagttggtgacatccattatactggggcgacgtactactctccgtcctcaagagtcgtctcacctatttcgaggacacgtccatcgaaccncttcctccctagaactcgacctccgtcgaccgccgcggacaccggtccgtttattcgtgtgcgaggcgagacgtggtcttcattcgtagtggggcctggcctaccgtgtctactgtcctcctcagtccttccaccaacgggcccagttcccgg

SEQ ID NO: 192201 - DNA, 533 bp, Homo sapiens
  misc_feature: GYAE6OF01CN2X0.44.23.C01.1.454.CMB.1.raw
  modified_base (271)..(271): a, c, t, g, unknown or other
  misc_feature (271)..(271): n is a, c, g, or t
  modified_base (393)..(393): a, c, t, g, unknown or other
  misc_feature (393)..(393): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (529)..(529): a, c, t, g, unknown or other
  misc_feature (529)..(529): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnacggccctaaggtcctcgtctctcgtgaaaccagactggaaggtagacgtcccgtcaggttcagtgccagtccaggtggtgggccggagtccactctcaccattagcgacctgcggctgaanttctgctaacttatttctgtcagcagtatcatgtcnccccgtttntacttttggccgaggggacccaggtcctaggaaactcgaaacgtactggtcgctgacaccatctgtcttcattccttcccgctattctgtnttac

SEQ ID NO: 192202 - DNA, 520 bp, Homo sapiens
  misc_feature: GYAE6OF01B2S1O.44.23.C01.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (391)..(391): a, c, t, g, unknown or other
  misc_feature (391)..(391): n is a, c, g, or t
  modified_base (437)..(437): a, c, t, g, unknown or other
  misc_feature (437)..(437): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaacgaaaaggggnaggcccctaaggtcctcgtctctcgtgaaaccagactggaaggtagagtcccgtcaggttcagtgccagtccagggtgtgggccggagtccactctcacattagcgacctgcggcctgaagnttctgctaacttatttctgtcagcagtatcatagtcgtccccgttnacttttggaccaggggaccaaggcgtaggaaatcaaagactgtagctgccacatctgtcttcacttccttcccgcatctgata

SEQ ID NO: 192203 - DNA, 423 bp, Homo sapiens
  misc_feature: GYAE6OF01B6FY9.44.23.C01.1.454.CMB.1.raw
  modified_base (416)..(423): a, c, t, g, unknown or other
  misc_feature (416)..(423): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacagcggccctggctgcctggtcaaggactacttcctatatactgtctgagcgggctggcaaggcgcatagnnnnnnnn

SEQ ID NO: 192204 - DNA, 655 bp, Homo sapiens
  misc_feature: GYAE6OF01BRU9B.44.23.C01.1.454.CMB.1.raw
  modified_base (252)..(252): a, c, t, g, unknown or other
  misc_feature (252)..(252): n is a, c, g, or t
  modified_base (430)..(430): a, c, t, g, unknown or other
  misc_feature (430)..(430): n is a, c, g, or t
  modified_base (454)..(454): a, c, t, g, unknown or other
  misc_feature (454)..(454): n is a, c, g, or t
tcagacagtatatacacgaccggtgctcgatttagtacacgtgattagggtagttgggggagtcagaccctgtcaggggaccagcgatggacgatcgagggtccccgctcagctcctggggctcctgctgctctggctccaggttcggagtatgtgacatcgagatgacccagtctcctttccttcctggtacttcttctgttggagcagcgtcaccatctacttgccggcgtagtcaggttcgttttcggngctaggttgccttggtttccaaaccgaaaaagggggcgtacggcccctaaggtcctacgtctcgtacgtagaaaccagacgtggaaggtacgcgtcccgtctaggtcagtgccagtcgagggtggtgggccgagtcctactctcaccattacgcgtacctgccggtcctaggaacgtnttaccgtgtaccttaaacgttttntttcgtagttacaagtctaggtatctaagttcgtacgtccccgttatacccgttttgggacccgtaggggtaaccctaaggtccgttaagggaaactacggtaaaacgtacgtggttacgggacttacggacctacgtagttccgtacgtttacctacttaccgttccctttacccgactaccttcgttaggactttaacg

SEQ ID NO: 192205 - DNA, 559 bp, Homo sapiens
  misc_feature: GYAE6OF01B5VFB.44.23.C01.1.454.CMB.1.raw
  modified_base (276)..(276): a, c, t, g, unknown or other
  misc_feature (276)..(276): n is a, c, g, or t
  modified_base (408)..(408): a, c, t, g, unknown or other
  misc_feature (408)..(408): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaaacgaaaaagggggngacggcccctaaggtcctcgtctctcgtagaaaccagacgtggaaggtagacgtcccgtcaggttcagtgccagtccagggtggtcgggccggagtccactctcacctattacgcgacctgcggcctgaagnttctgactaacttatttctgtcagctagtatcatagtcgtccccgttctacgttttcggccgtacggggaccaaggcgtaggaaactacgaaacgacgtgtcggctcgacacctatctcgtcttctacttccttcccgcctatctgtatac

SEQ ID NO: 192206 - DNA, 529 bp, Homo sapiens
  misc_feature: GYAE6OF01CPOM5.44.23.C01.1.454.CMB.1.raw
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
  modified_base (525)..(525): a, c, t, g, unknown or other
  misc_feature (525)..(525): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgctggtttcaacaaaaagggggnaggcccctaaggtcctcgtctctcgtgaaaccagactggaagtagagtcccgtccaggttcagtgcagtccaggtggtgggccggagtccactctcaccattagcgacctgccggcctggaagnttctgctaactttatttctgtcagcagtatcatagtcgccccgttntacttttgggcctaaggggacccaaggctaggaaactcaaacgactggtggctgcaccatctgtcttcatccttcccgcatctgnttac

SEQ ID NO: 192207 - DNA, 528 bp, Homo sapiens
  misc_feature: GYAE6OF01EF5OZ.44.23.C01.1.454.CMB.1.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (400)..(400): a, c, t, g, unknown or other
  misc_feature (400)..(400): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaaacgaaaaagggggnaggcccctaaggtcctcgtctctcgtgaaaccagactggaaggtagagtcccgtcaggttcagtgccagtccaggtggtgggccggagtccactctcaccattacgcgacctgccggcctagaacgtnttctgctaacttatttctgtcagcagtatcatagtcgtcccgttctacttttcggcgtaggggaccaagctaggaaatacaaacgactgtcggctgacacntctntctcatcctcccncatctgntac

SEQ ID NO: 192208 - DNA, 536 bp, Homo sapiens
  misc_feature: GYAE6OF01AB6I3.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (502)..(502): a, c, t, g, unknown or other
  misc_feature (502)..(502): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcagtcaggtcgttttcggngctgttgcctggtttcaacaaaaagggggnaggcccctaaggtcctcgtctctcgtgaaaccagactggaagtagagtcccgtcaggttcagtgccagtccaggtggtggggccggagtcccactctcaccattacgcgacctgcggcctgaanattctgctaacttatttctgtcagctagtatcatacgtcgccccgtttctacgttttgggcccgtaaggggaccaaggctaggaaactcgaaacgactgtgctgcacntctgtcttcacttccttcccgctatctgattacg

SEQ ID NO: 192209 - DNA, 758 bp, Homo sapiens
  misc_feature: GYAE6OF01EP2IZ.44.23.C01.1.454.CMB.1.raw
  modified_base (241)..(241): a, c, t, g, unknown or other
  misc_feature (241)..(241): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtctccttccttcctgtcttcttctgttggaggcagcgtcaccatcacttgccgggcgagtcaggttcgttttcggngtcttgttgccttggtttacaaacgaaaaagggggcgacggtaccccgtaaggtcctcgtctcgtacgtacgaaaccaggacgtgggaaaggtagacgtccccgtacgtaggttcagtcgccagtccgagggtggcgggccggagtccactctacactagttacgcgtacctcggccggtcctaggaacgttacttccgtacggtaaccttaacttttacgttttacgtggttaccaaggtacctaaggtttaactacctaacgttaacggttcccggttaccccccgttttaattacccgggtttttccgggaacccggtaacgggggtaaacccctaaggttaccgtaaacgggtaaaacgtaaccgtaaaaccggtacggttacgggtaccggtaccttaccggaccctaaacccgttactttacccggttacggtttacccctttaacgaaccccgtttaccccgttacccccgtacccgttaaattttccccggtaagttaacctttaaacg

SEQ ID NO: 192210 - DNA, 577 bp, Homo sapiens
  misc_feature: GYAE6OF01DVGGZ.44.23.C01.1.454.CMB.1.raw
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggtcgttttcggtgctgttgcctggtttacaacgaaaaagggggnaggcccctaaggtcctcgtctctcgtgaaaccagactggaggtagagtcccgtcaggttcagtgccagtccaggtggtggccggagtccactctcaccattagcgacctgcggctagaagattctgactaactttatttctgtcagcagtatacatacgtcgtccccgtttctacgttttcggaccgtaggggaccaagcgtaggaaacttacgaaacgtacgtagtcggactcgacaacccgtatccttaggttccttcctaacttcccctttaccccgccctaattccttagtaatttaacg

SEQ ID NO: 192211 - DNA, 511 bp, Homo sapiens
  misc_feature: GYAE6OF01ERUW1.44.23.C01.1.454.CMB.1.raw
  modified_base (270)..(270): a, c, t, g, unknown or other
  misc_feature (270)..(270): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccagactggaaggtagagtcccgtcaggttcagtgccagtccaggtggtgggccggagtccactctcaccatagcgacctgcgctgaanttcngcaacttatttctgtcagcagtatcatagtcgtcccgttnacttttggccgagggaccaagctaggaaatcaaacgactgtgctgcacgatctgtctcatcttcccgctatctgata

SEQ ID NO: 192212 - DNA, 596 bp, Homo sapiens
  misc_feature: GYAE6OF01BHEBT.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggtttcaaacgaaaaggggnaggccctaaggtcctcgtctctcgtgaaaccagactggaaggtagacgtcccgtcaggttcagtgccagtccaggtggtgggccggagtccactctcaccattacgcgtacctgccggtcctaggaagtacttctgtctaactttatttctgtcagctagtatacgtatacgtcgtccccgttctacgttttcggaccgtaaggggaaccaaggacgtaaggaaacttacgaaaaccgtacgtaggtacggtactcggtaccaaccgtattcgttacgttccttacgtacttcccgttaccccgacctacttcgtgtaattaacg

SEQ ID NO: 192213 - DNA, 601 bp, Homo sapiens
  misc_feature: GYAE6OF01D4GLK.44.23.C01.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (396)..(396): a, c, t, g, unknown or other
  misc_feature (396)..(396): n is a, c, g, or t
  modified_base (446)..(446): a, c, t, g, unknown or other
  misc_feature (446)..(446): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcggngctgttgcctggtttcaacgaaaaaggggngaggccctaaggtcctcgtctctcgtgaaccagactggaaggtagagtcccgtcaggttcagtgccagtccaggtggtgggccggagtccacgtctcaccattacgcgacctggcggcctgaaagtnttctgctaacttatttctgtcaagtcagttatcatacgtcgccccgtttntaccgttttcgggcctaagggggacccaaggtctagggtaaactacgaaacggtacttggtacggccttggaccctaaccgtacgttaccttcggttacctttccgtaactttacccgtttaccccgaccttaacttccttaggtaactttaaac

SEQ ID NO: 192214 - DNA, 576 bp, Homo sapiens
  misc_feature: GYAE6OF01A3GI6.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggtttcaacgaaaaggggnaggccctaaggtcctcgtctctcgtagaaaccngactggaaggtagagtcccgtcaggttcagtcgccagtccagggtcggtgggccggagtccacgtctcaacccattacgccgacctggccggcctagaagtacttctgctaacttatttctgtcagctagtatctatacgtcgtccccgttctacgttttcggccgtaggggaccaaggtcgtacggaaactacgaaacgtacgtggtcggtactgacctaccgagttcctggttcttacacttcccgttacccgcctattcctgtattaacg

SEQ ID NO: 192215 - DNA, 257 bp, Homo sapiens
  misc_feature: GYAE6OF01ES8MD.44.23.C01.1.454.CMB.1.raw
  modified_base (225)..(257): a, c, t, g, unknown or other
  misc_feature (225)..(257): n is a, c, g, or t
tcagacagtatatacacgaccggtgctcgattttagtacacgtgattaggggattgggggaagaggaagactgaccggtcctcccgaggagttcgaggtcgctgggcaccttgggcacgggggaggtgtgtcacaagatttgggcctctgggcacagcggccctgggctgcctggtcaaggctattccatatactgtctgagcgggctggccaaggcgcataggnnnnnnnnnnnnnnnnnnnnnnnnnnnnnnnnn

SEQ ID NO: 192216 - DNA, 514 bp, Homo sapiens
  misc_feature: GYAE6OF01D6CZN.44.23.C01.1.454.CMB.1.raw
  modified_base (505)..(505): a, c, t, g, unknown or other
  misc_feature (505)..(505): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggagaggcccctaaggtcctcgtctctcgtgaaaccagactggaaggtagagtcccgtcaggttcagtgccagtccaggtggtgggccggagtccactctcaccattagcgacctgcgcctgaagattctgcaacttatttctgtcagcagtatcatagtgccccgttcacttttggccaggggaccaagcgtggagatacaaggaactgtggctgcacatctgtctcatcttcccncatctgtaa

SEQ ID NO: 192217 - DNA, 561 bp, Homo sapiens
  misc_feature: GYAE6OF01BMOHC.44.23.C01.1.454.CMB.1.raw
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (425)..(425): a, c, t, g, unknown or other
  misc_feature (425)..(425): n is a, c, g, or t
  modified_base (470)..(470): a, c, t, g, unknown or other
  misc_feature (470)..(470): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngtctgttgccttggtttacaaacgaaaagggggnacggcccctaaggtcctcgtctctcgtacgaaaccagacgtaggaaggtagacgtcccgtacgtaggttcagtcgaccagtccgagggtcggtcggggccgagtccactctcactagttacgcgtacctgcggtctagaacgtcttcgngtactaacttattctgtcagtctagtatcagtacgtcgtcccttntacgtttcggaccgagggaccagcgtagaactcaaacgtactgcgtctgacactattctcgtcttcacttcccgtccactatctgtatacg

SEQ ID NO: 192218 - DNA, 630 bp, Homo sapiens
  misc_feature: GYAE6OF01EA47B.44.23.C01.1.454.CMB.1.raw
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttgccttggtttacaaacgaaaaagggggngaggcccctaaggtcctcgtctctcgtagaaaccagactggaaggtagacgtcccgtcaggttcagtcgccagtccagggtggtgggccgagtccactctcaccattacgcgtacctggcggcctggaagtctttctagactaactttatttctgtcagcagtatcatagtcgtccccgtttactacgttttcggaccgtacggggaaccaacggtaccgtaacggaaacttacgaaaaccgtaacgttacggtacgggtacttcgaccgtaacccgtagttacccgttcggttccctttaccgtaactttccccttcccccggaccttaacgtccgttagtaagtttaaacg

SEQ ID NO: 192219 - DNA, 221 bp, Homo sapiens; identical to SEQ ID NO: 192135
  misc_feature: GYAE6OF01D2GBR.44.23.C01.1.454.CMB.1.raw
  modified_base (218)..(221): a, c, t, g, unknown or other
  misc_feature (218)..(221): n is a, c, g, or t

SEQ ID NO: 192220 - DNA, 407 bp, Homo sapiens
  misc_feature: GYAE6OF01EWJKW.44.23.C01.1.454.CMB.1.raw
  modified_base (403)..(407): a, c, t, g, unknown or other
  misc_feature (403)..(407): n is a, c, g, or t
tcagacagtatatacacgaccggtgctcgatttagtacacgtgattagggagttgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagtagggcagttcgtcaccaactactttgaccactggggccagggaacccctggtcaccgtctcctcagcctccaccaagggcccatcggtcttcccctggcaccctcctccaagagcacctctgggggcacagcggccctgggctgcctggtcaaggactacttccacgtctactgctgagcgggctggcaaggcgcatagnnnnn

SEQ ID NO: 192221 - DNA, 520 bp, Homo sapiens
  misc_feature: GYAE6OF01EMIP0.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (491)..(491): a, c, t, g, unknown or other
  misc_feature (491)..(491): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaagggggngaggcccctaaggtcctcgtctctcgtgaaaccagactggaaggtagagtcccgtcaggttcagtgccagtccaggtggtgggccgagtccactctcacattagcgacctgcggcctgaagattctgctaacttatttctgtcagcagtatcatagtcgccccgttctacttttggccaggggaccaagcgtaggaaatcaaacgactgtgctgcaccntctgtcttcatcttcccgctatctgntac

SEQ ID NO: 192222 - DNA, 684 bp, Homo sapiens
  misc_feature: GYAE6OF01D05US.44.23.C01.1.454.CMB.1.raw
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggngcttgttgtccttggtttcaaacgtaaaaaggggggagacggacccccttaaaggtcctccggtctctcgtagaaaacccagacgtggaaggtagacgtcccgtcaggttcagtnccagtccaggtggtgggccggagtccacgtctcaccattagcgacctggccggcctagagtattcgtgactaacttatttctgtcagtctagtatcaattagtcgtcccccgtttctacgtttttcgggacccgtaacggggaacccgtaaacggtaccgtaggggtaaaacttaacccgtaaaaaccgggtaaccgttacgggttcgggtaccttaccggaccctaaacccgtacgtttccgttacggtttaccctttaccctaaccgtttccccttttaccccccggaccgtttaacccttcccgtttaggtaattttaaacccg

SEQ ID NO: 192223 - DNA, 594 bp, Homo sapiens
  misc_feature: GYAE6OF01DT79C.44.23.C01.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (421)..(421): a, c, t, g, unknown or other
  misc_feature (421)..(421): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgccttggttacaacgaaaaggggnacggcccctaaggtcctgtctctcgtgaaaccngacgtggaaggtagacgtcccgtcaggttcagtcgccagtccaggtggtcggccggagtccactctcacattacgcgtacctggccggtcctaggaacgtattctagacctaactttntttcgtgtcagctagtatctatacgtcgtaccccgttgtacgttttcgggacccgtaaggggaaccaaggtacgtacggtaaactaccgaaacgtactggtacggtctggccaaccgtgttccttaggttccttactaacttcccgttaccccgctatttcctgtacttaacg

SEQ ID NO: 192224 - DNA, 226 bp, Homo sapiens
  misc_feature: GYAE6OF01COEY9.44.23.C01.1.454.CMB.1.raw
  modified_base (217)..(217): a, c, t, g, unknown or other
  misc_feature (217)..(217): n is a, c, g, or t
  modified_base (222)..(226): a, c, t, g, unknown or other
  misc_feature (222)..(226): n is a, c, g, or t
tcagacagtatatacacgaccggtgctcgatttagtacacgtgattagggattgggggaagaggaagactgacggtcctcccaggagttcaggtgctgggcaccttgggcgacgggggaggtgtgtcacaagatttgggctctgggcacagcggccctgggctgcctggtcaaaggactacttcctaatatactgtctggagcgggctggcaaggcnatagnnnnn

SEQ ID NO: 192225 - DNA, 587 bp, Homo sapiens
  misc_feature: GYAE6OF01CIPU1.44.23.C01.1.454.CMB.1.raw
  modified_base (118)..(118): a, c, t, g, unknown or other
  misc_feature (118)..(118): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (272)..(273): a, c, t, g, unknown or other
  misc_feature (272)..(273): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
tcagacagtatatacacgaccggtgctcgatttagtacacgtgattagggaggttgggggaagaggaagactgacggtcctcccgaggagttcaggtgcgtggcaccttggcacgggngtgtgtcacgagattgggctctgggacacagcggccctgggctgacctggtacaaggctacttcctatatacgtgtctgagcgggctggcaaggcgcagtgctgngatncnagntgctntgacgatcntanagngttnacagattgcacgtatnngngcgngngngtgtgtagtagtacgtacgagcgtagagagagngagtgagtacgtgngtagtacgtacgtactactactacacgtacgacgacgtacgtacgtacgtacgtacgtacgtacgtacgtacgtacgtacgtaacgtacgttacgttacgtacgtaacgtacgtaacgtactacgttacgttaccgttacgtacggtacgtacgtacggtacggtaacggtacggtaacgtacgtaacgtacgtacgtacgtacgtagtacgtcgtacgtacgtacgtacgtacgtacgtacgtccgtaccgtaccg

SEQ ID NO: 192226 - DNA, 566 bp, Homo sapiens
  misc_feature: GYAE6OF01DQ5QK.44.23.C01.1.454.CMB.1.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttcaacgaaaagggggnaggcccctaaggtcctcgtctctcgtgaaaccngactggaaggtagacgtcccgtcaggttcagtgccagtccaggtggtgggccgagtccactctcaccattagcgtacctgcggcctagaagtattctgactaactttatttctgtcagcagtatctatacgtcgtcccgtttactacgttttcggaccgtaggggtaccaaggtcgtaggaaactacgaaacgtactcgtggctcgacctaccgtatcgtacgttccttctacttccttcccgacctattctgtattaacg

SEQ ID NO: 192227 - DNA, 221 bp, Homo sapiens
  misc_feature: GYAE6OF01BAGW4.44.23.C01.1.454.CMB.1.raw
  modified_base (214)..(221): a, c, t, g, unknown or other
  misc_feature (214)..(221): n is a, c, g, or t
tcagacagtatatacacgaccggtgctcgatttagtacacgtgattagggattgggggaagaggaagactgacggtcctcccaggagttcaggtgctgggcaccttggcacggggaggtgtgtcacaagatttgggctctgggcacagcggcctggctgcctggtcaaggctacttcctatatactgtctgagcgggctggcaaggcgcatagnnnnnnnn

SEQ ID NO: 192228 - DNA, 222 bp, Homo sapiens
  misc_feature: GYAE6OF01E3BR0.44.23.C01.1.454.CMB.1.raw
  modified_base (218)..(222): a, c, t, g, unknown or other
  misc_feature (218)..(222): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnnn

SEQ ID NO: 192229 - DNA, 577 bp, Homo sapiens
  misc_feature: GYAE6OF01EBYQH.44.23.C01.1.454.CMB.1.raw
  modified_base (402)..(402): a, c, t, g, unknown or other
  misc_feature (402)..(402): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaaagggggagaggccctaaggtcctcgtctctcgtgaaaccagacgtggaaggtagacgtcccgtcaggttcagtgccagtccaggtggtgggccggagtccactctcaccattacgcgacctgccggcctgaacgtnttctgactaacttatttctgtcagtcagtatcatacgtcgtccccgttctacttttcgggaccgtacggggaaccgaagtcgtaggaaactacgaaacgacgttgtacggtctcgaccaccgtacttctcgttcttccgtaacttccttccccgacctacttcttgtacgttaac

SEQ ID NO: 192230 - DNA, 624 bp, Homo sapiens
  misc_feature: GYAE6OF01C83FM.44.23.C01.1.454.CMB.1.raw
  modified_base (274)..(274): a, c, t, g, unknown or other
  misc_feature (274)..(274): n is a, c, g, or t
  modified_base (403)..(403): a, c, t, g, unknown or other
  misc_feature (403)..(403): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttcaaacgaaaagggggnacggcccctaaggtcctcgtctctcgtgaaaccagactggaaggtagacgtcccgtcaggttcagtgccagtccaggtggtggccggagtccactctcaccattacgcgacctgccggccttgaacgtnttcgtcgactaactttatttctggttcaggtactagtatcaattacgtcgtccccgtttctaccttttggaccgtaacgggggaccaaaggtcgtagggaaacttacgaaaacggtacttaggttacggacttacggaccaaccgtaagttccgttacggttccctttaccgtaacgtttccctttacccccggaccttacgttcctaggtaatttaaacg

SEQ ID NO: 192231 - DNA, 222 bp, Homo sapiens
  misc_feature: GYAE6OF01A0SCW.44.23.C01.1.454.CMB.1.raw
  modified_base (220)..(222): a, c, t, g, unknown or other
  misc_feature (220)..(222): n is a, c, g, or t
tcagacagtatatacacgaccggtgctcgatttagtacacgtgattagggattggggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnn

SEQ ID NO: 192232 - DNA, 558 bp, Homo sapiens
  misc_feature: GYAE6OF01EA3TZ.44.23.C01.1.454.CMB.1.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccngactggaaggtagagtcccgtcaggttcagtgccagtccaggtggtgggccggagtccactctcaccattagcgacctgcggcctgaagtnttctgactaacttatttctgtcagctagtactcattacgtcgtccccgttctacgttttcgggccgtacggggaaccaacggacgtaggaaacttacgaaacgaactgtaggctgacaccgtatctgttcttcacttccttcccgaccattctgtattaacg

SEQ ID NO: 192233 - DNA, 558 bp, Homo sapiens
  misc_feature: GYAE6OF01CDK8J.44.23.C01.1.454.CMB.1.raw
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaaacgaaaaagggggnaggcccctaagggtcctcgtctctcgtagaaaccngactggaaggtagacgtcccgtcaggttcagtgccagtccagggtggtgggccggagtccactctcaccattacgcgacctggcggcctgaagtnttctgctaactttatttctgtcagcagtatctatacgtcgtccccgtttctaccgttttcggccgtaacggggaccaaggcgtaggaaactacgaaacgtactggtggctgacacctatctgttcttctacttccttcccgctatctgtattac

SEQ ID NO: 192234 - DNA, 592 bp, Homo sapiens
  misc_feature: GYAE6OF01DQK45.44.23.C01.1.454.CMB.1.raw
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgccttggttttacaaacgtaaaaagggggagacggccccttaaggtcctcgtctctcgtgaaaccagactagggaaggtagacgtcccgtcagggttcagtgccagtccgaggtggtcggccggattcccacgtcctcaccattacgcgtacctgcggcctgaacgtnttctgctaacttntttactgtcagctagtatcagttacgtcgtcccccgtttatacgttttcggccgaacggggacctaaggcgttagggaaactacgaaacgtactggtcgactcgaccacgtattctgttccttacgtacttcccgttcccgacctatccttagtaacttaag

SEQ ID NO: 192235 - DNA, 632 bp, Homo sapiens
  misc_feature: GYAE6OF01BATGR.44.23.C01.1.454.CMB.1.raw
  modified_base (237)..(237): a, c, t, g, unknown or other
  misc_feature (237)..(237): n is a, c, g, or t
  modified_base (400)..(400): a, c, t, g, unknown or other
  misc_feature (400)..(400): n is a, c, g, or t
tcagacagtatatacacgaccggtgctcgatttagtacacgtgattagggattggggagtcagaccctgtcagggacagcatggacatgagggtcccgctcagctcctggggctcctgctgctctgactcccaggttcgagatgtgacatcgagatgacccagtctccttccttcctgtcttcttctgttggaggcagcgtcaccatcacttgccggcgagtcaggtcgttttcggngctgttgcctggttcaacgaaaaggggcaggccctaaggtcctcgtctcgtcgtgaaaccagactggaagtagacgtcccgtcaggttcagtgccagtccaggtggtcgggccggagtccactctcacctattacggcgaccgtgccggtacctggaaacgtnttcgtgtacctaactttactttcttcgtacagtcctagttatactagttaacgttcggtcccctttctacgttttcgggcccgtaacggggaccctaacggtcgtaggaaacttacgaaaaccgaacgttacggttcggaccgttacgccgtaacctaacttccgttacgtttcccgttactaactttcccgttttaccccgacccttagtttacccttggtaactttaaac

SEQ ID NO: 192236 - DNA, 569 bp, Homo sapiens
  misc_feature: GYAE6OF01B8SP1.44.23.C01.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagacagtatatacacgaccggtgctcgatttagtacacgtgattagggattgggggagtcagaccctgtcaggggacagcatggacatgagggtccccgctcagctcctggggctcctgctactctggctccgaggtgccagatgtgacatccagatgacccagtctccgtcctcactgtctgcgtctagttggggacagagtcaccatcacttgccgggcgagtgccgactattaggtacttttttggccttggtttcagcaggagcctggcaaacggcccctaagtcccctgtacttcttttctggatcctactttgaagtagtggacgtcccagccaggttcagcggcagtggttctgggacactatttcactctcaccatcagccagcctgcagcctggagtnttcgngtacttattactcgacctaataacttatttaccttttttatccgttacttacggttttaggccgtaacgggacctaaggcgtaggacgtaatacgaaaaggtacgtggtgtacgtgaccacgacttcgtcgttaccttactcttcccttaccccg

SEQ ID NO: 192237 - DNA, 567 bp, Homo sapiens
  misc_feature: GYAE6OF01EZQ2J.44.23.C01.1.454.CMB.1.raw
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttcgccttggtttacaaacgaaaaagggggngacggcccctaaggtcctcgtctctcgtagaaaccngacgtggaaggtagacgtcccgtcaggttcagtcgccagtccgaggtggtcgggccggagtccactctcacctatacgcgacctgcggcctagaagcttctgactaacttatttctgtcagctagtatactattacgtcgtccccgtttctacgttttgggccgtaacggggaaccaaggcgtaaggtaaactacgaaacgactgtggctgaccaccgtntctntcttctacttcctcccgactatctgattac

SEQ ID NO: 192238 - DNA, 598 bp, Homo sapiens
  misc_feature: GYAE6OF01CDXK9.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (398)..(398): a, c, t, g, unknown or other
  misc_feature (398)..(398): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcaggttcgttttcggngctgttgcctggtttcaacgaaaaaggggnaggcccctaaggtcctcgtctctcgtgaaaccagactggaagtagacgtcccgtcaggttcagtgccagtccaggtggtcgggccggagtccactctcaccattacgcgacctgccggcctagaagtntctgactaacttatttctgtcagcagtatctatacgtcgtccccgttcgtacttttcgggccgtaacggggacccaaggtccgtaggtaaaaccttacaaaacggtacgtacggtacgggctacgtaccgtaaccgtaacgttcgttacgttccttaccgtacttccctttccccgaccctaacttcctagtaattaacg

SEQ ID NO: 192239 - DNA, 595 bp, Homo sapiens
  misc_feature: GYAE6OF01DD6KA.44.23.C01.1.454.CMB.1.raw
  modified_base (275)..(275): a, c, t, g, unknown or other
  misc_feature (275)..(275): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaaacgaaaaagggggngacggcccctaaggtcctcgtctctcgtgaaaccagactggaaggtagagtcccgtcaggttcagtgccagtccgaggtggtgggccgagtccactctcacattcgcgacctgcggcctagaagtacttctgactaactttattctgtcagctagtactctatacgtcgtccccgtttctacgttttcggccgtaacgggaccaacggtacgtaggaaactacaaacgtacgtaggtacggtcgacgaccacctaacgttcttacggttcctttaccgtaacttcccgttccccgtacctacttaccgtgtaagttaacg

SEQ ID NO: 192240 - DNA, 980 bp, Homo sapiens
  misc_feature: GYAE6OF01DADPQ.44.23.C01.1.454.CMB.1.raw
tcagacagtatatacacgaccggtgctcgatttagtacacgtgattagggattggggatgctttctgagagtcaaggacctcctgtgcaagaacatgaagcacctgtgtttttcctcctgctggtggcagctccagatgggtcctgtcccaggtgcagctgcaggagtcgggcccaggactggtgacggccgttcgggaaccctgtctctcatctgcactgtctcgtggtagttccatcgtagttctgtatctagtttcgttggggcttggtacgttccggacgaccggccccggaaggggacgggtaagtcgggtaaggtgggtagttcgggtagtacgtaacgttaccgttaacgttacggttaccggttcgggggaccgttaaccggttaaaccgtttaccccgttaaccgttccccggttaaccccgttaaccgtaaacggttaaccggtttccggttaccctaacccgttaaccgttaaccggttttaccggaacgggtacccgttaaccggttacccgtaacgttacccggtaacccgtacgtttacccctaccccggttaaacgtaaaaccccgtttccggtaaaccccgtttcccgggtaaccggtaacccccgggtaccgggtacccgggttaacccgttaacccggggtttacccgtttttaacggtttcccggttacgggtttacgggaacccgggttaacggggtacccggttaaaggttccccggtttttacggggttacccttttaaaccgggttaacgttttacccgggtaacggggtttcccggggttaaccccgggttaccgggtaaacccccggtttacccgggtaccggggttttacccgaaaccggtttttcccggtaccccgtttaccggttaacccggtaacccgtttcccccgtttaaccccgttaaaccccggggaaccccgggttcccgttccccggtttttaacccccccgggg

SEQ ID NO: 192241 - DNA, 801 bp, Homo sapiens
  misc_feature: GYAE6OF01AURJB.44.23.C01.1.454.CMB.1.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggaggcagcgtcaccatcacttggccgggcgagtcaggttcgttttcggngtctgttgcctggtttacaaacgaaaaggggnacggccctaaggtcctcgtctcgtcgtacgaaaccaggacgtagggaaggtacgacggttccccgtaccgtaggttacaggtcgaccgtaggtccgagggtgggtcggggaccggtagtcccacgttccgtacaccgtaagttacgaccgtaccgtcggccggaccttaggaaacgttcctttaccgttacggtaccttaaaccgtttttacgttttccgttacggttaccgtaacgtaccgttaaaggtttacttaccgtaacggtttaaccggtttccccggttacccccgttttaccgtttaccggttttttaccggggaaccccgggtaacgggggggtaaacccctaaacggggtacccgtttaaacggggtaaaaaccttaacccggaaaaaccggttaaccgttacgggttacgggacccttacggaccctaacccgtacgtttaccggttacgtttaccctttaccgtacgtttccccttacccccggtacttaccgttcttacgtaactttaaccg

SEQ ID NO: 192242 - DNA, 533 bp, Homo sapiens
  misc_feature: GYAE6OF01E1R9P.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaacgaaaaagggggngaggcccctaaggtcctcgtctctcgtagaaaccagactggaaggtagagtcccgtcaggttcagtgccagtccagggtggtgggccggagtccactctcaccattagcgacctgcggctgaagnttcngctaacttatttctgtcagtcagtatcatacgtcgtccccgttctacttttggccgtaggggaccaaggctagggaaatacaaacgtaactgtggctgcacattctgtcttcattcttcccgcatctntntac

SEQ ID NO: 192243 - DNA, 502 bp, Homo sapiens
  misc_feature: GYAE6OF01AWLZV.44.23.C01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (474)..(474): a, c, t, g, unknown or other
  misc_feature (474)..(474): n is a, c, g, or t
tcagacagtatatacacgaccggtgctcgatttagtacacgtgattagggattgggggagtcagaccctgtcaggggacagcatggacatgagggtccccgctcagctcctggggctcctgctactctggctccgaggtgccagatgtgacatccagatgacccagtctccttcctccctgtctgcatctgtggganacagagtcaccatcacttgccgggnagtcagggcattagcaattattagcctggtatcagcagaaacaggaagctcaagctctgatctatagaaacatcctatttgacaatcgagggtccatcgtcgtcagcgcagtgatctgggacagattcactctcaccgtcagcagtcctgcacgcctagaagtagtattcgactactttatactgtaacaaagttactaacgagtacgtcccctacacctacgttccggaccgtaggacctagagtgaactntacagacgtaactgaggtctgacctacg

SEQ ID NO: 192244 - DNA, 596 bp, Homo sapiens
  misc_feature: GYAE6OF01A2NNU.44.23.C01.1.454.CMB.1.raw
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (418)..(418): a, c, t, g, unknown or other
  misc_feature (418)..(418): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgccttggtttacaaacgaaaaagggggnacggccctaaggtcctcgtctcgtcgtgaaaccagactggaaggtagacgtcccgtcaggttcagtcgccagtccaggtggtgggccggagtccactctacacattagccgacgtgcgctgaagtacttctgactaactttntttactgtacagcagtatctatagtcgtcccgttctacgttttcggccgtaacgggacctaacggtcctaaggtaaactacgaaacgtacgtaggtggtaccgtcgacctaaccgtacgttcttacggttccttacgtaaccttcccgtttaccccgacttaactcgtagtattaaac

SEQ ID NO: 192245 - DNA, 611 bp, Homo sapiens
  misc_feature: GYAE6OF01BX2S4.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttacaacgaaaaggggnaggccctaaggtcctcgtctctcgtagaaaccagactaggaaggtagacgtcccgtcaggtcagtcgcctagtccgagggtggtcggggccggagtccactcncaccattacgctacctgcgctganacttcngctaacttntttcngtcagctagtatacgattagtcgtccccgtttntacgttttacgggccgtaacggggaccctaaggccgttaagggaaacttacgaaaaccgtaacgttggtacgggccgttacgacccgtacccgttcgttcgttaccgtttcaactttcccgttaccccccgacttacttcccgttataacgttattaaccg

SEQ ID NO: 192246 - DNA, 703 bp, Homo sapiens
  misc_feature: GYAE6OF01EAQCI.44.23.C01.1.454.CMB.1.raw
  modified_base (273)..(273): a, c, t, g, unknown or other
  misc_feature (273)..(273): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgaggtcgttttcggtgtctgttgccttggttacaacgaaaagggggnacggcccctaaggtcctcgtctcgtcgtagaaaccagaccgtagggaaggtacgacggtccccgtacgagggttcaggtcgccagtcccgagggtggtcggggcccgagtcccactcctaccaacctattacggccgtaacctcggccgggtccctaggaaacgtactttccgtagtacctaaacttttacgtttccgtagttccgaagtcgtaagttaactaccgtaacgttacggttacccgttccccccggtttactttaccgtttttcgggaccccgtaacgggggtaaccctaaggtccgtaacggtaaaacttaccgaaaaccggtaccgttgggtaccgtctcggaccctaccgtaattccgttacggttccctttactaccgtttccccgtttaccccacttacttaccgtgtaattaaccg

SEQ ID NO: 192247 - DNA, 219 bp, Homo sapiens
  misc_feature: GYAE6OF01BMA8G.44.23.C01.1.454.CMB.1.raw
  modified_base (218)..(219): a, c, t, g, unknown or other
  misc_feature (218)..(219): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcggctggcaaggcgcatagnn

SEQ ID NO: 192248 - DNA, 614 bp, Homo sapiens
  misc_feature: GYAE6OF01DE2LK.44.23.C01.1.454.CMB.1.raw
  modified_base (274)..(274): a, c, t, g, unknown or other
  misc_feature (274)..(274): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgtggaggcagcgtcaccatcacttgccgggcgagtcaggttcgttttcgggtgctgttgccttggtttacaaacgaaaagggggngacggcccctaaggtcctcgtctctcgtagaaaccagactggaaggtagacgtcccgtcgaggttcagtcgccagtccgagggtggtcgggccggtagtccactctcacctatacgcgacctgccggctagaagtnttctgctaactttnttctgtcagcattancattacgtcgtccccgtttntacgttttcggaccgaaggggtaccaaggtctaagggaaactaccgaaaacgtacgtggtacggctacggcctaaccgtacttccttcggtttccttaccgtacctttaccccgtttcccccgactttaactttccgtaggttaacctttaaacg

SEQ ID NO: 192249 - DNA, 287 bp, Homo sapiens
  misc_feature: GYAE6OF01DATGV.44.23.C01.1.454.CMB.1.raw
  modified_base (230)..(287): a, c, t, g, unknown or other
  misc_feature (230)..(287): n is a, c, g, or t
tcagacagtatatacacgaccggtgctcgatttagtacacgtgattagggattgggggggaagtagggaagactgacggtcctcccaggagttcaggtgctgggcacccttgggcacgggggaggtgtgtcacaagatttgggctctgggcacagcgccctgggctgcctggtcaaaggctacttcctatatactgtcctgagcgggctggccaaagggcgacatacgcnnnnnnnnnnnnnnnnnnnnnnnnnnnnnnnnnnnnnnnnnnnnnnnnnnnnnnnnnn

SEQ ID NO: 192250 - DNA, 590 bp, Homo sapiens
  misc_feature: GYAE6OF01BOO3Q.44.23.C01.1.454.CMB.1.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (426)..(426): a, c, t, g, unknown or other
  misc_feature (426)..(426): n is a, c, g, or t
  modified_base (585)..(585): a, c, t, g, unknown or other
  misc_feature (585)..(585): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaaacgaaaagggggnaggcccctaaggtcctcgtctctcgtagaaccagacgtggaaggtcgacgtcccgtactaggttcagtcgcaggtccagggtggtcgggccggagtccacgtctcaccattacgcgactggccggcctagaagtcttcgtcgtactaactttntttcgtgtcagtctagtactcaagtcgtccgccccttgtacgtttcgggccgacgggtaaccacggtcgtaaggaactacgaaacgacgttggtagccgttagtaccgtatccgttgttaccttccacctttcccttccccgctaattccgtatacttntaacg

SEQ ID NO: 192251 - DNA, 526 bp, Homo sapiens
  misc_feature: GYAE6OF01BDEOZ.44.23.C01.1.454.CMB.1.raw
  modified_base (241)..(241): a, c, t, g, unknown or other
  misc_feature (241)..(241): n is a, c, g, or t
  modified_base (372)..(372): a, c, t, g, unknown or other
  misc_feature (372)..(372): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgtgccttggtttcaaacgaaaagggggagacggcccctaaggtcctcgtctctcgtgaaaccagactggaaggtagacgtcccgtccaggttcagtgccagtccagggtggtgggcggagtacactcnaccatagcactgcgctgagtnttcngctaacttatttctgtcagctagtatcatagtcgtcccgttntacgttttggccgagggaccagcgtagaaatacaacgactggtgctgaccactagtctgtcttacacttcctcccgctatctgatac

SEQ ID NO: 192252 - DNA, 442 bp, Homo sapiens
  misc_feature: GYAE6OF01CYADM.44.23.C01.1.454.CMB.1.raw
  modified_base (435)..(442): a, c, t, g, unknown or other
  misc_feature (435)..(442): n is a, c, g, or t
tcagacagtatatacacgaccggtgctcgatttagtacacgtgattagggattggggaagtcagccataatggaagcaccagctataacccgtccctcaagagtcgactcaccatcctccgtcgacaccgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtcaccgtctcctcacgcctccaccgaacgggcccagtcggtccttcccccgtggccaccctcctaccaagacgccacctcgtggggcacgacgcggccctgggcctcgcctggtcaaggactacttctatatactgtctgagcgggctggcgaaggcgacatagnnnnnnnn

SEQ ID NO: 192253 - DNA, 651 bp, Homo sapiens
  misc_feature: GYAE6OF01AOQXX.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaacgaaaagggggnacggcccctaaggtcctcgtctcgtcgtagaaaccngactggaaggtgacgtccgtcaggttcagtgccagtccgaggtggtggccggtagtccactctcacctattacgcgacctgccggcctgaacgtnttcngactaactttattctgtcagtctagtatcagtacgtcgtcccccgtttgtacgttttcgggcccgtaacgggggaccctaacggtaccgttaagggtaaaacttaccgtaaaaaccggtaccgttacgggtacgggtcctaccgggtaccctaacccgttacgttccgtttacggttaccttttaccgtacgtttcccccgttcccccgtacccgttaacttaccgttacgtaacgtttaaacc

SEQ ID NO: 192254 - DNA, 644 bp, Homo sapiens
  misc_feature: GYAE6OF01D4PL9.44.23.C01.1.454.CMB.1.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaaacgaaaagggggnacggcccctaaggtcctcgtctctcgtgaaaccngactggaaggtgagtcccgtcaggttcagtcgccagtccgagggtggtcggggccggagtcccacgtctcacctagttacgccgacctggccggtcctaggaaacgtcttctcgtactaactttatttcgtagttcaagtctaagttatcgtaattacggtccgtcccccgtttactaccgttttcgggaccgtaacgggggaccaaggtcgtaggtaaacttaccgaaacgacgttggtacggcttacggacctaccgtaacgttccgttacggtttccctttaccgtaactttccccgttaccccggtacctaacctttcgttagtatttaaacg

SEQ ID NO: 192255 - DNA, 537 bp, Homo sapiens
  misc_feature: GYAE6OF01B9SEZ.44.23.C01.1.454.CMB.1.raw
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaaggggganaggcccctaaggtcctcgtctctcgtgaaaccagactggaaggtagagtcccgtcaggttcagtgccagtccaggtggtgggccggagtccactctcaccattacgcgacctgcggcctgaatctctgctaacttatttctgtcagcagtatcatagtcgtccccgttctacttttggccgaggggtaccaagcgtaggaaatacgaaacgactaggtgctgacaccgtatctgtcttcacttccttcccgcattctgtattaac

SEQ ID NO: 192256 - DNA, 569 bp, Homo sapiens
  misc_feature: GYAE6OF01BD3P1.44.23.C01.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (458)..(458): a, c, t, g, unknown or other
  misc_feature (458)..(458): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtagaaaccngactggaaggtgacgtcccgtcaggttcagtgccagtccgagggtggtcggggccggagtcccacgtcctcacctagttacgcgtacctggccggctagaagnttctgtactaactttatttctgtcagctagtatcatagtcgtccccgttntacgttttcggcgtaggggaccaaggtctagggaaactaccgaaacgactggtaggctagaccaaccattcttcgtcttctacttcccgttcccacctattctgtattaac

SEQ ID NO: 192257 - DNA, 710 bp, Homo sapiens
  misc_feature: GYAE6OF01B4QVW.44.23.C01.1.454.CMB.1.raw
  modified_base (254)..(254): a, c, t, g, unknown or other
  misc_feature (254)..(254): n is a, c, g, or t
  modified_base (514)..(514): a, c, t, g, unknown or other
  misc_feature (514)..(514): n is a, c, g, or t
  modified_base (659)..(659): a, c, t, g, unknown or other
  misc_feature (659)..(659): n is a, c, g, or t
tcagacagtatatacacgaccggtgctcgatttagtacacgtgattagggattgggggagtcagaccctgtcgaggggacagcatggacatgacgggtccccgctcagctccgtggggctcctgctgctctggctccgaggttcgagatgtgacatcgagatcgacccagtccttccttccttcctgttcttcttcgtggttggaggcagcgtcaccatcacgttggccgggcgagtcgtaggttcgttttggngcttgttcgtccgttggttaacgaaaacggaaaaagggggctacggaccccgttaaggtcccttcgtctcgtacgtacgaaaccgtagacgtagggaacggtacgacgttcccgtacgtaggttcagtcgaccgtaggtccggagggttcgggacggggacccggtactccgaacttcctaaccaaccgtagttacggcccgtaccgttgggccggtactaaggaacgtcttcgtagtactttaacgtttatttcggtanaccgtaagtacgtaagttactacgtagttaccggtccgtaccccgtttagtaccggtttcgggacccgtaacggggaacctaggtaccgtaacgggtaaactaacggtaaaccgaccgttggtcgtacgtaccgaccgtaacctnttccgtacttcttaacctccttccccgtcccacttatactagtaatttaac

SEQ ID NO: 192258 - DNA, 532 bp, Homo sapiens
  misc_feature: GYAE6OF01EKOI5.44.23.C01.1.454.CMB.1.raw
  modified_base (270)..(270): a, c, t, g, unknown or other
  misc_feature (270)..(270): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacaaaaagggggngaggcccctaaggtcctcgtctctcgtgaaaccagactggaaggtagagtcccgtccaggttcagtgccagtccaggtggtgggccggagtccacgtctcaccattagcgacctgcggcctgaagtattctgctaacttatttctgtcagcagtatcatagtcgccccgtttctacttttggccgaggggaccaaggctaggaaatacgaaacgactgtggctgcacgatctgtcttcacttccttcccgcatctgattaac

SEQ ID NO: 192259 - DNA, 517 bp, Homo sapiens
  misc_feature: GYAE6OF01B75TT.44.23.C01.1.454.CMB.1.raw
  modified_base (419)..(419): a, c, t, g, unknown or other
  misc_feature (419)..(419): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcacgtactactctccgtccctcaagagtcgtctcaccatttcgagggacacgtccatgaaccgcttctccctgaaactgacctccgtgaccgccgcganacggcctttattctgtgcgaggcgagactggtctttcaatctatgggccgtgcaccctgtcatcgtctcctcagtcttccaccaagggcccagtccgg

SEQ ID NO: 192260 - DNA, 529 bp, Homo sapiens
  misc_feature: GYAE6OF01CQNXU.44.23.C01.1.454.CMB.1.raw
  modified_base (337)..(337): a, c, t, g, unknown or other
  misc_feature (337)..(337): n is a, c, g, or t
  modified_base (523)..(523): a, c, t, g, unknown or other
  misc_feature (523)..(523): n is a, c, g, or t
tcagacagtatatacacgaccggtgctcgatttagtacacgtgattagggattgggggagtcagaccctgtcaggggacagcatggacatgagggtccccgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggtccactcgggcctccggggtctctgacnggttcagtgccagtgcatcacacacagatttcacactgcacatcagcagagtggaggctgacgatggttgggtctagttactgctatacctaagttacctaacctaacccccgttcgaacccgttcgggcgaagggaccacgtacgttgaagtagttaacgcgtaacgtggtagcctagacaccgntcgtcg

SEQ ID NO: 192261 - DNA, 549 bp, Homo sapiens
  misc_feature: GYAE6OF01BRFR8.44.23.C01.1.454.CMB.1.raw
  modified_base (272)..(272): a, c, t, g, unknown or other
  misc_feature (272)..(272): n is a, c, g, or t
  modified_base (395)..(395): a, c, t, g, unknown or other
  misc_feature (395)..(395): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggccctaaggtcctcgtctctcgtgaaaccagactggaagtagacgtcccgtcaggttcagtgccagtccagggtggtgggccggagtccactctcaccattacgcgacctgcggctgaatntctgactaacttatttctgtcagcagtatcatacgtcgccccgttctacgttttcggaccgtaggggaacctaaggcgtaggaaactacgaaacgtaacgtggtaggctgacctacctattctgtccttcacttcctcccgctatctgattaac

SEQ ID NO: 192262 - DNA, 697 bp, Homo sapiens
  misc_feature: GYAE6OF01CPASG.44.23.C01.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctcccaggttcgagatgtgacatcgagatgacccagtctccttccttctgtcttcttcgtgttggaggcagcgtcaccatcacgttggccgggcgagtcagggttcgttttcggngcgtgttcgccttggttacaaacgaaaagggggnaggacccctaagggtcctcgtctcgtcgtagaaaccaggactaggaaggtacgacgtcccgtacaggttcagtcgaccacgtccgagggtgggtcggccggagtcccaacgtcctacgaaccgtattacggccgtaaccgtggacccggtactaggaaacgtctttaccgagtactaaacgttttatttccgtagttacaacggtactaaggttactaccaagtttacggtccgttacccccggtttactaacggtttttccgggacccggtaaacggggtaacctaaggtacccgtaagggtaaaacctacggttaaaacgacgttcggagtacccgtacggacctaccggtacttcgttacgttcctttctaaccgtttcccgtccccgtacctaagtcctagtaactttaaccg

SEQ ID NO: 192263 - DNA, 637 bp, Homo sapiens
  misc_feature: GYAE6OF01CP6UH.44.23.C01.1.454.CMB.1.raw
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttctgtcttcttctgttggagcagcgtcaccatcacttgccgggcgagtcaggttcgttttcggtgctgttgcttggttacaaacgaaaaggggnacggcccttaaggtcctcgtctcgtacgtacgaaccagactaggaagtacgtacgtccccgtacgtaggttcagtcgccagtccgagggtggtcgggccgagtccactctcacagttacncgtacctgccggtcctagacgtacttcgtacgtactaacgtttactttcgtacgtcagtactagtactactaagttcgtaccggttccccgtttacgttacgttttccgggacccggtaacggggtaccctaaggtaccgttaaggaaactacgaaacgtacgtggtacgacgtacgtacctaccgtagtccgttacgttccttacgaccgtttcccttacccggaccttacttacgtgtaattaacg

SEQ ID NO: 192264 - DNA, 519 bp, Homo sapiens
  misc_feature: GYAE6OF01EKX3I.44.23.C01.1.454.CMB.1.raw
  modified_base (271)..(271): a, c, t, g, unknown or other
  misc_feature (271)..(271): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
  modified_base (485)..(485): a, c, t, g, unknown or other
  misc_feature (485)..(485): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtcaggttcagtgccagtccaggtggtgggccggagtccactctcaccattagcgacctgcggcctgaagattctgctaactttntttctgtcagcagtatcatagtcgtccccgtttntacttttggccaggggacccaagctaggaaatcaaacgactgngctgcacatctgtctcatccttccgcatctgnta

SEQ ID NO: 192265 - DNA, 594 bp, Homo sapiens
  misc_feature: GYAE6OF01CY9B2.44.23.C01.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (394)..(394): a, c, t, g, unknown or other
  misc_feature (394)..(394): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgctggttcaaagaaaaggggnacggccctaaggtcctcgtctctcgtagaaaccngactggaaggtgacgtcccgtcaggttcagtgccagtccagggtggnggccggagtccactctcactattagcgacctgcggcctagaactnttctgctaactttattctgtcagctagtatcatacgtcgtccccgtttatacgttttgggcccgtaaggggtacccaaggtctagggtaaactaccgaaacgtacgtacggtacggacctgacctaacccgtagttccttacggttacctttaccgtaacttcccttacccccggaccttacttactcggtaattaaacg

SEQ ID NO: 192266 - DNA, 632 bp, Homo sapiens
  misc_feature: GYAE6OF01A8KCD.44.23.C01.1.454.CMB.1.raw
  modified_base (273)..(273): a, c, t, g, unknown or other
  misc_feature (273)..(273): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggtgcttgttgcctggtttacaaacgaaaaggggngacggccctaaggtcctcgtctctcgtagaaccagacgtggaaggtagacgtcccgtcgaggttcagtgccagtccgagggtcggtgggccggagtccactctcacctattacgccgtacctggccggcctaggaacgtcttctgactaactttatttctgtacagtctagtatctagtcgtccgtccccgtttctaccgttttcggaccgtaacggggtacccaaggtcgtaacgggtaaacttaccgaaaaccggtaacgttcggtacggtcctacggaccctaaccgtacgttccgttacggttccttaccgtacttaccccgttccccgacctaagtttcctaggtaacttaacg

SEQ ID NO: 192267 - DNA, 587 bp, Homo sapiens
  misc_feature: GYAE6OF01EFT1W.44.23.C01.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (398)..(398): a, c, t, g, unknown or other
  misc_feature (398)..(398): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggtgctgttgcctggtttcaacgaaaaagggggngacggccctaaggtcctcgtctctcgtgaaaccngactggaaggtagagtcccgtcaggttcagtgccagtccaggtggtgggccggagtccactctcaccattacgcgacctgccggcctgaagnttcgtgctaacttatttctgtcagctagtatcatagtcgtccccgttctacgttttcggaccgtacggggacccaaggtcgtaagggtaaactacgtaaaaccggtaacgttcggtacggtcgtacggacacccgtattcttacgttcttacctacttccctttccccgacctactcttagtattaacg

SEQ ID NO: 192268 - DNA, 754 bp, Homo sapiens
  misc_feature: GYAE6OF01C3I6G.44.23.C01.1.454.CMB.1.raw
  modified_base (241)..(241): a, c, t, g, unknown or other
  misc_feature (241)..(241): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggngctgttcgccttggtttacaaacgtaaaagggggagaacggtccccgtaaggtccctcggtctccgtcggtacgaaacccagacgtagggaaggtagacggtcccgtactaggttccagttcgccagtccgagggtcggtcgggccggagtcccactccgtcaaccgtattacgccgtaccgtcggccgggacccttaggaacgtacgtttcgtacggtaccttaaaccgttttattttcctacggtttaccaacgtaccgtaacgttacttccgtaacgtttacggtcccggttaccccccgttttacttaaccggtttttccgggaacccggtaacggggtaacccaaacggtaccgttaagggaaaacttacccgaaaaacggtaccgttacggtacgggtacctacggaccctaaccgttcgttaccgtttcggtttaccccgtttacctaaccggtttcccccgtttacccccggaccttagtttaccccttaggtaactttaaaccg

SEQ ID NO: 192269 - DNA, 223 bp, Homo sapiens; identical to SEQ ID NO: 192164
  misc_feature: GYAE6OF01BIXTX.44.23.C01.1.454.CMB.1.raw
  modified_base (219)..(223): a, c, t, g, unknown or other
  misc_feature (219)..(223): n is a, c, g, or t

SEQ ID NO: 192270 - DNA, 607 bp, Homo sapiens
  misc_feature: GYAE6OF01C9CYI.44.23.C01.1.454.CMB.1.raw
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (270)..(270): a, c, t, g, unknown or other
  misc_feature (270)..(270): n is a, c, g, or t
  modified_base (400)..(400): a, c, t, g, unknown or other
  misc_feature (400)..(400): n is a, c, g, or t
  modified_base (454)..(454): a, c, t, g, unknown or other
  misc_feature (454)..(454): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgtggaggcagcgtcaccatcacttgccgggnagtcaggttcgttttcggngctgttgccttggtttcaaacgaaaaggggngacggccctaaggtcctcgtctctcgtagaaaccagactggaaggtagacgtcccgtcaggttcagtcgccagtccagggtggtcgggccggagtcccaactctcacattagccgactgcggcctggaanttctcgctaactttatttctgtccagtcagtatcaattacgtcgtccccgtttntaccgttttggccgaagggggtaacccaaggtcgttaggaaacttccgaaaacgtcgtaggtcggacttcggacaacccgtattccgttacgttacctttactaacctttcccgtttacccccggacttaactttccgtgtaactttaaaccg

SEQ ID NO: 192271 - DNA, 605 bp, Homo sapiens
  misc_feature: GYAE6OF01EDGYY.44.23.C01.1.454.CMB.1.raw
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaacgaaaagggggngaggcccctaaggtcctcgtctctcgtgaaccagactggaaggtagagtcccgtcaggttcagtgccagtccaggtggtgggccggagtccactctcacctattacgcgacctggcggccctaggaacgtattcgtcgtactaactttattttccttagtcagtctaagttacttactaattacggtccgtcccccggtttcttacgtttttcgggaccgtaacgggggaacccaaggacgtaagggaaacttacgaaacggtaactggtacggctcggaccaccgtactctgttccttcgtacttccgttacccacctatctgtattaac

SEQ ID NO: 192272 - DNA, 583 bp, Homo sapiens
  misc_feature: GYAE6OF01BNK08.44.23.C01.1.454.CMB.1.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (411)..(411): a, c, t, g, unknown or other
  misc_feature (411)..(411): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngtctgttgcctggtttacaaacgtaaaagggggnacggcccctaaggtcctcgtctctcgtgaaccngactggaaggtacgacgtcccgtcagggttcaggtcgccagtccagggtcggtcggggccggagtccactctcaccgattacgcacctggcggcctggaagtnttctgactaactttattctgtcagcagtatctagtacgtcgtccccgttactaccgttttcggccgtacggggaccctaaggtccgtagggtaaacttaccgaaacgtacgtggtcggtctacggaccaccgattctcgttcttccgtatcccttcccgctactctgattac

SEQ ID NO: 192273 - DNA, 575 bp, Homo sapiens
  misc_feature: GYAE6OF01B0205.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (409)..(409): a, c, t, g, unknown or other
  misc_feature (409)..(409): n is a, c, g, or t
  modified_base (464)..(464): a, c, t, g, unknown or other
  misc_feature (464)..(464): n is a, c, g, or t
  modified_base (513)..(513): a, c, t, g, unknown or other
  misc_feature (513)..(513): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggganacggcccgtaaggtcctcgtctctcgtagaaccagactaggaaggtagagtcccgtcaggttcagtgccagtccgagggtggtcggggccggagtcccacgtctcaacctattacgcgtaccgtgcggtcctgaagtnttcctgtacctaactttatttctgtacagctagtactcatagtcgtccccgtttntacgtttggccaaggggacctaagcgtacggaaatccgaaactagtcgngccgttgacctacgtatcgttctcttacacttcccttacccgcctaattctagtaattaacg

SEQ ID NO: 192274 - DNA, 638 bp, Homo sapiens
  misc_feature: GYAE6OF01CDS31.44.23.C01.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagacagtatatacacgaccggtgctcgatttagtacacgtgattagggattgggggagtcagaccctgtcaggggacagcgatggacatgagggtccccgctcagctcctggggctcctgctgctctggctcccaggttcgagatgtgacatcgagatgacccagtctccttcttcctgtcttcttctgttggagcagcgtcaccatcacttgccgggngagtcaggtcgttttcggnctgttgctggtttcaacgaaaaggggnaggccctaaggtcctcgtctctcgtagaaaccagacgtggaaggtgacgtcccgtcgaggttcagtcgccagtccgagggtcggtgggccggaggtcctacgtctacacctacgttagcggacctggcccggcctaggaacggtatttcgtgtacctaactttactttctgttcacgtactaggttattcaagttacgtccggtccccgtttactacgtttttccgggaccgtaacggggtaccaaggtccgtaaggaaacttacgaaaccggtacgttaggtcggtacgttcggacaacccgtacgttacctcggttaccctttaccaacgtttcccgttcccccgactaccttcttacgtaatttaacg

SEQ ID NO: 192275 - DNA, 555 bp, Homo sapiens
  misc_feature: GYAE6OF01A7UI4.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (549)..(549): a, c, t, g, unknown or other
  misc_feature (549)..(549): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcctcctgtcttcttctgttggagcagcgtcaccatcacttgccgggcgagtcaggttcgttttcggngctgttgcctggtttcaacgaaaagggggnaggccctaaggtcctcgtctctcgtgaaccagactggaagtagagtcccgtcaggttcagtgccagtccagggtggtgggccggagtcccactctcacctattacgcgtacctggcgcctagaacgattcngactaactttntttcgtgtacagctagtactcatagtcgtccccgtttctacgttttcggaccgtaggggacctaaggccgttaggaaactccgaaacgactcggtggctgccacattctgtcttcacttccttcccgctatctagtnttaacg

SEQ ID NO: 192276 - DNA, 610 bp, Homo sapiens
  misc_feature: GYAE6OF01CCU20.44.23.C01.1.454.CMB.1.raw
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaaacgaaaaagggggnaggccctaaggtcctcgtctctcgtgaaaccngactggaagtagagtcccgtcaggtcagtcgccagtccaggtggtgggccggagtccactctcacattacgcgactgcgctgaagnttcngcaacgttattctgtcagcagttatctagtacgtcgtcccgttctacgttttcgggaccgtaggggtacccaaggtcttaagggaaacttacccgaaaacggtaccttaggtacgggtacctcggaccaaccgtaagttccgttacggttccctttaccgtaagtttcccctttaccccggccttaagtttttcggaactttaatttaaaccg

SEQ ID NO: 192277 - DNA, 221 bp, Homo sapiens; identical to SEQ ID NO: 192155
  misc_feature: GYAE6OF01CUL1V.44.23.C01.1.454.CMB.1.raw
  modified_base (219)..(221): a, c, t, g, unknown or other
  misc_feature (219)..(221): n is a, c, g, or t

SEQ ID NO: 192278 - DNA, 544 bp, Homo sapiens
  misc_feature: GYAE6OF01BQFGP.44.23.C01.1.454.CMB.1.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (458)..(458): a, c, t, g, unknown or other
  misc_feature (458)..(458): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (541)..(541): a, c, t, g, unknown or other
  misc_feature (541)..(541): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgggatgaccaagtctccttccttcctgtcttcttctgttggaggcagcgtcaccatcacttgccgggcagtcaggtcgtttcggtgctgttgccttggttcaacgaaaagggggnacggacccctaaggtcctcgtctctcgtcgaaaccngacgtagggaacggtagacgtcccggtcaggttcagtcgcctaggtccgagggtcggtgggccggagtccactcncgaacnttacgcgacctgcgcctgaagacttctgtactaacttnttactgtcagcagtatctatcgtacgtcccgttntacgtttcgacgagggacagcgtagaatanaacgaactggtgctnacacntcgtntcttcactccttcccactatactgtatntac

SEQ ID NO: 192279 - DNA, 581 bp, Homo sapiens
  misc_feature: GYAE6OF01CK728.44.23.C01.1.454.CMB.1.raw
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccagactggaaggtagagtcccgtcaggttcagtgccagtccaggtggtgggccggagtccactctcacctatagcgacctgcggcctgaagtnttctgctaattatttctgtcagcagtatctatagtcgccccgtttctacgttttgggaccgtacggggaccaacgtacgttaggaaacttacgaaaacggacgttaggtcggtactcggaccacccgtattccttcgttcctttacactttcccgttccccgtacctacttcctgtaatttaacg

SEQ ID NO: 192280 - DNA, 707 bp, Homo sapiens
  misc_feature: GYAE6OF01C4KGL.44.23.C01.1.454.CMB.1.raw
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (325)..(325): a, c, t, g, unknown or other
  misc_feature (325)..(325): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctggttggaggcagcgtcaccatcacttgccgggtgagtcgaggttcgtttcggngctgttcgccttggttacaaacgaaaaggggngacggaccctaggtcctcgtctctcgtagaaaccagactagggaaggtanacgtcccgtacgtacggttcagtcgacctacggtccgagggtcgggtcggggaccggtagtacctacgtctaccgacctaacgtttacgcccggtaaccgtgaccgggccttaggaaagtactttcctaggaaccttaacttttaatttccttaggtacaggtacaagtactacgtaagtacggttccgttacccccgtttacgtttaacggttttccgggacccggaaacgggggtaaccctaggtaccttaaaggggaaaaccttaacgaaaacccggtaagtcgggttacgacgttacgaccgtaaccctacgttccttcggttacccttacctacccgtttacccgttccccacgttacttacgttgaaactttaacg

SEQ ID NO: 192281 - DNA, 594 bp, Homo sapiens
  misc_feature: GYAE6OF01A015B.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (456)..(456): a, c, t, g, unknown or other
  misc_feature (456)..(456): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttacaacgaaaaaggggngaggcccctaaggtcctcgtctctcgtgaaaccagactggaaggtagagtcccgtccaggttcagtgccagtccgaggtgggtgggccggagtccactctacaccattagccgacctgccggcctggaagtacttcgtgctaactttatttctgtacagctagtactcatagtcgtccccgttntacgttttcgggaccgtacggggaacccaaggtcttagggaaacttacgaaaccggaacgttggtcggctacggccaaccgtacttccttcgttcctttaccacttcccgtttaccccgctacttcgtagtattaacg

SEQ ID NO: 192282 - DNA, 590 bp, Homo sapiens
  misc_feature: GYAE6OF01CYGL1.44.23.C01.1.454.CMB.1.raw
  modified_base (577)..(590): a, c, t, g, unknown or other
  misc_feature (577)..(590): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtaccctctactactactctcgtggtacgtcggtcgggggccggacggggacccggtccggtaccgtacccggttcccttacccgttaccgaccggtcccctaccccgaaacccggaaccggggaccccctacggttcccggttccccctttccccccgtcggacccctacccccgttcccctaacccgaacggaccgaccctaacccgttccgggtcgggggacccaaccggaccggcccggtccccggtcgggtccgtccgtcccggttcggtaccgaaacggtaccttacctttacctaatttactacgttgtcgtaggacgggccgggtcgtcggacgaacggcgactagtgnnnnnnnnnnnnnn

SEQ ID NO: 192283 - DNA, 714 bp, Homo sapiens
  misc_feature: GYAE6OF01B6UCL.44.23.C01.1.454.CMB.1.raw
  modified_base (240)..(240): a, c, t, g, unknown or other
  misc_feature (240)..(240): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctcccttcttcctgtcttcttctgttggaggcagcgtcaccatcacttgccgggcagtcaggtcgttttcggngctgttgcctggtttacaacgaaaaagggggagaggcccctaaggtcctcgtctcgtcgtgaaaccagacctaggaaggtacgacgtcccgtcaggttcagtcgccagtccgagggtggtcggggccggagtcccactcctacaccctattacggccgtacccgtggccggtaccctgggaaacgtatttccgtacggtaccttaaaccgttttattttccttacggttccgtaaggtcctaaggttaacttccgtaagttaacggtcccggtaccccccgttttcgttaaccgttttttcgggaccccggtaaggggggaacccctaaagggtaccgtagggtaaaacttaccgaaaaccggtaaccgttaggtacgggtctacggacccgtaaccgtacttcgttacggttcctttacccgtaacgtttcccctttacccccggacctaactttccctaggtaactttaaac

SEQ ID NO: 192284 - DNA, 598 bp, Homo sapiens
  misc_feature: GYAE6OF01EL6SO.44.23.C01.1.454.CMB.1.raw
  modified_base (270)..(270): a, c, t, g, unknown or other
  misc_feature (270)..(270): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggttacaacgaaaagggggngaggcccctaaggtcctcgtctctcgtgaaaccagactggaaggtagagtcccgtcaggttcagtgccagtccaggtggtcgggcgagtccatcncacatagcgactgcggcctgaagnttctgactaacttacttctgtcagctagtactctatacgtcgtccccgtttctaccttttgggaccgtaacggggaaccaacggtctacgggtaaactaccgaaaacggtaacttcggtgggaccttacggacctaccgtaacttcgttcgtttccgttaccacgtttacccgtttcccccgtaccctaagttccttagtaactttaac

SEQ ID NO: 192285 - DNA, 608 bp, Homo sapiens
  misc_feature: GYAE6OF01BK9OW.44.23.C01.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgttggaggcagcgtcaccatcacttggccgggcgagtcaggttcgttttcggngctgtgccgtaggtttaacgaaaaaaggggngacggccctaaggtcctcgtctctcgtagaaaccngactaggaaggtagacgtccgtacagttcagtgccaggtcagggtggtcgggcgagtccactctacacagttacgccgtaccgtcgccggtccgtagaagtacttcgtgacttaacttntttctgtacagtctagtactactagtacgtcgtacccgttcttacgtttcggaccgtaggggacccaggtacgtacggtaaactacgaaacgtacgtaggtcgactacgctaacctagtcttaggttccttacgtaccttccttacccggacctacttacttacgaactttagtaacg

SEQ ID NO: 192286 - DNA, 539 bp, Homo sapiens
  misc_feature: GYAE6OF01AHZL9.44.23.C01.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (510)..(510): a, c, t, g, unknown or other
  misc_feature (510)..(510): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggttcaacgaaaaaggggngaggcccctaaggtcctcgtctctcgtagaaaccngactggaaggtagagtcccgtcaggttcagtgccagtccgagggtggtgggccggagtccactctcacctattagcgtacctggccggcctaggaacgattcgtgactaactttatttctgtcagctagtatcatacgtcnccccgtttnacgtttggccgaggggaccaggctaggaaactacgaaacgtactgtcgctgcacntctgtcttcattcctcccncatctgntac

SEQ ID NO: 192287 - DNA, 653 bp, Homo sapiens
  misc_feature: GYAE6OF01CW0QF.44.23.C01.1.454.CMB.1.raw
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttcctgtcttcttctgttggagcagcgtcaccatcacttgccgggcgagtcaggttcgttttcggngctgttcgccttggtttacgaaacgaaaaagggggngacggtacccgtaaggtcctcgtctcgtacgtagaaccagactaggaagtagacgtcccgtacgtaggtcagtgcagtcgaggtggtcgggccggagtccactctcacctagtacgacgaccgtgccggcctagaagtacttcgcgtactaactttacgtttctacgtacaagtaagttactacgtaacgtacgtccgtccccgttacgttacgttttcgggaccgtaacgggggtaaccaaggtaccgtaagggtaaactaacgtaaaaccggtaacgttagggtacggtctacgaccgtaactacgttccgttggttacccttcgtaccgtttcccttccccgaccttacgttaccttacgtaattacgttaacg

SEQ ID NO: 192288 - DNA, 725 bp, Homo sapiens
  misc_feature: GYAE6OF01D1RFE.44.23.C01.1.454.CMB.1.raw
  modified_base (167)..(167): a, c, t, g, unknown or other
  misc_feature (167)..(167): n is a, c, g, or t
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (468)..(468): a, c, t, g, unknown or other
  misc_feature (468)..(468): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgaacccngtcctccttccttcctgtcttctctgttggnggcagccgtacaccatcacgttcgccggcagtcgtaggttcgtttcggngtcttgttcgccgttggttacaaagtaaaaggggnacggccctaaggtcctcgtctactcgtagaaaccgagacgtagggaagtacgtacggtcccgtctaacggttcagttcgaccgtacggtccgagggttcggggacggccgggtaactccgtaactcctacaccgtaattacggccgaaccgttcggccggtacctaagaacggttacttaccggtntaaccttaacgtttactttacgtcgtacgacgtacgtaagttactactacgttacgttccgtaccccgtttcgttacggttttcgggacccggtaacgggtaacctaacggtcgttaaaccggtaaactaaccggtaaactacggttcggtacgggacctttacggaccctacccgttaaacgtcgtttacggtttaccctacttaccttaccccggttaccccacccttaagtccggtttactaactttaaaccgg

SEQ ID NO: 192289 - DNA, 575 bp, Homo sapiens
  misc_feature: GYAE6OF01EAQ7R.44.23.C01.1.454.CMB.1.raw
  modified_base (272)..(272): a, c, t, g, unknown or other
  misc_feature (272)..(272): n is a, c, g, or t
  modified_base (399)..(399): a, c, t, g, unknown or other
  misc_feature (399)..(399): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggtgctgttgcctggtttacaacgaaaaagggggnaggcccctaaggtcctcgtctctcgtgaaaccagactggaaggtagacgtcccgtcaggttcagtgccagtccaggtggtgggccggagtccactctcacctattagcgacctgccggcctggaagnttctgactaacttatttctgtcagcagtatacatacgtcgtccccgttctacgttttcggaccgtacggggaacctaacggctacgggtaaactacgaaacggtactggtacggactcgaccaccgtacttcgttacgtccttctacttcccttccccgactacttctgtattaac

SEQ ID NO: 192290 - DNA, 665 bp, Homo sapiens
  misc_feature: GYAE6OF01ARF1U.44.23.C01.1.454.CMB.1.raw
  modified_base (276)..(276): a, c, t, g, unknown or other
  misc_feature (276)..(276): n is a, c, g, or t
  modified_base (451)..(451): a, c, t, g, unknown or other
  misc_feature (451)..(451): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcgaggttcgttttcggtgcttgttgcctggtttacaacgaaaagggggngacggcccctaaggtcctacgtctctcggtagaaaccgagaccgtggaaggtacgacgtcccgtcgaggttccagtcgccaggtccgagggtcgggtggggccggagtcccgaacgttcctaccaacccgtacgtttacggaccggtacccgtggcccggtccttagggaacgtnttacgtcggaccttaaactttntttcgtntacgacgtacaagttactcaagttcgtccgtcccccgtttgttaccgttttcggacccgtaggggaaccctaacggtcgttaacggaaaacttcgaaaaccgtacgttggtcggtcctacggcctaaaccgtcttacttcgttcctactaccgttcccttacccgccttatccttgtaattaccg

SEQ ID NO: 192291 - DNA, 547 bp, Homo sapiens
  misc_feature: GYAE6OF01BBNZN.44.23.C01.1.454.CMB.1.raw
  modified_base (271)..(271): a, c, t, g, unknown or other
  misc_feature (271)..(271): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
tcagacagtatatacacgaccggtgctcgatttagtacacgtgattagggattggggtagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtgaaaccagactggaaggtagagtcccgtcaggttcagtgccagtccagggtggtgggccgagtccactctcaccattagcgacctgcggcctggaacgtattctgactaactttatttctgtcagctagtatctatagtcgtccccgttctacgttttcggccgtacggggacctaagcgtaggaaactcgaaacgactgtcgctcgaccactntctcgtcttcnttccttcccgaccattctgtattac

SEQ ID NO: 192292 - DNA, 731 bp, Homo sapiens
  misc_feature: GYAE6OF01D7292.44.23.C01.1.454.CMB.1.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
tcagacagtatatacacgaccggtgctcgatttagtacacgtgattagggagttgggggagtcagaccctgtcaggggacagcatggacatgagggtccccgctcagctccgtggggctcctggcgtgctctgggcctcccgaggttcgagatgtgacatcgagctgacccagtcctccttccttcctgtcttntctgttggagcagcgtcacatcacgtggccggcgagtcgtaggttcggtttcggtgtctgttcgtccgttggtttacgaaacgtaaaaagggggntacggtaccccgtaaggtcctacggtctccgtacggtacgaaaccgtgaacgtgggaaggtagacggtcccgtcgtaggttcagtcgcctaagtccgtagggtcgggtcggaccggtagtcccactctacgaaccgtaagttcggacgtaccgtggccggtcctaggaagtacttcgtctactaacttactttcgtgtacagcgtacgtactcgtaagtcgtccgtacccgtttctacgttttcgggaccgtaacggggtacctaacggtacggtaacgtaaacgtacgtaaaccggtacgttacggtacgggtcgttaccggaccttaacccgtacttaccggtttaacgtttcccggtttacccgttaaaccgtttccccccggttttaccccgtacccccgttaacgtttccccggttaagtaaaccgttttaaaccgg

SEQ ID NO: 192293 - DNA, 709 bp, Homo sapiens
  misc_feature: GYAE6OF01CWL83.44.23.C01.1.454.CMB.1.raw
  modified_base (180)..(180): a, c, t, g, unknown or other
  misc_feature (180)..(180): n is a, c, g, or t
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttctntcttcttctgttggaggcagcgtcaccatcacgttgccgggcgagtcgtaggttccgttttcggngtcttgttgccttaggtttacaaacgaaaaggggganacggtaccccgtaaggtcctcgtctcgtcgtagaaccngactggaaggtagcgtcccgtacaggtcaggtcgccgagtccgaggtcggtcgggccggacgtccactctaccaactagtacgccgtacgtggaccggtcctaggaacggtctttaccgtacgtccttaaacgttttactttcgttacgttccgaagtcgtaagttacttacctaagtttacggtcccgttcccccgttttaacgttaccgtttttaccgggacccgggtaacggggaaaccctaaaggtaccgttaacgggtaaaacctaccgaaaaccggtacttaagggtccggtacgtaccggacctaacccgtagttcccttcggtttaccctttcgttaacttccccgtttccccgaccttagttccttaagacttttaaacg

SEQ ID NO: 192294 - DNA, 669 bp, Homo sapiens
  misc_feature: GYAE6OF01CMIJK.44.23.C01.1.454.CMB.1.raw
tcagacagtatatacacgaccggtgctcgatttagtacacgtgattagggattgggggagtcagaccctgtcaggggacagcatggacatgagggtcccgctcacgctcctggggctcctgctgctctggctcccaggttcgagatgtgacatcgagatgacccagtctccttccttcctcgtcttcttctgttggaggcagcgtcaccatcacttgccgggcgagtcaggtcgttttcggtgcttgttcgccttggtttacaaacgtaaaaaaggggggagaacgggtacccccttaagggtcccttcggtacctcgtcgtacgaaacccaggaccgtaggaacggtacgacgtcccgtcaggttcagtcgccagtccgagggtggtcgggtccggagtcccactctcgacctagttacgccgaccgtgccggccttagaacgtcttcgtagactaactttattctagtcagtactagtatcgtagttacgtcgttccccgtttactacgttttcggaccgtaacggggacctaacgtcgtacggaaacttaccgaaaacggtacgttgggtacggtactacggtaccctaaccgtacgttaccgtggttccctttacgtaccgttcccctttaccccggaccttactttcgttcgtaactttaaccg

SEQ ID NO: 192295 - DNA, 702 bp, Homo sapiens
  misc_feature: GYAE6OF01AYAWD.44.23.C01.1.454.CMB.1.raw
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaaacgaaaagggggngacggccctaaggtcctcgtctctcgtagaaccagacgtggaaggtagacgtcccgtacgaggttcagtcgccagtccgagggtcggtcggggccggagtcccactctacaccgagttacgccgtacctcggccggtcctaggaacgtactttcgtagtacctaacgttttacttttccgttagttaccaggtacgtaagttacttactaagttacggttccgttaccccccggttttcttaaccggttttttccggggacccggtaaccggggggtaaccctaacggtaccgttaaacggggtaaacttaaccggaaacgtaaccgttgggtacgggtctacggaccctaaccgtacgtttccgttacggtttccttaccgtacctttccccgttccccgacccttattccgttaggtaacttaacg

SEQ ID NO: 192296 - DNA, 554 bp, Homo sapiens
  misc_feature: GYAE6OF01BRFVI.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaaccngactggaaggtagagtcccgtcaggttcagtgccagtccaggtggtcggggccggagtccatctcaccattagcactgcgcctgagnttcngctaacttntttctgtcagcagtatcatacgtcgtccccgttntaccttttgggaccgtaggggaccaaggcgtaaggaaactacaaacgtactggtcgactcgacacctattctacgttcttaccacttcccgttccccgcctaattcgtgtattaac

SEQ ID NO: 192297 - DNA, 579 bp, Homo sapiens
  misc_feature: GYAE6OF01A3R39.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggttacaacgaaaagggggngaggccctaaggtcctcgtctctcgtagaaacccagacgtaggaaggtagtacgtcccgtcaggttcagtcgccagtccgagggtgggtcgggccggagtccactctccacagttacgcgtacctggcggcctagaacgtattcctgactaatttactttctgtcagctagtactacattagtccgtccccgttataccgttttgggaccgaaggggacctaagcgtaagaaactcgaaacgtactggtcgtctacgccaacgtgttcctgttccttcacttccgttaccccgactatctgtaatacg

SEQ ID NO: 192298 - DNA, 531 bp, Homo sapiens
  misc_feature: GYAE6OF01EMSHQ.44.23.C01.1.454.CMB.1.raw
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
  modified_base (528)..(528): a, c, t, g, unknown or other
  misc_feature (528)..(528): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacaaaaagggggnaggcccctaaggtcctcgtctctcgtgaaaccngactggaaggtgagtcccgtcaggttcagtgccagtccaggtggtgggccggagtccatctcaccattagcgacctgcggcctgaanttctgcaacttatttctgtcagcagtatcagtagtcgtccccgttctacttttgggcctaaggggacccaaggtcgtaggaaactacgaaacgtaactggtggctgcaccatctgtcttcactccttcccgctatctgntac

SEQ ID NO: 192299 - DNA, 770 bp, Homo sapiens
  misc_feature: GYAE6OF01C3MIH.44.23.C01.1.454.CMB.1.raw
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtctccttcctctgtcttcttctgttgaggcagcgtcaccatccacgtttcggccgggcgtaacgtccgtagggttccgttttttccgggtgtccgttggtttcgcccgttagggttttacccgaaaaacggtaaaaaagggggggctaaccgggaccccccgttaaagggttccctccggtaccttaccgtcggtacgaaaacccgtaggtaccgtagggaacggtacgtaccggttccccggtacgtaggttaccaaggttcgacctaggtaccgagggtcggtcggggaccggacgtccgacgtctccgaacctagttacggccgaaccttccgggacggtcccttaaggaacgtacgtttccgtggaaccttaacctttatttccgagttacgaaggtacgtaggtaattcgtaattaccgtcggtcccccgtttataccgttttacgggccgtaacgggaacctaaggtcgtaaggaaacgttacaaaccggtagtcgtacggtactacgtaccgaaccgtacgtaccgttacggtttcccttactaacccgttttcccgtacccccggttactaaccgtttactcgtaacttttaaaccg

SEQ ID NO: 192300 - DNA, 593 bp, Homo sapiens
  misc_feature: GYAE6OF01D3BJS.44.23.C01.1.454.CMB.1.raw
  modified_base (414)..(414): a, c, t, g, unknown or other
  misc_feature (414)..(414): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgtctgttgccttggtttacaaacgaaaagggggagacggtcccctaaggtcctcgtctctcgtagaaaccagactggaaggtagacgtcccgtcaggttcagtgccagtccgaggtggtgggccggagtcccatctacacctattacgcgacctggccggtctagaaacgtnttctgactaacttatttcgtgtacagctagtatactatagtctccccgtttacgtaccttttcgggaccgaacggggaaccaaggtcctaaggaaactacgaaacgacgttaggtggacctagaccaacctattcttcgttcttcctacttcccttaccccgactattctagtattaac

SEQ ID NO: 192301 - DNA, 559 bp, Homo sapiens
  misc_feature: GYAE6OF01A3EBL.44.23.C01.1.454.CMB.1.raw
  modified_base (272)..(272): a, c, t, g, unknown or other
  misc_feature (272)..(272): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (524)..(524): a, c, t, g, unknown or other
  misc_feature (524)..(524): n is a, c, g, or t
  modified_base (555)..(555): a, c, t, g, unknown or other
  misc_feature (555)..(555): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccagactggaaggtagacgtcccgtccaggttcagtgccagtccgagggtggtcggggccggagtcccacgtcctcacctattacgccgtacctgccggcctagaagtacttcgtgactaactttntttctgtcagctagtntctatacgtcgtcccgttctacgttttcggaccgtacgggaaccagcgtaggaaactacgaaacgactggtgctcgcacnttctgtcttcacttccttcccgcattctgtntaac

SEQ ID NO: 192302 - DNA, 797 bp, Homo sapiens
  misc_feature: GYAE6OF01CDU5A.44.23.C01.1.454.CMB.1.raw
  modified_base (723)..(723): a, c, t, g, unknown or other
  misc_feature (723)..(723): n is a, c, g, or t
tcagacagtatatacacgaccggtgctcgatttagtacacgtgattagggattgggggagtcagaccctgtcaggggacagcatggacatgagggtccccgctcagctcctggggctcctgcctgctcgtggcctccgtaggttcgagtagtggtacgactacgtcgagtagtcgacccgtagtccttcccttccttccgttcgttcctttcctttcgttggttgggacggcgacggtccgtaccaacctattacctacgttcgggcccgggacgtacgtacgtcgggtttcggttttcggtcgtcgttcggttcgtccgtttggttaaccgaaaaagggtaaaaggggggcgaccggtaccccgttaagggttcccttcggtcctaccgtacggtaacgaaaccgaggtacggtaaggggtaacggtacggtacccggttccccggtagtacggttcaggtccgaccgtacggtccgaggggtcgggtccggggcgtacgtccctactcctacgaaccgttagtacgcccgtaccgtcggccggtacctaaggaacgttacgtttcgacgtaaccttaacttttacgtttcgtacgtacgacgtagtaacgttctacgtaagttccggtcccgtccccgtttagttaccggtttaccggacggtaaccgggaactacggacgttaagaaaacgttaccgaaacgtacgttcggcggttaccncggacccaccgtagttcgttaccggttcctacgtcccttccccgttcccgacttattccgtaagtatttaaccg

SEQ ID NO: 192303 - DNA, 658 bp, Homo sapiens
  misc_feature: GYAE6OF01DU0S2.44.23.C01.1.454.CMB.1.raw
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtctttcttctgttggaggcagcgtcacatcacttgccgggcagtcaggttccgttttcggngcttgttcgccttaggtttacaaacggaaaaaggggggcgacgggaccccttaaagggtccctacgtctccgtcgtacgaaaaccaggtaaccgtagggaaggtacggacgttccccggtacgtacgggttcaggtcgccgtacgtccgagggtgggcggggccggagtccacgtctacacctagttacgccgaccgtgccggtaccgtagaacgtattctagactaactttatttctagtcagtctaagttatcgtaattcggtccgtccccgtttgtaccgttttccggacggaacggggaaccctaagcgttaaggaaacctacgaaacgtacgtaggtcggactcgtaccacgtacgttccgttacgtccgttactaccttcccgttacccgactacgtttcagttattaac

SEQ ID NO: 192304 - DNA, 653 bp, Homo sapiens
  misc_feature: GYAE6OF01C4K19.44.23.C01.1.454.CMB.1.raw
  modified_base (245)..(245): a, c, t, g, unknown or other
  misc_feature (245)..(245): n is a, c, g, or t
  modified_base (476)..(476): a, c, t, g, unknown or other
  misc_feature (476)..(476): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccctagtcttccttccttcctgtcttcttctgttggagcagcgtcaccatcacttcggccggctagtcgtaggttcgttttggngcttgttcgccgttggttacgaaaacggaaaaagggggcacggtacccttaaggtcctcgtctcgtacgtagtaaaccaggacgtagggaacggtagaccgttcccgtacgtaaggttcaaggtcaccgtaggtccgagggtcggcggggtaccgactccgtactcgtactaacctagtacgccgacgtcggacggtacctagaacgttctccgtacgctttaaacgtttntttccgtgttacaacgtcgtaagtctacgtagttcgtccgtaccccgttttagtccggtttcgaaccggtacggacgtacgtacgtaagaaactcgtaaaccgacttgcggtatccgacgaactcgtcttacgtcttacccgtacttacccgtcccaccttatcctgtaaacttacg

SEQ ID NO: 192305 - DNA, 603 bp, Homo sapiens
  misc_feature: GYAE6OF01BX1A3.44.23.C01.1.454.CMB.1.raw
  modified_base (271)..(271): a, c, t, g, unknown or other
  misc_feature (271)..(271): n is a, c, g, or t
  modified_base (453)..(453): a, c, t, g, unknown or other
  misc_feature (453)..(453): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccagactggaaggtagagtcccgtcaggttcagtgccagtccaggtggtggccggagtccactctcaccattacgcgacctgccggccctaggaagtacttctgtactaactttatttctgtcagtcagtatcatacgtcgtcccccgtttntaccgttttcggaccgtaacgggggtacccaaggtccgttaacgggaaacttaccgaaaacggtaacgtcggttacggacctcgaccaccgtacgttaccttggttccctttactacttcccttccccgacctaattcctgtaattaacg

SEQ ID NO: 192306 - DNA, 704 bp, Homo sapiens
  misc_feature: GYAE6OF01BU9HK.44.23.C01.1.454.CMB.1.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
  modified_base (651)..(651): a, c, t, g, unknown or other
  misc_feature (651)..(651): n is a, c, g, or t
tcagacagtatatacacgaccggtgctcgatttagtacacgtgattagggagttgggggagtcagaccctgtcgaggggacagcatggacatgagggtccccgctcagctccgtggggctcctgctgctctggctccaggttcgagatgtgacatcgagatgaccaagtctccttccttcctgtcttctctgtgaggcagcgtcacatcacgttggccggngagtcgaggttcgttttcggtgtcttgttcgccttggtttaaccgaaacggaaaagggggngaacggtcccgttaaggtccttacgtctcctacgtagaaaccagacgtaggaaggtacgacgtcccgtacgtacggttcaggtcgaccgtacggtccgagggtcgggtcggggaccggtacgtacccgacgttacgtacccgtaaccgtaagtttacggacccggtacgtcggtaccggtaccgtaggaacgttacttccgtagtaccttaacgttttacgtttcttaggtactaacgtacgtaagttactaacgtattaccggttcccgttaccccgttagtttacgttttaccgggacccgaaggggtaacccaacggtacgtaacggaaactacgaaacgtacgtggtcgtacgtcgactaccgtnttcctacgttctaccgtacttacccgtcccgacttacgttctaagtacttaac

SEQ ID NO: 192307 - DNA, 625 bp, Homo sapiens
  misc_feature: GYAE6OF01C6WKX.44.23.C01.1.454.CMB.1.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
  modified_base (427)..(427): a, c, t, g, unknown or other
  misc_feature (427)..(427): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggtgcttgttgccttggtttacaaaacgaaaaagggggnacggcccccttaagggtcctcgtctcgtcgtagaaaccagaacctgggaacggtagacgtcccgtcaggttcagtcgaccagtccagggtggngggccggagtccactcctacgacctagtacgcgaccgtgccggtctaggaacgtnttctagactaactttattctgtcagtacagttactctagttacgtcgtccccgtttactaccgttttcgggaccgtaacggggaaccctaacggtcgtaggaaactaccgtaaacgtacgtaggtacggcgtacgaccaaccgtagttcctcgttccttactaacttcccttaccccgaccttattcctgtaattaac

SEQ ID NO: 192308 - DNA, 533 bp, Homo sapiens
  misc_feature: GYAE6OF01BL62C.44.23.C01.1.454.CMB.1.raw
  modified_base (273)..(273): a, c, t, g, unknown or other
  misc_feature (273)..(273): n is a, c, g, or t
  modified_base (455)..(455): a, c, t, g, unknown or other
  misc_feature (455)..(455): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaaagggggnaggccctaaggtcctcgtctctcgtgaaaccagactggaaggtagagtcccgtcaggttcagtgccagtccaggtggtgggccggagtccactctcacctagttacgcgacctgccggcctaggaagtacttctgacctaactttatttctgtcagtcagtatctatacgtcgtccccgttntacttttcggccaggggaccagctaggaaactcaaacgactgtgctgcacntctgtctcntcctccnctatctgntac

SEQ ID NO: 192309 - DNA, 646 bp, Homo sapiens
  misc_feature: GYAE6OF01BVLIC.44.23.C01.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgtgcctggttcaacgaaaaggggnacggccctaaggtcctcgtctctcgtagaaaccagacgtggaaggtagacgtcccgtcaggttcagtgccagtccagggtggtgggccgagtccactctcacctattacgccgacctggccggtccctaggaacgtactttcgtcgtacctaacttttagtttcctggtaccgtagtctaagttactcgtaattacggtccgtcccccgtttacttaccgtttttcgggacccgtaacgggggaaccctaaggtccgttaacgggtaaaacttaccgtaaaaccgtaacgttcggtacgggcttacggacctaaccgtacttccgtacggttccttaccgtacttccccgttaccccgctaacttcctagtaactttaac

SEQ ID NO: 192310 - DNA, 878 bp, Homo sapiens
  misc_feature: GYAE6OF01BPXDF.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtggggctcctgctgctctggcctcccaggttcgagatgtgacatcgagatcgacccagtcctccttccttcctgttcctttcttctggttggaggcagccgtcaccatccacgttcggccgggcgagtcgtaggtttccggttttcgggtgtcgttggttcgtccgtttagggtttaaccaaaacgggaaaaagggggggacgtaaccgggtacccccgttaaagggttcccgttccggttccgttaccgttacggtaacggaaaacccgtaggtaaccggttaaggggtaaacgggttacggtaccggttcccccggttaccgtagggtttaccgaggttccggacccgtacggtaccggtaggggttcgggtaccggggccggtacgtcccgtaccgttccgtaccaacccgtagttaaccggcccgtacccgtcgggacccggtaccgtaggtaacgttacgtttacgtacggtaacctttaacgttttacgttttaccgttcggtactacgtacgttaacgttacttaccgtaaggttaccgttcccggttacccccgtttacgtttaacccggtttttccgggacccgggtaaaccggggtaacccgtaaagggtaccgttaaagggaaaaccgttaaccggtaaaaccggtaacgttcgggtacggtacctaccggaaccctaccgtacttcccgttacgtttaccttaccgtacctttaccccgttaccccgtacctaacgtttcctaagttacttaacg

SEQ ID NO: 192311 - DNA, 601 bp, Homo sapiens
  misc_feature: GYAE6OF01DWV6H.44.23.C01.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttctgtcttcttctgttggaggcagcgtcaccatcacttgccgggcgagtcaggttcgtttcggngctgttgcgttggtttacaaacgaaaagggggnacggcccctaaggtcctcgtctctcgtgaaaccagactggaaggtagacgtcccgtcgaggttcagtcgccagtccgagggtggtgggcccggagtcccacgtctcaccgtattacgccgacctgcggtacctaggaacgtcttctcgactaactttatttctgtcagtcagttactctagttcgtcgtaccccgtttctacgttttcggaccgtaacggggaccaacggtcgtaggaaactacctaaacggtactggtacggctcggaccaccgtattcgttggttccttcgtacttcccttacccgacttactcgtagtacttaacg

SEQ ID NO: 192312 - DNA, 585 bp, Homo sapiens
  misc_feature: GYAE6OF01A9745.44.23.C01.1.454.CMB.1.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (538)..(538): a, c, t, g, unknown or other
  misc_feature (538)..(538): n is a, c, g, or t
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggngctgttgccttggttacaaacgaaaagggggnacggtccctaaggtcctcgtctctcgtagaaccngacgtggaaggtacgacgtcccgtactaggttcaggtcgcctagtccgagggtcggcggggccggagtccactcncacctatacgcacgtgccggtctagaagtcttcgtgaccttaactttactttctgtacagtctagtatcgtatcgtccgtcccttgtaccgtttggccgtaagggtaacacgtcgttaggaaacttacgaaacgtacgtggcgtctgacctacgtnttctacgttctacgtactcccgttacccncttatacgtntnttaacg

SEQ ID NO: 192313 - DNA, 740 bp, Homo sapiens
  misc_feature: GYAE6OF01EXNW6.44.23.C01.1.454.CMB.1.raw
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtctccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtagaaaccagactggaaggtagacgtcccgtcaggttcagtgccagtccgagggtggtcgggccggagtccactctacacctattacgccgacctcggccggtcctaggaaacgtacgtttccgtaggtaccttaaacgttttactttccgtagttaccgtaagtaccgtaagttaacttacctaacgttaacggttcccggttacccccgttttacgttaccgttttttacggggacccggtaaacggggggtaacccctaaagggtaccggttaaacgggtaaaacttaacccggaaaaaccgttaaccggttagggttaccgggtaccgttacggtaacccgtaaccccgtaagtttacccgtttacggttacccgttttacccgtaaccgttttccccgtttacccccggaacccttacgtttccgttaaggttaaaac

SEQ ID NO: 192314 - DNA, 715 bp, Homo sapiens
  misc_feature: GYAE6OF01BCA13.44.23.C01.1.454.CMB.1.raw
  modified_base (677)..(677): a, c, t, g, unknown or other
  misc_feature (677)..(677): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccgaggttcgagatgtgacatcgagatgaccagtctccttccttcctgtcttcttctggttggagcagctcaccatcacttggccggcgagtctaggttcgttttcggtgcgttgttcgccgttggtttaccgaaacgaaaagggggcgtaacgggtccccgtaaggtccctcgtctccgttacgtagaaacccgtagtacgtgggaaacgtaggacgtaccccggtacgtacggttacaggttcgaccgtacggtcgacgggttgggtcgggaccggtacgtccctacgtccgtaccaccgtaacgttacggcccgtacgtcggacccggtaccttaggaacgttcttccgtacgtacgtaactttttaccgttctcggtacacggtaccgtaagttacgttacctaagttccgttaccgtccccccgttttagttaaccggttttccgggacccgtaaggggaccctaaggtcgtaacggtaaactacgtaaacggtacgtcgtggaccttacggacctacctggtccttcggttccttacncgtttcccgtacccgtactagtttccagttaacctacg

SEQ ID NO: 192315 - DNA, 598 bp, Homo sapiens
  misc_feature: GYAE6OF01A7RDV.44.23.C01.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (466)..(466): a, c, t, g, unknown or other
  misc_feature (466)..(466): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggttacaacgaaaaggggnaggccctaaggtcctcgtctctcgtacgaaaccagactggaaggtacgacgtcccgtcaggttcagtcgccagtccgagggtggtcggggccggtagtccacgtctcacctagttacgccgtacctggccggtcctggaagtcttcgtgacctaactttgtttctgtcagtctagtactcattcgtcgtccccgttntacgttttcgggaccgtaggggaaccctaaggtccgttaaggaaacttacgaaaaccgtacgttggtcggtactcgaccgaccgtacttccgtgttccttacacttcccgtccccgactactctagtattac

SEQ ID NO: 192316 - DNA, 594 bp, Homo sapiens
  misc_feature: GYAE6OF01C8QR8.44.23.C01.1.454.CMB.1.raw
  modified_base (271)..(271): a, c, t, g, unknown or other
  misc_feature (271)..(271): n is a, c, g, or t
  modified_base (475)..(475): a, c, t, g, unknown or other
  misc_feature (475)..(475): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcttggttcaaacgaaaagggggnacggcccctaaggtcctcgtctcgtcgtagaaccagactaggaaggtagacgtcccgtcaggttcagtcgccacggtccagggtggtacgggccggtaagtcccactctacgacctagttaacgccgacctcggccgggtcctaggaacgtcttacgtcgactaactttattctgtcagtcagtatcgatacgtcgtcccgttntacgtttgcccgtaaggaccaagtcgtaggaaactcgaaacgtcgtagtcggtacctcgaccaccgtatccttcgttccttacgtacgttcctaccccgactattccgtagtactaacg

SEQ ID NO: 192317 - DNA, 737 bp, Homo sapiens
  misc_feature: GYAE6OF01E0TC8.44.23.C01.1.454.CMB.1.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagtatgacccagtctccttctcctgtcttcttctgttggagcaggctcaccatcacttgccgggcgagtctaggttcgttttcggngtcttgttcgccttggttacaaacgaaaagggggnacggaccctaaggtcctcgtctcgtcgtacgaaaccgaggtaccgtggaaggtagacgttccccgtacgtaggttcaggtcgcctacggtccgagggtcgggtcggccggtacgtccacgtctaccaccgtagttacggcctaccgtcggaccggccttaggaacgtcttcgtacggtaaccttaacttttacttttcgtacgttacgtacggtactaagttacttacgtaacgttacggttcccgttaccccgttttacgttacccgtttttccgggacccggtaacggggtaacctaacggtaccggttaacggtaaaacttacgtaaaccggtacgttacggtacgggtccttacgaacccgtacccgttaacgttccgttaacggtttccctttacctaaccgttttccccgttaccccggtacccttaactttcccgtttaggtaacctttaaccg

SEQ ID NO: 192318 - DNA, 779 bp, Homo sapiens
  misc_feature: GYAE6OF01CBJL4.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacgttgccgggcgagtcgaggttcgttttcggtgctgttcgccgttggtttacgaaacggaaaaagggggacgacggtaccccgtaaggtcctcgtcctcgtcggtacgaaaccagtaccgtagggaaggtagacgtcccgtacgtaggttcagtcgaccgtagtccgagggtgggtcgggccggagtccacgtctacacgtattacggcgtaccgtcggcggtcctaggaacgtacttcgtacggtacttaaccgttttactttccgttacgtaccgtaacggtacgtaacgttacttacgtaacgtttaaccggttacccggtttacccccggtttacctttaaccgggttttttaccgggaccccgggttaaccgggggtaaaccctaacgggtaccgttaacgggtaaaaccgttaaccggaaaaccggttacggttacgggtaccgggtaccgttccggaaccctaacccgttaaccgtttacgtttaccggtttccgtttacccgttaacgttccccgtttaccccgaccgttaacgttccgttaacggttaactttaaaccg

SEQ ID NO: 192319 - DNA, 719 bp, Homo sapiens
  misc_feature: GYAE6OF01ELZCP.44.23.C01.1.454.CMB.1.raw
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcagtcaggttcgttttcggtgcttgttgccttggtttacaaacggaaaagggggngacggcccctaaggtcctcgtctctcgtagaaaccngacgtgggaaggtagacgtcccgtacgaggttcagtcgccagtccgagggtcgggtcgggccggagtcccactctcacctagttacgcgtaccgtggccggtcctaggaacgtctttcgtacgtaccttaacttttacttttcgttacgttacgtaacggtacctaaggtttaactacctaagtttaccggttcccgttaccccccgttttacgttaccggtttttccgggacccggtaaccggggggtaaccctaaacgggtaccgttaaaggggtaaaaccgttaacccgtaaaaccggttaacgttcgggtacggtacctacggaccctaaccgtactttcgttacgttcctttaccgtactttccccgttaccccgaccttaacttccgttacgtattaaac

SEQ ID NO: 192320 - DNA, 559 bp, Homo sapiens
  misc_feature: GYAE6OF01EHJGW.44.23.C01.1.454.CMB.1.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaaagggggnaggcccctaaggtcctcgtctctcgtgaaaccngactggaaggtgagtcccgtcaggttcagtgccagtccaggtggtgggccggagtccactctcaccattagcgacctggcggcctggaagtattctagctaacttatttctgtcagctagtatctatagtcgtccccgttctacgttttcggccgtacggggaccaaggcctaggaaactacgaaacgtacgtagtggctgaccacctattctgttccttcacttcccttcccgacctattccgtgtattaac

SEQ ID NO: 192321 - DNA, 657 bp, Homo sapiens
  misc_feature: GYAE6OF01EI85J.44.23.C01.1.454.CMB.1.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgttggaggcagcgtcaccatcacttcggccgggcgagtcgtaggttcgtttcggngtcttgttcgccgttggttacaaacggaaaagggggngacggtaccccttaaggtcctcgtctctcgtacgaaaccagacgtagggaaggtacgacgtcccgtcgtaggttcagtcgccgtagtccgagggtcgggcggggaccggacgtcccacgtcctaccacctagttacggaccgtacccgtggccggtcctaggaacgtacttccgtacgtaccttaactttctttcgtagtacgaacgtctaagttactcgtagttacgtccgtccccgtttacgttacggtttcggaccgtaacgggaacctaaggtcgtaaggaactacgaaacgtacgtcggcgtctacgacctaccgtcgttcttacgttcttacctacttcccgtccctactacttctagtacttaacg

SEQ ID NO: 192322 - DNA, 766 bp, Homo sapiens
  misc_feature: GYAE6OF01CHDNW.44.23.C01.1.454.CMB.1.raw
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcgaggttcgttttcggngctgttcgccttggttacaaacgaaaagggggcacggcccctaaggtcctcgtctcgtcgtagaaccagacgtaggaaggtagacgtcccgtacgtaggttcagtcgccagtccgagggtggtcgggccgagtccactcctacaccgtagttacgccgtacctcggtccggacctaggaaacgtacgttcgtacggtaccttaactttacttttcgtaggttaccaacggtacctaaggttacttaccgtaagttaccggttaccggtaccccccgttttacgttaccggtttttccgggacccggtaacgggggtaaccctaaacgggtcccgttaaggggtaaaaaccttcccggaaaaaccgggtacccgttagggttacccggggtaccgttaccggaccccgttaaacccgtaggtttaccccgtttaccggtttaccctttaccccgtaaccgtttttccccccgttaccccccgggtaccttaactttacccggttaaagttaaacctttaaacggg

SEQ ID NO: 192323 - DNA, 587 bp, Homo sapiens
  misc_feature: GYAE6OF01CY9L7.44.23.C01.1.454.CMB.1.raw
  modified_base (270)..(270): a, c, t, g, unknown or other
  misc_feature (270)..(270): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (570)..(570): a, c, t, g, unknown or other
  misc_feature (570)..(570): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcttggttcaacgaaaagggggnacggccctaaggtcctacgtctctcgtgaaaccagactggaagtagcgtcccgtcaggttcagtgccagtccagggtggtcgggccggagtccactccgtcacctagttacgcgacctggccggctgaagtnttcgtgctaactttntttctgttcagtcagttatcattacggtcgccccgtttgtaccttttgggacccgtaggggtaaccgaaggtcgtaggaaactacgaaaccgtatggtacggtcgtagcctaaccgtcttcctcgtttacctctaaccctccgttaccccctntaccttctagatttacg

SEQ ID NO: 192324 - DNA, 223 bp, Homo sapiens
  misc_feature: GYAE6OF01E5N3R.44.23.C01.1.454.CMB.1.raw
  modified_base (217)..(217): a, c, t, g, unknown or other
  misc_feature (217)..(217): n is a, c, g, or t
  modified_base (222)..(223): a, c, t, g, unknown or other
  misc_feature (222)..(223): n is a, c, g, or t
tcagacagtatatacacgaccggtgctcgatttagtacacgtgattagggatgggggaagaggaagactgacggtcctcccaggagttcaggtgctgggcaccgttgggcacgggggaggtgtgtcacaagtatttgggctcgtggcacagcggccctgggctgcctggtcaaggactacttcctaatatactgtctgaggcgggctggcaaggcgnatagnn

SEQ ID NO: 192325 - DNA, 815 bp, Homo sapiens
  misc_feature: GYAE6OF01C7NYC.44.23.C01.1.454.CMB.1.raw
  modified_base (310)..(310): a, c, t, g, unknown or other
  misc_feature (310)..(310): n is a, c, g, or t
  modified_base (440)..(440): a, c, t, g, unknown or other
  misc_feature (440)..(440): n is a, c, g, or t
tcagacagtatatacacgaccggtgctcgatttagtacacgtgattagggtagtttgggggaagtcgaagaccctgtcgacgggacacgcagtggacatggacggtccccgcgtcacgtcctcctgggacctccttgcctcgctacctggtccttccgtacggttcgagtatggtgacagtcgagagtcgacccgagtccttccgttccttccgtcgttcggtttccttcgtggttcggtacgtcctagtcgccacctacttccgtacgtttcgcccgggtacgtacgtcgtacggttccgttttccggngtcgttcggttcgtccgtttgggttaaccaaacggtaaaaaacggggctaccgggacccggttagggtccttcggttcgtcgtacgtaacgaaaccgtagtaacgtagggacgtacgacgttcccggtanacggttccgaagtccgacccgacggtcccgtagggtacgggtcggggacccgtacgtccaacgtcctacacctaagtccgaaccgaccctaggacgacctaggaattcttacgtcgacttaaccgttatttccgtaacgtcgtaacgtacgtacgttacgtacctaacgtcgtacccggttcccgtttacgttacgtttccggaccgttaaggaaccctaagtaacccgtaaagaaaccgttacgaaaccggtacggttacgtacgggtaccctacggtaaccctacggttaaccgttccggttaccgttaacccgtccggtaaccctttcccccggtacccgtacctttagtcccgtagttacccttaaaccgg

SEQ ID NO: 192326 - DNA, 634 bp, Homo sapiens
  misc_feature: GYAE6OF01A70JF.44.23.C01.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcagtcaggttcgttttcggngctgttgccttggttcaaagaaaaggggnacggccctaaggtcctcgtctctcgtagaaccngacgtggaaggtacgacgtcccgtcgtaggttcagtgcccagtccgagggtcgggtcgggccggagtccacgtcactaccattacgcgacctggccggacctagaacgtcttcgtcgacctaacgtttactttcgtgtaccagtacgtagtacttactacgttacgtccgttccccgtttacgttaccgttttacgggccgtaacggggaacctaaggtccgtaacggaaactactaaaccggtacttgggtcggtacctacgtaccaccgtagtttcccgtacgttccttacctacttacccgttaccccacttactcttagtacttaacg

SEQ ID NO: 192327 - DNA, 698 bp, Homo sapiens
  misc_feature: GYAE6OF01DV6Y5.44.23.C01.1.454.CMB.1.raw
tcagacagtatatacacgaccggtgctcgatttagtacacgtgattagggattggggagtcagaccctgtcagggacagcatggacatgagggtccccgctcagctcctggggctcctgctgctctggctcccaggttcgagatgtgacatcgagatgacccagtctccttccttctgtcttcttctgttggagcagcgtccaccatcacgttgccggcgagtcaggttcgttttcggtgtcttgttcgccgttggttacaaaacggtaaaaagggggacgacggtacccccgtaagggtcctaccgttcctcgtacgtacgaaaccgagtacgtaggaaggtagacgtcccgtcgaggttcacgtgaccacgtccgaggtggtgggccggtaagtcctacgtctacacctagttacgcgacctgccggtacctaggaagtactttcgtacgtaccttaaacgtttacttttccgtagttaccgaagtactaagtttactacgtacgttcgtaccgttcccccgttttagtaacccgttttcgggaaccgtaacggggtaaccaggttcgtacggtaaaactccgtaaaacggtcttagggcgtcgtacgacctaaccgtacgttaccttcggtttcccttaccgtaccgtttaccccgttcccccggttacttagtttacccgttagtatttaaccg

SEQ ID NO: 192328 - DNA, 947 bp, Homo sapiens
  misc_feature: GYAE6OF01DXIWJ.44.23.C01.1.454.CMB.1.raw
  modified_base (278)..(278): a, c, t, g, unknown or other
  misc_feature (278)..(278): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttcgccttggtttacaaacgaaaaagggggngacggccccctaaggtcctcggtactcgtacgtacgaaaacccgagtacgtagggaaacggttagaccggttacccccgtaccgtaaggggttttcccaaggtttccggacccgtaacggttaccccggaagggggtttcggggtacggggggtaccccgggtaaacgttcccccgtaaacggttcccttacccggtaaaccccttaaacggttttaaccggccccgggtaaacccccgttggggaccccggggtacccgtttaagggaaaacgttacgttttaccggtacggtaaccctttaaaaccgttttttaacgttttttacccgttacggttaccgaaacgggttaaccgtaacgggttttaacttaccggttaaacgtttaaccgggtttcccggttacccccccggtttttacgttaacccggtttttttaccggggaccccgggtaaacggggggtaacccctaaaagggtaccgttaacggggtaaaaacttaacccggaaaaacggttaaccggttacgggtacgggtacccgttaccggaccctaaacccgtaacgtttaccgtttacgggtttaccctttacctaacccgttttacccccgtttaccccccggtaacccttaacgtttacccgtttcggtaaacttttaaacccgg

SEQ ID NO: 192329 - DNA, 771 bp, Homo sapiens
  misc_feature: GYAE6OF01A0UAD.44.23.C01.1.454.CMB.1.raw
  modified_base (240)..(240): a, c, t, g, unknown or other
  misc_feature (240)..(240): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttgaggcagcgtcaccatcacgttgccgggcagtcaggttcgtttcggngctgttcgccttggttacaacgaaaaggggcgacggtcccgtaaggtcctcgtctcgtcgtacgaaaccgagacgtagggaacggtacgacggtccccgtacgtaggttcaggtcgcctacgtccgagggttcgggtcggggccggtacgtcccgtacgtccgtaccaacccgtaagtttacggccgtacccgttcggaccgggtaccgttagggtaacgtacgtttccgtacggtaacctttaaccgttttagttttccgtaggttacctaacggacttaagttcttaccgtagttacggttcccgttacccccgtttagtttacccggttttaccgggaccggtaacgggggtaaccctaacgggtccgttaaacgggtaaacctttaacggaaaccggtaaccgttgggtaccggtccgttacggaccctaacccgttcgttacccgttaggtttaccccttttaccgacccgtttcccccccgttttaaccgaccccgttaatttacccggttaagtaacttaaacg

SEQ ID NO: 192330 - DNA, 689 bp, Homo sapiens
  misc_feature: GYAE6OF01D3NTE.44.23.C01.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagacagtatatacacgaccggtgctcgatttagtacacgtgattagggattgggggagtcagaccctgtcaggggacagcatgggacatgagggtccctgctcagctcctgggactcctgctgctctggctcccagataccagatgtgacatccagatgacccagtctccatcctccctgtctgcatcgtggtgggagacagacgtccaaccatcacgttcgccgggngagtcgagggcattagactaattatttagcctggtancacgacaagaaaccgacggaaaccctcctaacctctagtacttctttgctgctactcctactttcgactagtcgacgggtcccagttccgtcggttcaggccggtacgtaggtggtagtcgtcggtactagttactttcgtcttccgtacccacctacgtacacgtccaacggtccctacggacctaaccgtacccgtaagggtaacgtagtttacgttaccggtaacctttaaactttaacgttttaccgtaaacgttaaacgtaaaacggtttaaccaaaccgtaccggttacccgtaccccgtaccctaacgttacccgtttacccggggacccgttaaacggggtaaaccctaaacggggttacgtaaacttaacgtaaaccgtaaaacggtacgttaggtacggcctggtaaccccg

SEQ ID NO: 192331 - DNA, 560 bp, Homo sapiens
  misc_feature: GYAE6OF01ADOB0.44.23.C01.1.454.CMB.1.raw
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaacgaaaaagggggngacggccctaaggtcctcgtctctcgtgaaaccagactggaagtagagtcccgtctaggttcagtgccagtccgaggtggtggggccgngtccactctcacattagcgactgcggcctgagtattcgtgactaactttnttctgtcagctagtactctatacgtcgtccccgttctacgttttcggaccgtaggggacctaagcgtaggaaactacgaaacgtacgtgtcggtctcgacacctactcttgttcctctactcctttccccgactatctagtattaacg

SEQ ID NO: 192332 - DNA, 799 bp, Homo sapiens
  misc_feature: GYAE6OF01BREF6.44.23.C01.1.454.CMB.1.raw
  modified_base (162)..(162): a, c, t, g, unknown or other
  misc_feature (162)..(162): n is a, c, g, or t
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (786)..(786): a, c, t, g, unknown or other
  misc_feature (786)..(786): n is a, c, g, or t
tcagacagtatatacacgaccggtgctcgatttagtacacgtgattagggattggggggagtcagaccctgtcgaggggacagcatggacatgacgggtccccgctcagcctccgtggggctcctgctgctctggcctcccgaggttcgagatgtagacagngagatcgaccctgtccttccttccttcctgtccttcttcgtggttggagcagcgacaccatcacgtcggccgggngagtcgtacggttcggtttggngtcttggttgtaccgttaggttaaacgaaaaacgggtaaaagggggcgtaaccgggtaccccgttaaggtcctcgtctacgtacgtaacgaaaccgtaggacgaagggaagttaccggacctcccggtacgtacggtacgacggttaccgccgtaacggtaccggtagggggtcgggaccgggaacccggtacgtacctacgtaccgtaacccgtaaccgtaggttacggacccgtaccgtccgggacgtaccgtaagtaacggtaccttttacgggaacttaacctttaacgtttttaccgttgttacccggaacgtagtaacgttaaggttaactacggtaacggtttcccggttaccccgtttaacccggtttacgggtttaacggtttcccggggaacggggtaaaacccggggtaacaacgggttacgtaaaaccggtaaaaccggtaaaccgtaaacgacggttggtcgactacgtaccaaccgtgtcctagtttcctagttcccgttacctcccagttanctaagtattaacc

SEQ ID NO: 192333 - DNA, 661 bp, Homo sapiens
  misc_feature: GYAE6OF01ADOFU.44.23.C01.1.454.CMB.1.raw
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcaggttcgtttgngctgtcgcctggttacaacgaaaaggggnacggccctaaggtcctacgtctcgtcgtagaaaccgagaccgtaggaaggtacgtacggtacccgtaccgtacggttcacgtcggacctaggtccgagggtcgggtcggggacccggtagtcccacgttcctcctaccgtagtttacggccgtacccgtggccggtacctagaacggtacttcgtcggtaccttaacgtttacttttccgtaggtaccaggtacctagtatcgtagtacggttccgtaccccgtttcttacgttttcggcccgtaacggggtaccaacggtacgtaacggtaaactacgtaaacgtacgtaggttcgacgttcgaccgtaaccgtcgttacgtacttccgttcacctttccctccccgactactctgtactaac

SEQ ID NO: 192334 - DNA, 751 bp, Homo sapiens
  misc_feature: GYAE6OF01C27Z5.44.23.C01.1.454.CMB.1.raw
  modified_base (244)..(244): a, c, t, g, unknown or other
  misc_feature (244)..(244): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttcgtgttggagcagcgtccaccatcacgttgccgggcgagtcgaggttcgttttcggngtcttgttcgccgttaggtttacaaaacggtaaaaagggggcgaacggaccccttaaggtccctcggtcctcgtcgtacgaaaccgaggtactagggaagtacgacgtcccgtacgaggttcagtcgaccgagtccgagggtcggtcgggcggacgtcctactctacctaacgtacgttacgaccgaccgttggccggtactaggtaacgtcgtttacgtacgtaccttaacgtttacttcgtagtccaacgtactaacggttactactaagttaccgtccgtacccccgtttacgttaaccgttttccgggacccggtaacggggtaaccctaacggtaccgtaacggtaaaacgttaaccgtaaaaccggtaccgttaggttaccggaccgtacgtaccgtaacccgttaaacgttcccgttacggtttacccttacccgttaaccgtttacccccgttaccccggtaacccttagtttacccgttaacggttaattttaaaccg

SEQ ID NO: 192335 - DNA, 794 bp, Homo sapiens
  misc_feature: GYAE6OF01CQIMB.44.23.C01.1.454.CMB.1.raw
  modified_base (249)..(249): a, c, t, g, unknown or other
  misc_feature (249)..(249): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctggttggaggcagcgtcaccatcacgttggccgggcgagtccgtagggttcgttttcggngtcttgttcgtcccttaggtttaaccgaaaacggaaaaaggggggacgaaccgggtaccccgtaacggtcccgttcgttcctccgtcggtaacgaaaaccctaggaacgtagggaaaggtacgaccggttcccgtacgtacgttcgagtcgcccgtaggtccgtagggtcgggtacggggacccggtacgtaccctacgtcctaccgaaccgtaacgtttacggacccggtaaccgtcgggacccggtacctagggtaaacgttacgtttccgtacgttaccttaaacgttttacttttccgtaggttaccgaagtaccgttaagtacttaccgtaaagttccgttcccgtaccccgtttacgttaccggttttaccgggacccggtaacggggtaaccctaacggtaccgttaaaacgggtaaacctaaccggtaaaaccgtaacggttcggtacggaccgttacgaccctaaccgttactaccgttcttccgttaccgtccctttacccgtccccgtaccgtaatccttaagtaacttaaacg

SEQ ID NO: 192336 - DNA, 667 bp, Homo sapiens
  misc_feature: GYAE6OF01A956K.44.23.C01.1.454.CMB.1.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtctgcttctataggagacagagtcgccatcacttggccgggacaagtcagaccattaacngtacttaatttaaagttggtatcagacagacgaccgagggaaacnccccgtagaacctctgactctctgctcgccctccactcngacgtaggtcggtatcctcgttacgtaaggttcagggtcggactaggtcggactcggtagggacttaggtactttccaccgttctacctaacctacttcctaccgtacgttcctacgtacctaaaccgttaggtaaacgtttacgttttacgacctttaaaccgtttaccttacgttacgtaaccaacgtaagttaacgtttactaccgttcccggttaccccgttttacgttaccgggttttacggggtacccgggggtaacctaacggtcgtaagggtacgtacgtaaccgaaacggtacgtcgggtagtcctacgaccctaaccgtcttcgttcgtaccc

SEQ ID NO: 192337 - DNA, 572 bp, Homo sapiens
  misc_feature: GYAE6OF01ELQGE.44.23.C01.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (405)..(405): a, c, t, g, unknown or other
  misc_feature (405)..(405): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctgtttccccggtgccaggtgtgacatcgagatgacccagtctccgtcctcactgtctgcgtctattggggacagngtcaccatcacttgccggnaagtcagagcattaggaacttctttaaattggtatcagcagagccgaaggaaacgccctacaactcctagtactctatgctgccgtcctattttcgacgtaaggtcgggtacccagtacgtaacggttcagtggactaggtggactcgtagggactagtatttcactctcacctatcagcatcncgacacgtagaatattacgacgtagttctttattattgtacaagtagtagtagaacctaatacctccgacttaccgtacgttaccgggacggacggtacctagttcggtaggacgtaacgtaacggtaaacgacgttggacggtactacgacctaactgttcttacg

SEQ ID NO: 192338 - DNA, 704 bp, Homo sapiens
  misc_feature: GYAE6OF01B29HM.44.23.C01.1.454.CMB.1.raw
  modified_base (243)..(243): a, c, t, g, unknown or other
  misc_feature (243)..(243): n is a, c, g, or t
  modified_base (574)..(574): a, c, t, g, unknown or other
  misc_feature (574)..(574): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacgttggccgggcgagtcaggttcgttttcggngcttgttcgccgttggtttacaaacggaaaaggggcgacggacccgttaaggtcctcgtctcgtcgtagaaacccagtacgtaggaaacggttagaccgttcccgtacgtaaggttcgacgttcggccctaaggtcccgtaaggggtcgggttacgggggacccggtacgttcccgaacgttcctaccgaaccgttaagtttacggcccggaacccgttgggcccggtaccttaggaacgttacgtttccgtaggtacctttaaacgttttactttaccgttcgttaccaggtacctaaggttactacgtattacgtccgtaccccgtttntacgttttcgggacccgtagggaacctagacgtaacggaaactacgaaacggtacgtacggtcgtactcgacctacgtacgttctaggttcttacgtacttacccgtcccgacttatcgtgtaattaacg

SEQ ID NO: 192339 - DNA, 759 bp, Homo sapiens
  misc_feature: GYAE6OF01DMKVI.44.23.C01.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (752)..(752): a, c, t, g, unknown or other
  misc_feature (752)..(752): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttctgtcttcttctgttggagcagcgtcaccatcacttgccgggngagtcgaggttcgttttcggngtcttgttcgtccttggtttacaaacgaaaagggggcgacggacccttaaggtcctacgtctctacggtagaaaccagtacgtagggaacggtacgacggtccccgtacgtacggttcagtcgccgtaacgtccgaagggttcgggtacggggaccggtacgtccgtacgttccgtacgaacctagtttacgaccggtacccgtgggccgtacccgtaggaaacgttacgtttccgtacggtaaccttaaacgttttacgtttcgttacgttacgtaacgggtactaagttacgtactaacgtttaacggtcccggtttaccccgtttacgttaccggtttttccgggaacccggtacgggggtaaacccgtaagggtaccggttaacggtaaaaccgtacccggtaaaacggtaccgttacgggtccgtacgcggtaacccaccgttaacttcttacggtttcttaccctaaccggtttccccttccccggacttacgttccttaagttnttaaacg

SEQ ID NO: 192340 - DNA, 871 bp, Homo sapiens
  misc_feature: GYAE6OF01EZY4H.44.23.C01.1.454.CMB.1.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (642)..(642): a, c, t, g, unknown or other
  misc_feature (642)..(642): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcaggttcgttttcggngtctgttgtcctagggttacaaacgaaaacggggggctaacggcccccgttaagggttccctacggttctccgtccggtagtaaaaccccgagtacgtacnggtaacggtacggtaccggtacccgtaccgtacggttacgtacggtcgaccgtacggtaccggtacggggttcgggttacggggtaccgggtaccggtacccgtaccgttaccgtacccgtaacccgttaacgtttaccggtacccggtacccggttaccgggtacccgggtacccggttaacgggttaaaccggttaaccggtttaccgtttaaccgttaacccgtttaaaacccgtttttaaccgtttttaccgtttacggttaccgaaacggttaaccgttaaccggtttaaaccgnttaaccgttaacggtttacccggtttaccccggtttaccccggttttaccggtttaacccggttttaccgggtacccgggtaaccggggtaaccgtaacggtacgtaacgtaaacgtaaaccgtaaacgtacgtacggtacggtacgtaccgtaccgtaccttaccgttaccgttaccgttaccgttaccgttacccgttaccccgttacccgtacccgttacgttacg

SEQ ID NO: 192341 - DNA, 758 bp, Homo sapiens
  misc_feature: GYAE6OF01C7RS5.44.23.C01.1.454.CMB.1.raw
tcagacagtatatacacgaccggtgctcgatttagtacacgtgattagggattgggggagtcagaccctgtcaggggacagcatggacatgagggtcccccgctcagctcctggggctcctgctgctctgtttccccggtgccaggtgtgacatcgagatgacccagtctccgtcctcactgtctgcgtctagttgggacagagtccaccatcacgttcggccgggcgagtcgccgactagtttaggtactttttggccttggttcagcaggagcctggacaaacgcccctaagtcccctagacttcttttcgtggtactcctacgtttaggaagtacggtcggaacgtcccgaagtcccgtaagggttccaacgggccgggtactaacggggtttcgggttttccgtacgggggtaaaccctacgtttacttttacccgaaccttcctttaacccgacccttaaacgttcccgaaacgaccgtaaccggtcccgttacgaccgaacggtcccgtagggtaacgtacggttttccgacgttaactttacgttacgtacgtacctaaactaattacttttacttttttacgtaccgtttacgttacggttttacgggacccgtaacgggggtaccctaaggtccgttaagggtacgtaacgttaaccgaaaaggggtaccgttagggtacggtaccgtacgacctaaccgtacgttacggtttcttaccgtttcaccttttccctccccgtaccttacg

SEQ ID NO: 192342 - DNA, 590 bp, Homo sapiens
  misc_feature: GYAE6OF01E0UBI.44.23.C01.1.454.CMB.1.raw
tcagacagtatatacacgaccggtgctcgatttagtacacgtgattagggattgggggatgctttctgagagtcaaggacctcctgtgcaagaacatgaagcacctgtggtttttcctcctgctggtggcagctcccagatgggtcctgtcccaggtgcagctgcaggagtcgggcccaggactgggtgaggccttcgggaaccctgtctctcatctgcactgtctctggtacgtttccatctagttctgatcatttcgttgggggctgggattccggcacggcccccgagggggacggggaagtgggaggtgggagttgggtgactatcattagtacgtggggcgacgtactactctccgtcctacaagacgtcgtctcactattcgaggcacgtcatacgaactctctcctagaactcgacctccgtacgaccgccgcggaccacggttccgtttagtttctggtgcggaggcgacgacttggttcttacgattcgtaggtcgggccgtcggcctacccgttggtcctaccgttgtccttccgtctacgtcccttacccgaaccgaccgggtccctacggttccccgg

SEQ ID NO: 192343 - DNA, 678 bp, Homo sapiens
  misc_feature: GYAE6OF01CFYIZ.44.23.C01.1.454.CMB.1.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgaggtcccgctcagctcctgggctcctgctgctctggctcccaggttcgagatgtgacatcgagatcgacccagtcctccttccttcctgtcttcttcgtgttggagcagcgtcaccatcacttggccggngagtcgaggttcgttttcggngcttgttgccttgttacaaacggaaaagggcgacggacccgtaacggtcctcgtctcgtacgtacgaaccgagacgtagggaagtacgacgtcccgtacgtacggttcaggtcgaccgtacggtccgtagggtcgggtacggggccggtacgtccgtacgtccgtacctaaccgtaagttacgccgtaccgtcggccggtaccgtacggtaacgtacttaccgtcgtacctttaacgttttatttccgtagtacgtagtacgtaagttactactaacgtacgttccgtacccgtttacgttacggtttaccggaccgtacgggtacctaacggtacgtaacggtaaactaaccgaaacgtacgtcggtcgtacgtacgactaccgtcgttccgttacgttcctctacgttccctccgtactacttcgtcgtcgtcg

SEQ ID NO: 192344 - DNA, 698 bp, Homo sapiens
  misc_feature: GYAE6OF01CCKTD.44.23.C01.1.454.CMB.1.raw
  modified_base (239)..(239): a, c, t, g, unknown or other
  misc_feature (239)..(239): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttcctgtcttcttctgttggagcagcgtcacatcacttgccgggcgagtcgaggttcgtttcggngcttgttcgtccttaggtttacaaacgaaaaagggggcacggacccgttaacggtccgtcgttacctcgtacgtacgaaaccgagtacgtagggtaaggtacgacggtcccgtactggtacagtcgtccacggtccggaggtgggtccgggcggaacgtcctacgtctacctaactagttaccgcgtaccttcggccggtacgtaagacgttacttcgtgtaacctttaacgtttactttctacgtactaacggtactagttctaacgtagttaccggtccttacccggtttacttacggttttccgggacggtaccgggtaaccgaacggtacgttaaggtaaacctaaccgaaacgttacgttacgggtgtaccgtaccaccgtaaccgtacttcggttactttaccgttactacccttcccgttaccgacccttaagtccgtaacgtatttaaacg

SEQ ID NO: 192345 - DNA, 220 bp, Homo sapiens
  misc_feature: GYAE6OF01BZI3U.44.23.C01.1.454.CMB.1.raw
  modified_base (219)..(220): a, c, t, g, unknown or other
  misc_feature (219)..(220): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnn

SEQ ID NO: 192346 - DNA, 779 bp, Homo sapiens
  misc_feature: GYAE6OF01DCRM0.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacttgccgggcgagtcgaggttcgttttcggtgcttgttcgtccgttaggtttacgaaaacgtaaaaaggggggacgaacgggtacccccgttaagggtcccgttccgttaccttccgtcggtacgtaaaacccgaggtaaccgtaggggtaaaggttaacggacggttcccccggttaccgtaagggtttccgacggtcgaccgtacggtcccgtagggttcgggtcggggaccggtacgtacccgtacttccgtaccaacccgtaagtttaacggcccgtacccgtttcgggccgggtacccttaaggtaaacgtactttcccgtacggaaccctttaaaccttttcttttcgtcgttaccaacggtactaaggttactactaagttacggttcccgtacccccgttttagtaccgttttcgggacccggtacgggaaccctaaggtacgtagggtaaactaccgaaaacgtacgttggtacggtactcggacctaaccgtgtcctttcgttccctttacgacctttccccgtttccccgactagttccgtaagtacgtttaaacg

SEQ ID NO: 192347 - DNA, 734 bp, Homo sapiens
  misc_feature: GYAE6OF01ELM8N.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccgtcctcactgtctgcgtctagttggggacagagtcaccatcacgttgccgggcgagtcgccgacattaggtacttttttggccttggtttcagcaggagcctgaacaaacgcccctaagtcccctgtacttcttttcgtggtacttcccgtaacgttttacggaaaggtaggttcgggtaacgtccccgaaggtacccgtaagggtttccgaacgggccgggtcgtacgggtttcgggtttccggtacggggaacctaacgttacttttaccgaaccttccgtacctaacccgtaacttaccgacggaccgtaacgtcccgttacgaccgtacggtcccgtagggtaacgttacgtttcggaccgttaactttactttacgtacgaaccctaaataactttacgttttacttttttaacgtaccgtttaacgttacggttttacggaccggtaacggggtaccaaggtcgttaggaataacgtaacgtaaacggtacgtaggtacggtacgtcgaccgtacccgtattccgttacgttaccttctaccgttcccgttcccccg

SEQ ID NO: 192348 - DNA, 474 bp, Homo sapiens
  misc_feature: GYAE6OF01CR42B.44.23.C01.1.454.CMB.1.raw
  modified_base (227)..(227): a, c, t, g, unknown or other
  misc_feature (227)..(227): n is a, c, g, or t
  modified_base (445)..(445): a, c, t, g, unknown or other
  misc_feature (445)..(445): n is a, c, g, or t
  modified_base (447)..(474): a, c, t, g, unknown or other
  misc_feature (447)..(474): n is a, c, g, or t
tcagacagtatatacacgaccggtgctcgatttagtacacgtgattagggattgggggaagtcagccataatggaagcaccagctataacccgtccctcaagagtcgactcaccatctccgtcgacacgtccaagagacagatgtccctgagtctgacgtctgtgaccgcgcggacgcggctgtgtatttctgtgcgagaggccctggtaccagcgagtggtacctntactactactctctggacgtgtcggggccaggggaccgcggtcaccgtctcctcacgcctccaccgaacgggccccagtccggtccttccccctggccaccctcctccaagcgccacctcgtcggggcacgacggccggccgtgggctcgccgtggtcaacggtactacttcctatactactgtctgacggcgggtctggacgaacggcgctagtagnannnnnnnnnnnnnnnnnnnnnnnnnnnn

SEQ ID NO: 192349 - DNA, 785 bp, Homo sapiens
  misc_feature: GYAE6OF01BI0WW.44.23.C01.1.454.CMB.1.raw
tcagacagtatatacacgaccggtgctcgatttagtacacgtgattagggaggttgggggagtcagaccctgtcagggacagcatggacatgaggtcccgctcagctcctgggctcctgctgctctggctcccgaggttcgagatgtgacatcgagatcgacccagtcctccttccttcctgtcttcttctgttggagcagcgtcaccatcacttgccggcgagtcgaggttcgtttcggtgtcttgttgccgttggtttacaaacggtaaaaggggcgaacggtacccctaaggtcctacgtacctcgtacggtacgaaaccaggtacgtagggaaggtacgacggttcccgtaccgtagggtttccgagttccggtacccgtaacgttaccggagggttcgggtccggggaccggtacgtcccaacgttccttaccgaaccgtagttacggacccgtacccgtcggccggtacctaggtaacgtacgtttacgtcggtacccttaaacgtttacgttttacgtacgttaccgaacggtacgttaacggttaacttacgttaagttacgttacccgtaccccgtttacgtttaccggtttttaccgggaccggtaacggggtaacccaaacggtaccgtaacggtaaaccttaaccgtaaaaccggtaccgttacgggtacgggtaccgtaccggtaacccgtaccgtacgttccgttacggtttcctaccgttaccttccccgtttaccccgacccttacgttcccgttagtacgttaacccg

SEQ ID NO: 192350 - DNA, 755 bp, Homo sapiens
  misc_feature: GYAE6OF01DNWAC.44.23.C01.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggcctccgaggttcgagatgtgacatcgagatcgaccctagtcctccttccttcctgttctttcttctggttggagcagctcacatcacgttcggccgggnagtcgtagggtttccgttttcggngtcgttgttcgtccgttaggttaacgaaaacgggaaaagggggcgtaccggtaccccgttaaggtcctcgtcgtcgtacggtacgaaccgagtacgtagggaagtacgacgtcccgtacgtagttacagtccgaccgtacggtaccggtagggttcgggtaccggggaccggtacgttcccgtactcccgtactacccgtaaggttaccgacccggtaccgtaccgggtaccggtaccgttaaggtaaccgttactttaccgtacgtaacctttaacgttttacgtttcttacggtactaacggtctaaggttaacctcgttaacgttaccggtcccgttaccccgtttaccgtttcggtttaccgggacccgggtaacgggtaacctaacgtaccgtaacggtaaactaccgaaacgtacgtcggtacgcgtcgactaccggtattcgttcttcgttacctaccgttccccgttaccgactacttacgtagtaattaccg

SEQ ID NO: 192351 - DNA, 764 bp, Homo sapiens
  misc_feature: GYAE6OF01A3NU4.44.23.C01.1.454.CMB.1.raw
  modified_base (247)..(247): a, c, t, g, unknown or other
  misc_feature (247)..(247): n is a, c, g, or t
tcagacagtatatacacgaccggtgctcgatttagtacacgtgattagggattgggggagtcagaccctgtcaggggacagcatggacagtgagggtccccgctcagctcctggggctcctgctgctctggctcccaggttcgagatgtgacatcgagatgacccagtcctaccttccttctgtcttcttctgttggaggcagcgtcaccatcacttggccgggacagtcgagggttcgttttcggngtcttggtcgccgttggtttaccaaacgaaaaaggggggcacggtaccccgtaaggtcctacgtctctcgtagaaacccagacgtggaaggtacgacggtcccgtcaggttcagtcgccaggtccgtaggtcgggtcggggaccgacgttccaacgttccgtaccaaccgtagtttaaccggaccgtaccgttcggccggtacccgtaggaaaacggttcgtttaccgtcggtaccttaaaccttttacgttttccgtagttacgagtaccgtaaagttactacgttaagttacggtccgttaccccgtttacgttaccggtttttaccgggaccggttaacggggaacccgtaaacggtccggttaaacgggtaaaaccgttaaccgaaaacgggtaaccgttcgggtaacgggtacctaccggacccttaacccgtaacgttcccttacggttcctttaccgtaacctttaccccgttaccccgacccttaagttccctaagttaacgtttaaac

SEQ ID NO: 192352 - DNA, 727 bp, Homo sapiens
  misc_feature: GYAE6OF01BNO8I.44.23.C01.1.454.CMB.1.raw
  modified_base (186)..(186): a, c, t, g, unknown or other
  misc_feature (186)..(186): n is a, c, g, or t
  modified_base (245)..(245): a, c, t, g, unknown or other
  misc_feature (245)..(245): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctcccaggttcgagatgtgacatcgagatgacccagtctccttcttcctgtcttnttctgttggaggtcagcgtcacctatcacttcgccgggcagtcgaggttcgttttcggngcttggttgtaccgttggttttaccaaaacggaaaaagggggtatacgggtccccttaagggtccctcggtacttccgtacggtacgaaaacctaggacgttacgggaaggttacgacggttccccggtaccgtaagggtttaccgaaggttcggacctaacgggttacccgtaagggggttcgggtacggggggacccggtaagtccccgaacttcctccgaaccccgttaagtttaaccggccgtaaccgtcgggtccggtccctaggtaaacgtcgtttactcgtacgttaaccgttttatttaccgttagtaccgtacgtcgtagttactacgtagtacggtcgtcccgttcttacgttttcggaccgtacggggacctaaggtccgtaaggaaactacgaaacgtacgtggtacgctacggccacgtattcgtcgtcttacctacttcccgttcccgacttacttctcgtattaacg

SEQ ID NO: 192353 - DNA, 224 bp, Homo sapiens
  misc_feature: GYAE6OF01CXUHO.44.23.C01.1.454.CMB.1.raw
  modified_base (222)..(224): a, c, t, g, unknown or other
  misc_feature (222)..(224): n is a, c, g, or t
tcagacagtatatacacgaccggtgctcgatttagtacacgtgattagggattggggggaagaggaagactgacggtcctcccaggagttcaggtgctgggcaccttgggcacgggggaggtgtgtcaacaagatttgggctctgggcacagcggccctgggctgcctggtcaaggactacttcctatatactgtctgagcgggctggcaaaggcgcatagnnn

SEQ ID NO: 192354 - DNA, 727 bp, Homo sapiens
  misc_feature: GYAE6OF01A3XLC.44.23.C01.1.454.CMB.1.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcaggttcgttttcggngctgttgccgttggtttacaaacgtaaaaaggggngacggcccctaaggtcctcgtcctcgtcgtacgaaaccgagacgtagggaaggtacgacggtccccgtaccgtagggtttcgaacgtcggcccgtacggtccgagggtcgggtcgggggcccggtacgtcccacgttcctaccgaacccgtaagtttaccggaccgacccgttcggaccgggtccctaaggaacgtactttcgtacgtaccttaacttttacttttcgtggttacagtacctaaggttactacgtaagttacggtccgtaccccgtttgttaccgtttcgggacccggtaacggggaacctaacggtacgtaacggtaaacttaccgaaaacggtaccgtgggtcggtacgttacggacctaaccgtacgttcgtttacgttctttacccgtactttccccgttacccccgtacttaactttccgtagtaaatttaaccgg

SEQ ID NO: 192355 - DNA, 694 bp, Homo sapiens
  misc_feature: GYAE6OF01C5X6R.44.23.C01.1.454.CMB.1.raw
  modified_base (166)..(166): a, c, t, g, unknown or other
  misc_feature (166)..(166): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgaccngtctccttcctctgtcttcttctgttggaggcagcgtcaccatcacttggtcgggcgagtcgaggttcgttttcggngcgttgttcgcgttggtttacaaaacggaaaaagggggngacggtaccctaaggtcctcgtctcgtcgtagaaaccgagtacgtagggaagtacgacgtcccgtcgtaggtcagtcgaccgacgtccgagggtcggtcgggccggacgtccgaactccgtaccactagttacgaccgtaccgtgccggtacctaggaacgtacttaccgtacgtaccttaacttttacgttcgtcgtacgagtactagttactacgtaacttacggtacccgtaccccgtttactaccggttttcgggaccggtaacgggtaacctaacggtacgtacgtaaactaaccgaaacgtacgtacgtcgggtactcggacctaccgtaacttcgttcgttacccttacgttacccgtttacccgttccccgtaacgttaccttacgtaagttaacttaaaccgg

SEQ ID NO: 192356 - DNA, 645 bp, Homo sapiens
  misc_feature: GYAE6OF01EUVEK.44.23.C01.1.454.CMB.1.raw
  modified_base (275)..(275): a, c, t, g, unknown or other
  misc_feature (275)..(275): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaaacgaaaaagggggngacggcccctaaggtcctcgtctctcgtagaaaccagacgtggaaggtagacgtcccgtcaggttcagtcgccagtccagggtcggtcgggccggagtccactctcacctagttacgccgtaccgtggccggtctaggaagtacttctcgtacctaactttatttctagtacagtctagtactcgtaattagtccgtccccgtttacgttaccgttttcgggcccgtaacgggggtaacccaaggtacgttaacggaaaacttaccgaaaacgtaacgttcggtacgggtcctacggacctaaccgtacttccgttacgttcctttacctacttacccttcccccgactaacttccttaattaacttacg

SEQ ID NO: 192357 - DNA, 915 bp, Homo sapiens
  misc_feature: GYAE6OF01D6E1O.44.23.C01.1.454.CMB.1.raw
  modified_base (260)..(260): a, c, t, g, unknown or other
  misc_feature (260)..(260): n is a, c, g, or t
tcagacagtatatacacgaccggtgctcgatttagtacacgtgattagggattgggggagtcagaccctgtcaggggacagcatggacatggacgggtccccgctcagctccgtgggctcctgctgctctggcctcccgaggttcgagatgtgacagtcgagatcgaccctagtccttccttccttcctgttctttcttctggttggagcagccgtcacctatcacgttcgccggcgtagtcgtagggttcgttttcggngtcgttggttcgtccgtttacggttaaccgaaaaacgggaaaaagggggtcgtaccggttacccccgttaaggttcccgttacggttccgttaccgttaccggtaaacggaaaacccgtaggtaaccggtaaggggtaacggtacggtacccggttacccggtacgtacgggtttacacggttccgaccgtacggttaccgggtaggggttcggggtaccggggacccggtaaccgttcccgtaacccgttacccgtaacccgtaacccgttaacggtttacccggaccggtaacccgttcgggacccggtacccttaagggtaaaccgtttcgtttaccgttaccggtaacctttaaaccgtttttcgtttaccgttacggtacccgtaaggtacgttaaacgtttacgttaccgttaacggttacccggttttaccccgtacccccggtttttaccgtttaacgggttttacccgggaaccgggttaaccggggaaacccttaaccgggtacggttaaaccggtaaacgttaaaccgtaaaccggtacgttcggtaccgtaccgtacgtaaccctaccgttacttccgttaccgtttccctacccgttccccttacccgtacccttactaacgttactaaattacgttaaccg

SEQ ID NO: 192358 - DNA, 806 bp, Homo sapiens
  misc_feature: GYAE6OF01EJSH0.44.23.C01.1.454.CMB.1.raw
tcagacagtatatacacgaccggtgctcgatttagtacacgtgattagggattgggggagtcagaccctgccaggggacagcatggacatgagggtccccgctcagctcctggggctcctgctgctctggctcccaggttcgagatgtgacatcgagatcgaccagtctccttccttcctgtcttcttctgttggaggcagcgtcaccatcacgttggccgggcgagtcgtaggttccggttttcgggtgtcgttggttcgtcccttagggttttaaccgaaaacggaaaaaggggggacgaccggtacccccgttaagggtccttcggtccttccgtacgtacgaaaccgaggtacgtagggtaaaggtacggacgttcccggtacgtaggttcagtcgccgagtccggagggtcgggtcgggccggtacgtcccacgttctaccaacgtacgttaacgccgtaccgtcgaccggtcctaaggtaacgtactttccgtactaccgttaaccttttacgtttcttacggtacctacggtactaacggttactacgtaacgttaccggtttacccggttcccccgttttacgtttacccggtttttccgggacccgggttaaacgggggtaaccctaacggggtaccgttaaacggggtaaacttaaaccggtaaaaccggttaacggtcgggttaaccgggtacgttacccggtacctaaacccggttaccttaccggttactttcccgtttactaacccgtttacccgttaccccgaccttacctttacgttgaaactttaaccg

SEQ ID NO: 192359 - DNA, 661 bp, Homo sapiens
  misc_feature: GYAE6OF01BQ05F.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggaggtcgggcccaggactggtgaggccttcgggaaccctgtctctcatctgcactgtctctggtacgtttccatctagttctgtactctagtttcgttggggtcgtcgggacgtccgggacgaccggacccccggaagggggaacggggtaacgtgggtaggtgggtagttgggtagtacgtactacctagttacgtacgtcggggacgtacgtacctactccgtcccgtacctacgaagtacgtcgtctacacctagttcggacggtactacgtccagtacgaacccgtcttccgtaccctacgaaaccgtccgtaccgtccggtacgacccggccggaccggaccgtaccggttccttttacgttctggtcggcgtaggcgtagtcgtgttcttagattcggtacggtcgggtcgtcgtccctccgtggtcctagttcgtccttaccgtcgtaccgtccttacccggaaccgtcggtccctacggttccccgg

SEQ ID NO: 192360 - DNA, 702 bp, Homo sapiens
  misc_feature: GYAE6OF01A04FV.44.23.C01.1.454.CMB.1.raw
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttccgttttcggngtctgttgtccttggtttacaaacgaaaaggggnacggcccgtaaggtcctcgtctcgtcgtagaaccgngacgtggaaggtcgacgtcccgtcgtaggttcagtcgccagtccgagggtcggtcgggaccggtatcccactcctacgacctagttacgccgtacctggcggtacctggtaactcgtttccgtacgtaaccttaacgttttactttcgtacgtaccgacgtactaaggttactaccgtaagttaccggttacccgttacccccggtttctacccgtttttcggggaacccggtaacgggggaaccctaaggtccggtaaacggtaaacgttaaccgaaacggtaacgttcggtacgggacctcggacctaaccgtacgttcctttacggtccctttaccgtacgttaccccgtttacccgacccgttagttccgttaagtacgttaaacg

SEQ ID NO: 192361 - DNA, 810 bp, Homo sapiens
  misc_feature: GYAE6OF01C2QLV.44.23.C01.1.454.CMB.1.raw
  modified_base (232)..(232): a, c, t, g, unknown or other
  misc_feature (232)..(232): n is a, c, g, or t
tcagacagtatatacacgaccggtgctcgatttagtacacgtgattagggattgggggagtcagaccctgtcaggggacagcatggacatgagggtcccccgctcagctcctggggctcctgctgctctggcctcccaggttcgagatgtgacatcggagatcgacccagtcctcccttccttcctgttcttcttctggttggaggcagcgtcaccatctacgttggccggngtagtcgtaggttccggttttggtcgtcgttggttcgtccgtttaggttaaccgaaaacggaaaaaggggggcgaccgggtaccccttaaggtcccttcggtccttccgtacggtaacgaaaccctaggtacgtaggggaaacggtacgaccggttaccccggtacgtaggttcaggttcgaccgtacggtccggaggggttcgggtccgggggaccgtacgtacccgtactccgtaccaaccgtagttacggccgtaccgtcgggacccggtagtaacggaaagttcgttaccgtagtaccttaaacgtttactttaccgtagttaccgaagttacgtaagtttactacgtaacgttaccggttaccccgtaccccggttttaccgttacggttttaccgggaccgggtaacggggtaaccctaacggtaccggttaaggtaaaacctaccggtaaaccggtacgttacgggtacggtacctaccggacctaaccgttacgtttcctacggtttcctttaacccgacgtttccccccgttaccccgattaccgtttaccgtaagttacctttaaacg

SEQ ID NO: 192362 - DNA, 720 bp, Homo sapiens
  misc_feature: GYAE6OF01A1UIP.44.23.C01.1.454.CMB.1.raw
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (468)..(468): a, c, t, g, unknown or other
  misc_feature (468)..(468): n is a, c, g, or t
tcagacagtatatacacgaccggtgctcgattttagtacacgtgattagggagttgggggagtcagaccctgtcaggggaccagcgaatggacaactgagggtccccgctcagctcctggggctcctgctgctctgctcccaggttcgagtatgtgacatcgagatgaccaacgtctcctttccttcctgtcgttacttctgttcggagtcagcgtcaccatcacgttgccgggcgagtccacggttcgttttcggngtcttgttcgccgttggttacaaacgaaaaaagggggnacggaccccgtaaggtcctcgtcctcgtcgtacgaaaccagactaggaagtagacgtcccgtccgaggttcagtcgccagtccaggtcggtggggccgtagtccacgtctcacgtagttacgcgacctggccggtcctaggaacgtacttctcgacttaacctttatttccgngttacgaacggcctaaggtactacgtattacggtcgtcccccggtttacttaaccgtttttcgggacccgaacgggggtaacccaaacggtcggttaagggtaaacgttaacccaaaaccggtaacttcgggtacggtccgttacggaccccgtaaaccgtaagtttacccgttacgttcccgtttaaccgtaacgttttaccccgtttacccccggtaccgtaaccttcccgttaaaggtaaactttaacg

SEQ ID NO: 192363 - DNA, 539 bp, Homo sapiens
  misc_feature: GYAE6OF01C70KP.44.23.C01.1.454.CMB.1.raw
  modified_base (508)..(539): a, c, t, g, unknown or other
  misc_feature (508)..(539): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagacggccctggtaccagcgagtggtacctctactactactctctggactcgtgggggccaggggaccgcggtccaccgtctcctcacgcctcccaccgaacggcccctacgtccggtcccttcccccgtcggccctacccctccctacccaagcgccacccgtcgtcggggccacgacggccggcccgtgggacctcggtcccgtcggtacgtaaacgggtacccttaccgttcccgaccgtttcctacgtcggtccgtagggacgggtccgggtacggcggaccgaacgggccgtacgtaagtcgacgnnnnnnnnnnnnnnnnnnnnnnnnnnnnnnnn

SEQ ID NO: 192364 - DNA, 948 bp, Homo sapiens
  misc_feature: GYAE6OF01DZ7E8.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtccttccttccttcctgttctttcttctgttggaggcagcgtcacctatcacgttcggccgggcgagtcgtacgggttcgttttcggtgtcgttgttcgtccgttaggtttaaccgaaaacggtaaaaagggggcgtaaccggtacccccgttaaggttcccttcggtccttacgtacggtaacggaaacccgtagtaccggtagggtaaacggtacgtacggttccccgtacgtacggttcacggttcgacccgtacggtaccggtaagggttcgggtaccggggtcccggtaaccgttaccctaccgttaccgtaacccgaacccgttaaggtttaaccggaccggtacccgttacgggccccggtacccgtaaaggtaaaccgggtttacctttaccgggttaccgttaaacccgttttaaaccgtttttaaccgtttttccgtaacggtttaccgtaaacgggtccgttaaaacggtttaccgttaaccgttaaacgggtttacccggtttacccccggtttaaccccccggtttttaacggtttaaccccggggttttttaacccggggaacccggggttaaaccgggggtaaaccccgttaacgggttaacccgggttaaacggtaaaaaccggggttaaaccctaaaacgggttaccgttacgggttacggtacccgttaccgaaccgttaacccgtacgtttccgttaggtttcccttaaccgtaccgtttccccgttaccccgtacttaaccttacgttacgtaagtttaaccg

SEQ ID NO: 192365 - DNA, 869 bp, Homo sapiens
  misc_feature: GYAE6OF01BYYY4.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttctgtcttcttctgttggagcagcgtcaccatcacgttcggccggcgagtcgaggttccggtttcggtgtctgttcgtccgttggtttacgaaacggtaaaaagggggacgacgggtaccccgtaaggttcccgtcgtaccgttcgtacggtacgtaaaccgaggtaaccgtagggtaacgggtaacggacggtaccccgttaccgtaagggtttccaaggtccgacccgtaggtaccggtaggggttgggtccgggggacccggtacgttcccgtactccgtacctaacccgtacttacggccgtacccgtcggacccggggtaccctaggtaacgtcgtttaccgtagtaacccgttaaacgtttttacctttaccgttacgttaccggtagtaccgttaagttacgttaccgtaacgttaccggtttcccggtaccccccgttttagtttacccggtttttaccgggaaccccgggtaacgggggtaacccttaaacgggtccggttaaacggtaaaaccgttaaaccgaaaaccggttaacggtcgggttaccgggtaccgtaccggtacccgtaaccccgtaagtttccccgtttacggtttccccgtttaacccttacccgttttacccccggtttacccccggtacccttaacggttttcccttaggttaaaccgttttaaaacg

SEQ ID NO: 192366 - DNA, 833 bp, Homo sapiens
  misc_feature: GYAE6OF01BD8IJ.44.23.C01.1.454.CMB.1.raw
tcagacagtatatacacgaccggtgctcgatttagtacacgtgattagggattggggagtcagaccctgtcaggggacagcatggacatgagggtccccgctcagctccgtggggctcctgctgctctggctcccaggttcgagatgtgacatcgagatgacccagtcctccttccttcctgtcttcttctgttggagcagcgtcacatcacgttggccggcgagtcgaggttcggttttcggtgtcgttggttcgtccgtttagggttttaccgaaaacggtaaaaaggggggcgtaaccgggtacccccgttaaagggttcccgttccggttaccgttaccggttaccggtaacgtaaaacccgaggtaacggttacggggtaaacggttacggtaccggttaccccgttacggtaacgggtttaccgaacggttcggtacccgtacggttccggtacggggttcgggttaccgggggacccggtacgtccccgtaacgttccgtaccgaaccgtaacgttacggacccgtaccgtcggccggtaccgtaggaacgttacttcgtacgtaccttaaccgttttacgtttcgtacgtacgacggttacctaaggttactacgttacgttacgttacccgtcccccgttttacgtaccggttttaccgggaccggtaacggggtaaccctaacgggttaccgtaaagggtaaacctaacgtaaacgtacgttggtaccggtacctacgtaccgtaaccgtcgttccgttacgttcccttaccgtacccgtttcccgttaccccgaccttacggtttcttaagtaatttaaccg

SEQ ID NO: 192367 - DNA, 660 bp, Homo sapiens
  misc_feature: GYAE6OF01AT3YW.44.23.C01.1.454.CMB.1.raw
  modified_base (244)..(244): a, c, t, g, unknown or other
  misc_feature (244)..(244): n is a, c, g, or t
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
  modified_base (606)..(606): a, c, t, g, unknown or other
  misc_feature (606)..(606): n is a, c, g, or t
  modified_base (655)..(655): a, c, t, g, unknown or other
  misc_feature (655)..(655): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagtcagcgtcaccatcacttgccgggcgagtctaggttcggttttcggngtctgttcgtccgttggtttaccaaacggtaaaaaaggggggcgaacggtccccgtaaggttcctcggtactccgtcggtagaaaaccnggtacgtagggaaggtacgtacggtcccgtccgtagggttcaagtcgaccaggttccgagggtgggtcgggccggtagtcccacgtctcaccagttacgctaccgtgcggtcctagacgtcttcgngtaccttacgttatttcgtgttcaacgtcgtagtactcctagtacggtccgttccccgtttagtaccgttttgggacccgtaaggggtcctaacggcgttaacggaaacctacgtaaacggacttcgggtgacgttcgacctaccgnttccgagtttcccttacgtacgttcccttacccggacttagttctagtnttaac

SEQ ID NO: 192368 - DNA, 716 bp, Homo sapiens
  misc_feature: GYAE6OF01B4ECG.44.23.C01.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (347)..(347): a, c, t, g, unknown or other
  misc_feature (347)..(347): n is a, c, g, or t
  modified_base (641)..(641): a, c, t, g, unknown or other
  misc_feature (641)..(641): n is a, c, g, or t
tcagacagtatatacacgaccggtgctcgatttagtacacgtgattagggattgggggagtcagaccctgtcgaggggacagcatggacatgacgggtccccgctcagctccgtggggcctcctgctgctctggcctccgtaggttacgagatgtagacatcgagatacgaccctagtccttccttccttctgttcttcttcgtgtggagcagctcactntctacgtggccgggngagtcgtaggttcgtttcggngtcgttggttcgtccggttaggttaacgaaaacgggtaaagggggcaaccggtacccgtaacggtcctcgtctcgtacggtacgaaaccgngtacgtaggaaggtaccgtacgtacccggtacggtacggtacacggtaccgaccgtaggtaccggaggggttcggggtaccgggtaccggacctccgtacttacgtaccgtaaccgttacgttaccggccggtaccgtcggaccgtacgtaggtaacttcgttcgtacgtaactttactttcgttctacgtagaacgtacttagtactactaagtcccgtccgtcccgttcgttagttcccggacggtaacgggaacctaggtacgtaaacgaactacgtaaacggtgtacggntaccgtacgactaccgtcgttcgtccgttctacccgtcttccccgtacccgattacggtctaacgttattaaccg

SEQ ID NO: 192369 - DNA, 872 bp, Homo sapiens
  misc_feature: GYAE6OF01DDAGB.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgcacttgtctcgtggtacgtttccattccagttctgatctattcgttggggctggacgtccggcacgacccccgaggggagggacgtgggaggtggtagttggtgacgtactcctagttacgtacgtggggcgtaccgtacgtacctccgtccgtccctacgtaacgtacgtccgttacctccgtaacctacgtttaccggaacgggtacctaccggtacccgtaacgtaccggtaaccccgtacctttacccgtaccccgttaacgtaaacccgttaccggtaacccccgtttacccggtaccggtaacccccggtacccgggtaccccgggtaacccggtaaccccggggttttacccgttttttaaccgttttcccggttcggggttaccggaccgggtacggggtaccggtaaccgggttaccggtttaccgggttttaccctttaacggttaaaccgtttccggttaacggggttcccggggggttcccggttaccgggtacccccgttaaccccgggttcgggttaaccccgttacggtttcccggtttccccgtttaccccgttacggttaacccggtttcccccttaacccccggtaaaccccgggtaaacccgggtcccccgttaaccgggtttaccccccccgggg

SEQ ID NO: 192370 - DNA, 790 bp, Homo sapiens
  misc_feature: GYAE6OF01ATSW8.44.23.C01.1.454.CMB.1.raw
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttacttcctgtcttcttctgttggaggcagcgtcaccatcacttcggccgggcgagtcgacggttcgttttcgggtgtcgttgttcgtcccgttaggtttaaccgaaaacggtaaaaaggggggcgaacgggtacccccgttaaagggtcccttaccggttctcgttacggtaacggaaaacccgtaggtaccggtagggaaaggtacgtacggtccccggtacgtaggttcaggtcgcctaggtccgagggtcgggtcgggccggagtcccactccgtacgacctagttacgaccgtaccgtcggccggtaccttaggaacgttacgttccgtacggtaaccctttaaacgttttacgttttaccgtacggtaccgtaacggtaccttaaagttaacttacgtaacgtttacgggttccccgtttacccccgtttaacgtttaccggttttaccgggaacccggtaacgggggtaacccctaaggtaccggttaaacggaaaacttaaccggaaaaccggttcgttacggttacggaccttacggacctaaccgtacgttcttacgttccttccgtaacgttccccgttacccgaccttagtccgttagtaacttaacg

SEQ ID NO: 192371 - DNA, 663 bp, Homo sapiens
  misc_feature: GYAE6OF01AJGE5.44.23.C01.1.454.CMB.1.raw
  modified_base (596)..(596): a, c, t, g, unknown or other
  misc_feature (596)..(596): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggacgtttccatcagttctgatctattcgttggggctggatccggcacgccccgaggggagggaatcgggaggtgggtagttgggtagacacgttacctaagtttaacgtacggtcgggggaccgtaccggttaaccttaccgttccgttccccgttaccctacgaacggtacggttccgtctacccgtacctaacgtttcggagggtacctaccgtaccacgtcgtaaccgtcttacctacccgtagtaacgtccgtacccgtccggtacgacccgcccggcggtaccgtacggtaccgttttactttcgtgtcgccggtacggcgagtacgtggtcctttacgattcgtagtcgggccgtcggtaccnccgttcggcctcgttcgtccctcccgtcacgttcccttaccaaccggaccggccctcgttccccggg

SEQ ID NO: 192372 - DNA, 709 bp, Homo sapiens
  misc_feature: GYAE6OF01EBPA5.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggaggcagcgtcaccatcacttcggccggcgagtcgtagggttcgttttcggtgtcttggttcgtccgttaggtttacgaaaacggaaaaagggggtcgaccgggtaccctaaggtcctcgtctacgtcgtaacgaaaccagtacgtagggaaggtacgtaccggtcccgtacgtaggttcaggtcgacctacggtccgtagggtgggtcggggccggtacgtccctactcctacctaccgtagtttacggccgtacccgttcgggacccggtaccttagggaaagttaccgtttcgtacgtaaccctttaaccgttttattttcgtacgtacacggtactagttactctaagtcgttccgttccccgttattacggtttcggaccggtacgggaacctacgacgtaacgtaaactacgaaacgtagttcggacgtccgtacgacctaccgtattccgtacgttccttaccgtacccttcccgttacccgaccttagttccttagtaacttaacg

SEQ ID NO: 192373 - DNA, 859 bp, Homo sapiens
  misc_feature: GYAE6OF01D83NR.44.23.C01.1.454.CMB.1.raw
  modified_base (209)..(209): a, c, t, g, unknown or other
  misc_feature (209)..(209): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagcctcccagatgggtcctgtcccaggtgcagctgcaggagtcggcccaggactggtgacggccttcgggaaccctgtcnctcatctgcactgtctcgtggtagttccatcagtttctgatctagttcgttgggctggacgtccggcacgccccgaggggagggatgggaggtggtagttgggtgactacgtcctaagttacgtacggtacggggacgtaaccgttaacgttaccttaccgtcccgttacccgtacgaacgtccggttcgtaccttacctaaccgtagtttaccgggacggggtaacctaccgttacccgtaacgttaccggtaacccgttcccgtttaacccttaccccgtaacggtaaaccctttaccggtaacccccgttccgggtaacccgtaaccccgggccccgggtacccgggtaacccggttacccgggtttaccccgttttttaacgtttccggttacgggttaccggtaccgggtaacggggtccgtaacggttacggtttacggtttaccgtttttacgtaaactttaccgggttaccgggttccgggggtaccccggttcgggtaaccccggttccccggtttacgggttaacccgttcccggtttaccggttccccgttaccccgttacccggttaacccgttaccccgttaaaccccgtaaacccccgggttaaccggtcccccggttaagtttccccccccgggg

SEQ ID NO: 192374 - DNA, 502 bp, Homo sapiens
  misc_feature: GYAE6OF01E3OIM.44.23.C01.1.454.CMB.1.raw
  modified_base (479)..(480): a, c, t, g, unknown or other
  misc_feature (479)..(480): n is a, c, g, or t
  modified_base (482)..(502): a, c, t, g, unknown or other
  misc_feature (482)..(502): n is a, c, g, or t
tcagacagtatatacacgaccggtgctcgatttagtacacgtgattagggattggggaagtcagccataatggaagcaccagctataaccccgtccctcaagagtcgactcaccatctccgtcgacacgtccaagagacagatgtccctgagtctgacgtctgtgaccgccgcggacgcggctgtgtatttctgtgcgagacggccctggtaccagcgagtggtacctctactactactctctggacgtcgtgggggccaggggaccgcggtccaccgtcctcctcacgcctccaccgaacgggcccatccgggtcccttcccccgtcggcctacccctcctcccaagcgcctaccctcggtcggggaccacgacggcccggcccgtcgggcctcgccgtcggtacgaacggtacctaccttcccaccgtctacgtcgtcgtggacgggcgggtcctagggacgaacggccgacatagnngnnnnnnnnnnnnnnnnnnnnn

SEQ ID NO: 192375 - DNA, 660 bp, Homo sapiens
  misc_feature: GYAE6OF01CMIN8.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgtcttcttctgttggagcagcgtcaccatcacttggccgggcgagtcgaggttcgttttcggtgctgttcgcttggtttacaaacggaaaagggggagacggtaccccgtaaggtcctacgtctctcgtacgaaaccaggtacgtggaaggtacgacggtcccgtcgtaggttcagtcgccgtagtccgagggtcggtcgggccggagtcccacgttcacactagttacgccgtaccgtggccggtaccgtaggaacgtacttcgtacgtaccttaacgtttactttcgtcgttacgacgtactagtatctaagttacgtccgttccccggtttcttacggttttcgggaccggtaacggggtacctaacggtacgttaacggaaactaacgaacgtacgtgtacggtactacgtaccaaccgttcgtcttacgttcttaccgtacttccttccccgtactacgttctagtacttaacg

SEQ ID NO: 192376 - DNA, 706 bp, Homo sapiens
  misc_feature: GYAE6OF01D6AIR.44.23.C01.1.454.CMB.1.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (495)..(495): a, c, t, g, unknown or other
  misc_feature (495)..(495): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgttctttcttcgtgttggaggcagcgtcaccatcacttggccggcagtcgaggttcgttttcggngtctgttcgccgttaggttacaaaacggaaaagggggngaccggtaccccgttaaggtcctcgtcctcgtacggtacgaaaccgtaggtacgtagggtaaaggtacgaccggttccccgtacgtaggttcaggttcgaccgtaggtccggagggttcgggtcggggaccggagtcccacgttcctacaaccgtagttacgccgtacgtaggccgtaccgtagaagtcttacgtacgtacttaactttntttcgtagtacagtacgtagttatctagttacgtccgttacccgttaccgttacgttttaccggacggtaaccgggtaacctaacggtacggtaacggtaaactaacgaaaccgtaacgtcggtacggtactacgaaccgtaacctacgttacttacgttccttacctaccttcccgttaccccaccttacgttacttagtaatttaaccg

SEQ ID NO: 192377 - DNA, 700 bp, Homo sapiens
  misc_feature: GYAE6OF01DK31B.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (351)..(351): a, c, t, g, unknown or other
  misc_feature (351)..(351): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctcccaggttcgagatgtgacatcgagatcgacccagtcctccttccttcctgtcttcttctgttggagcagctcaccatcacttgccggcagtcaggttcgttttcggngctgttcgcttggtttacaaacgtaaaaggggnacggtcccctaaggtcctgtactntcgagtaaacccaggactaggaaggtacgacgtcccggtactaggttcacgtnaccgagtccgtagggtggtcgggccgtacgccaactccgtacaacctatacgaccgacgcggaccggtacctagaaagttcttacgtacgtacttaacttagtttacgttacggttcgaacgtacgtagttaactctaacgttacgtaccgtaccccgtttaccgttaacgttttccgggaaccggtaacggggaaccgtaacggtacgtaacggtaaaccgttaacgaaacccgtacgtacggttaccggtaaccgtcgtaacccgtaaccgtacgttaccgttacgtttacccttacgttaaccttcccgttacccctaaccctacgttaacctgtaacttaaacgg

SEQ ID NO: 192378 - DNA, 729 bp, Homo sapiens
  misc_feature: GYAE6OF01CLL74.44.23.C01.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (345)..(345): a, c, t, g, unknown or other
  misc_feature (345)..(345): n is a, c, g, or t
  modified_base (568)..(568): a, c, t, g, unknown or other
  misc_feature (568)..(568): n is a, c, g, or t
tcagacagtatatacacgaccggtgctcgatttagtacacgtgattagggagttgggggagtcagaccctgtcaggggacagcatggacatgacgggtccccgctcagctcctgggctcctgctgctctggctccgaggtcgagatgtgacatcgagatcgaccctagtcctccttccttctgtcttcttctgttggaggcngcgtcaccatctacgttgccgggtcgagtcgtaggttcgttttcggngcttggttcgtccgttaggtttaaccgaaacggaaaagggggtcgaacggtaccccgttaagggtcccttcggtccttcgtacggtagaaaacccnggtacgtagggaaggtacgtacggtcccgtacgtaggttccaggtcaccgtacggtaccgaggggtcggtaccggggaccgtacggtacctacgttccctaccggaaccttagtacggccgtaccgtggcccggtactagaaggtacttacgcggtaccttaactttattcgtgttaacacgtacgtagtacttcgaacgttacgtcccgttaccccggtttnttacggttttaccgggaccggtaaccggggtaaactacccggttaagtaaaccggtaaacgtaaccgtaaacggtaccggttcgtacgggtactccgaacctaacgtcttctaccggttcttaactcccgttacgttccccgtacacgttctgtaacttag

SEQ ID NO: 192379 - DNA, 233 bp, Homo sapiens
  misc_feature: GYAE6OF01BTSLP.44.23.C01.1.454.CMB.1.raw
  modified_base (222)..(233): a, c, t, g, unknown or other
  misc_feature (222)..(233): n is a, c, g, or t
tcagacagtatatacacgaccggtgctcgatttagtacacgtgattagggattggggggaagaggaagactgacggtcctcccaggagttcaggtgcgtgggcaccttgggcacgggggaggtgtgtcacaagatttgggctctgggcacagcggccctgggctgcctggtcaaggactacttcctatatactgtctgagcgggctggcaaggcgcagtagnnnnnnnnnnnn

SEQ ID NO: 192380 - DNA, 521 bp, Homo sapiens
  misc_feature: GYAE6OF01AC1QY.44.23.C01.1.454.CMB.1.raw
  modified_base (192)..(192): a, c, t, g, unknown or other
  misc_feature (192)..(192): n is a, c, g, or t
  modified_base (486)..(521): a, c, t, g, unknown or other
  misc_feature (486)..(521): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttcngtgcgagacggccctggtaccagcgagtcggtacctctactactactctcgtggacgtcgtgggggccaggggaccgcggtcaccgtcctcctcacgcctccaccgaacgggcccctagtccggtccttcccccgtggccctacccctccctaccgaacgacgcctacccgtcggtcgggggaccaccgacggcccggcccgttgggcctcgcgtcggtacgaacggtaccttaccttccgtcgtacgttccggcgtctggacggcgggtcgtggacgacggcgactagtacgnnnnnnnnnnnnnnnnnnnnnnnnnnnnnnnnnnnn

SEQ ID NO: 192381 - DNA, 853 bp, Homo sapiens
  misc_feature: GYAE6OF01EFGSO.44.23.C01.1.454.CMB.1.raw
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttcctgtcttcttctgttgagcagcgtcacatcacgttcgccgggcgagtcgtaggttcgttttcggngtcttggttcgacccgttaggtttaccgaaaaacggtaaaaaaggggggtcgaaccggtaccccgttaaacggtccttcgtccgttaccgtacgtaacgaaaacccgtaggaaccggtagggtaaacggtacgaccggttccccgtacgtacgggttcaaggtccgaccgtagtaccggtagggtcgggtcggggtaccggacgtccactccgtactaaccgtaagttacgcccgtaaccgtcggcggtaccctaggaaacgttgttacgtacggttaaccttaacgttttacgttttacgttagtaaccgtaacggttacctaaacggtttacttaaccgtaacgtttaaccgggtttacccggttaccccccggtttttacgtttaacccgggttttacgggaacccgggtaaaccggggtaacctaaaccgggtacgttaaacggtaaaaaccgttaaccggaaaaaccgttaccggtaggttaaccgggaccgttacgtaacccctaaaccgttacgttacccgttcgttttacccgttaccgttaacccgttccccccgtttaccccgtacccgttaatttacccgttaacgtaagtttaaaaccg

SEQ ID NO: 192382 - DNA, 825 bp, Homo sapiens
  misc_feature: GYAE6OF01ABWMZ.44.23.C01.1.454.CMB.1.raw
  modified_base (234)..(234): a, c, t, g, unknown or other
  misc_feature (234)..(234): n is a, c, g, or t
tcagacagtatatacacgaccggtgctcgatttagtacacgtgattagggagttggggagtcagaccctgtcagggacagcatggacatgaggtcccgctcagctcctgggctcctgctgctctggctcccaggttcgagatgtgacatcgagatgacccagtctccttcttctgtcttctctgttggagcagcgtcaccatcacgttgccggcgagtcgaggtcgttttcggngtctgttgcccgttggttttaccgaacgtaaaaagggggcgtacgggtacccccgttaaggttccctacggtaccttccgttaccggttacgaaaacccgaggtaccgtagggaaacggttacgtaacggttccccggtaccgtagggtttaccaggttcgaccccgtaggttcccgaagggttcgggttacgggtacccggtaacgtcccgtaacgttccgtaccgaacccgtagtttacgcccgtaacccgtcggtccggtacctagggtaacgtacgtttacgtcgtaccttaaaccgtttacgttttaccgtacggttaccgaacggtacgtaacggttactaccgtaaagttaccggtaccgttacccccgtttacgttaaaccgtttttccgggaaccggtaaccggggtaaaccctaacgggttaccgtttaacgggaaaaccgtttacccgtaaaaccggttaccgttacgggttaccggtaccgttaccggacccgttaaacccgtccgtttaccgtacgttacccgttaccgtaccgtttaccccgtacccgtacttaccggtacttacgttacgttaccg

SEQ ID NO: 192383 - DNA, 778 bp, Homo sapiens
  misc_feature: GYAE6OF01AZC5L.44.23.C01.1.454.CMB.1.raw
  modified_base (104)..(104): a, c, t, g, unknown or other
  misc_feature (104)..(104): n is a, c, g, or t
tcagacagtatatacacgaccggtgctcgatttagtacacgtgattagggattgggggagtcagaccctgtcgaggggacagcatggacatgagggtcccccgntcagcctcctggggctcctgctgctctggcctcccgaggttcgagatgtgacatcgagatgaccctagtcctccttccttctgtcttcttctggtgaggcagcgtcacatcacgttcgccgggcgagtcgtagggtttcgttttcggtgtcgttggtttcgtccgttgggtttaaccgaaaacgggaaaaacgggggacgaccggaccccgttaaggtcccgtccgtctccgtacgtacgaaacccgaggtaacgtacgggtaaggtacgaccgtcccggtaccgtaggttaccaggtcgacctacggtccgagggtgggtcggggacccggtacgtccgactccgtacctaaccgtagttacgaccgtacctggaccggtccgtagtaacgtagtttccgtagtaaccttaactttacgtttcctcgtacgtaacgtaccgtaagttactaccgtaagttaccgttcccggtccccgtttacgtttccggttttaaccgggaccggtaacgggggtaaccctaaggttaccggtaaacgggttaaacctaaccggtaaacggtacgttacggacggttccgtaaccgtacccttaacgtctttaccttacggtttacccttaccgtaccttaccccgttaccccgtacttacgttccttaagttacttaaacg

SEQ ID NO: 192384 - DNA, 721 bp, Homo sapiens
  misc_feature: GYAE6OF01A99RZ.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcacgggttcgttttcggtgctgttgccgttggtttacaaacggaaaagggggcgacggccccgtaaggtcctcggttctcgtcgtacgaaacccaggtaccgtagggaaggtagaccggtccccgtccgaggttccaggtcgacctaggtccgagggtcgggtcggggccggtacgtcccactctaccaccgtattacggccgaccgtggaccggtcctaggaagtctttccgcgtactaacttttacgttcgtacgtcaacggtctaaggttctacgtaactacggttcgttaccccccgtttgttacccggttttcgggacccggaacggggtaaccctaacggtaccggttaaaggtaaaacctaccggtaaaaccggtacgttcggtacggtcgtaccaccggtaaccctacggttccttccggttaccctttacccgtaactttcccccggtttacccgaccctaactttcgttaagttaacgttaaacg

SEQ ID NO: 192385 - DNA, 546 bp, Homo sapiens
  misc_feature: GYAE6OF01A9WU5.44.23.C01.1.454.CMB.1.raw
  modified_base (278)..(278): a, c, t, g, unknown or other
  misc_feature (278)..(278): n is a, c, g, or t
  modified_base (540)..(540): a, c, t, g, unknown or other
  misc_feature (540)..(540): n is a, c, g, or t
tcagacagtatatacacgaccggtgctcgatttagtacacgtgattagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttcaaacgaaaaagggggnacggcccctaaggtcctcgtctctcgtgaaaccagactggaaggtagacgtcccgtcagggttcagtgccagtccgaggtggtcgggcggagtccactctcacctattacgcgacctggcggcctgaagtattctgctaactttatttctgtcagcagtatcatagtcgtccccgttctacgttttggccgaagggggtaccaagctaggaatacgaaacgtacgtgtggctcgacacctatctgtcttcacttccttcccncctatc

SEQ ID NO: 192386 - DNA, 723 bp, Homo sapiens
  misc_feature: GYAE6OF01B1WB0.44.23.C01.1.454.CMB.1.raw
  modified_base (220)..(220): a, c, t, g, unknown or other
  misc_feature (220)..(220): n is a, c, g, or t
  modified_base (269)..(269): a, c, t, g, unknown or other
  misc_feature (269)..(269): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccggngagtcaggttcgttttcggtgctgttgcctggttacaacgaaaaggggnacggaccctaagggtcctcgtctcgtcgtagaaccagacgtggaagtaggacgtcccgtccgaggttcagtcgccagtccagggtcggtcggggccggtagtcctacgtccacaccctagttacgcgtaccgttcggcggtccgtagaacggtacttcgtacgacttaacttttagtttcgtcgtagaagtccgtaagttactccgtaagttacggtccgttacccccgtttacgttaccgttttacgggacccggtaaccgggggaacctaaacgggtccgttaagggaaaaaccttacgtaaaaccgggtaacgttcgggtaccggtacgtttccggaaccttaacccccgttagtttacccggtttcggtttaaccctttaccccgtaaccgtttcccccgttttacccccggaccttacccgtttacccgttgttaaacgttttaaaccc

SEQ ID NO: 192387 - DNA, 575 bp, Homo sapiens
  misc_feature: GYAE6OF01EQ6FH.44.23.C01.1.454.CMB.1.raw
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttcggngctgttgcctggtttcaacgaaaaggggnaggccctaaggtcctcgtctctcgtagaaccagacctggaaggtagacggtcccgtcgaggttcagtcgccagtccaggtggtcgggccggagtccactctcactatcgcgactgcgctgaagtatctgctaacttattctgtcagctagtatctatacgtcgtccccgtttctacgttttcgggccgtaacggggtaccaaggtcgtaggaaacttacgaaacgtaacgttggtacggtaccgtcgtaccacctacgttcgttcgttcctttacacttacccgttccccgcctcgttaccg

SEQ ID NO: 192388 - DNA, 585 bp, Homo sapiens
  misc_feature: GYAE6OF01BVUVH.44.23.C01.1.454.CMB.1.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (491)..(491): a, c, t, g, unknown or other
  misc_feature (491)..(491): n is a, c, g, or t
  modified_base (533)..(533): a, c, t, g, unknown or other
  misc_feature (533)..(533): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttgagcagcgtcaccatcacttgccgggcagtcaggttcgttttcggngcttgttgccttggttttacaaacgtaaaaaaggggggnacgggccccctaagggtcctacgtctctcgtagaaaccngaacgtggaaaggtagaacggtcccgtacgaggttcaagtcgaccagtccagggtggtcggggccgagtcccaactctacacctattagccgtaacccttggaccggtccctaggaagtactttccgtggacctaactttatttctgtcagactagtatcatagtcgcccgttntacttttcggcaacggggaccaagctagaaatacgaaatacngtcggctgccacgtntntgtcttacattccgttcccactatctgtattaacg

SEQ ID NO: 192389 - DNA, 847 bp, Homo sapiens
  misc_feature: GYAE6OF01B3SRI.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacagtcgagatcgaccctagtccttccttccttcctcgttcttcttcgtggttggacggcacgtcgtaccacctactctacgttcggccgggtcgtaacgttcgtacgggttcggttttcggtcgtcgttgttcgtccgttaggtttaacgaaaacgggtaaaagggggtacgaccggtaccccgttaacggttcccgttcgtccgttaccgtacgtacggaaacccgtaggtaacggtaagggtaacggtacggtaccggtcccggtacgtacggttaccgaggtccgaccgtaacggtccggaggggttcgggtccggggaccgtacgtccgtaaccgtctaccgacgtaacgttacggacccgtacccggtcggaccggtccgtaagtaacgttacgttcgtaccgttactttaaacgttttctttaccgtaggtacctaacgtacgttaagttccttaacggtaccgtttacggttacccccgttacccgttttacggttaccgtttacccggggaacggtaccggggttaaccgtacggtaaccggttaacgggtaaaacctaaccggtaaaccggtacgttaacgggtccggtacgttaccggacccttaacgtcgttaccgttacgtttaccccttaccgttacccttttccccgtaacccgtacttaccgttactacgttaacttaacg

SEQ ID NO: 192390 - DNA, 855 bp, Homo sapiens
  misc_feature: GYAE6OF01B0JMV.44.23.C01.1.454.CMB.1.raw
tcagacagtatatacacgaccggtgctcgatttagtacacgtgattagggattggggggagtcagaccctgtcgaggggacagcatggacatgacgggtccccgctcagctccgtggggctcctgctgctctggcctccaggttcgagtatgtgacagtcgagatcgaccctagtccttcccttccttcctgttctttcttcgtggttggaggcagtcgtccacctatctacgttcggccgggcgtagtcgtacgggtttcggttttcggtgtcgttggttcgtccgtttagggtttaaccgaaaaacggtaaaaacggggggcgaaccgggtaaccccgtttaacgggttcccttcggttccgttaccgttaccggtaacggtaaaacccgaaggtaaccggttaaggggtaaacgggttaccgtacccggttaccccggtaccgttacgggttacacggttccgacccgtacggtaccggtaggggttcggggtaccgggggtacccggtacgtaccctaacgttcctaaccgtaccgtaacgttaccgacccggtacgtcgggccggtaccgtagtaacgtcgtttccgtacgtaacctttaacgttttacgtttcgtacggtacaacgtccgtaaagttactacgttaacgttaccgttcccggttacccctttagtttaccgtttccgggaccggtaaacggggtacctaagggtaccgtaaacggtaaaccttaccggaaaccgttaggtacggtacgccgtacggtacctaaccgttgttaccgttccgttccttaccgttacccgtttccccgttaacccgtactagtttccgtaagttaacttacg

SEQ ID NO: 192391 - DNA, 681 bp, Homo sapiens
  misc_feature: GYAE6OF01CUALD.44.23.C01.1.454.CMB.1.raw
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (567)..(567): a, c, t, g, unknown or other
  misc_feature (567)..(567): n is a, c, g, or t
  modified_base (642)..(642): a, c, t, g, unknown or other
  misc_feature (642)..(642): n is a, c, g, or t
  modified_base (675)..(675): a, c, t, g, unknown or other
  misc_feature (675)..(675): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacgttgccgggcgagtcgtaggttcgttttcggngcttgttcgtcgttggttacgaaagtaaaagggggngacggcccgttaaggtcctcgttactccgtacggtacgaaaccaggtacgtagggtaaggtacgtacggttaccccgtacgtacggtttcaaggtcgaccgtacgtccggtagggtggggtccggggaccggtacgtacccgtacctactacccgtaacctacgttacggacccgtacgtcggacccggcgttaacggaattacgttccgtacgtaccgtttaaacctttgttacccttgttacctagaccgtaattaactctagtacggttcgtacccccgtttnttaacggtttccgacggaaccgggactacggacttaaggaaacctacgaaacgacttggcgctacgacctaactnttacgtctacttcgacttcccgtcccatactcntataac

SEQ ID NO: 192392 - DNA, 675 bp, Homo sapiens
  misc_feature: GYAE6OF01BO2ZH.44.23.C01.1.454.CMB.1.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatcgacccagtctccttccttcctgtcttcttctgttggagcagcgtcacatcacttgccggngagtcaggttcgtttcgngtcgttggttgtccgttggtttacaaacggaaaaagggggnacggcccctaaggtcctcgtctctcgtagaaccngacgtggaagtgacgtccgtacaggttcagtcgctagtccgagggtcggcgggccggtatccgactcgtaccaacctagttacgacgtaccgtgccgaccgtagtaacgtnttccgtagacttaacttntttctgtcacgctaagttactacgtaacgtacgttccgtaccccgtttgttaccgttttcggaacccggtaacggggacccgtaaggtaccgttaacggaaagttaacccgaaaccggttaacgtggtacggcgttaccgacccgtaaccgtacgtttcgtaccggtttcctttaccgtaacccgttttccccgtttacccccgaccttagtttcccttaaagtactttaaacc

SEQ ID NO: 192393 - DNA, 750 bp, Homo sapiens
  misc_feature: GYAE6OF01CLD3V.44.23.C01.1.454.CMB.1.raw
  modified_base (464)..(464): a, c, t, g, unknown or other
  misc_feature (464)..(464): n is a, c, g, or t
tcagacagtatatacacgaccggtgctcgatttagtacacgtgattagggattgggggagtcagaccctgtcaggggacagcatggacatggagggtccccgctcagctcctggggctcctgctgctctggctcccaggttcgagatgtgacatcgagatcgacccagtcctccttccttcctgttctttcttcgtggttggaggcagcgtcaccatcacgttgccgggcgtagtcgtaggttcgttttcggtgtctgttcgcgttggtttaccgaaagtaaagggggcgtacggtacccctaaggtcctcgtcctcgtcgtacgaaccagtacgtaggagtagacgtcccgtacgtaggtcaggtcgaccgtacggtccgtagggtggtacggggccggtagtcccgtacgtcctactacctagtaacgccgtaccgttcggccggtacccgtagaacggttnttacgtacggtaccttaacgtttacgttttccgagtttaccaaggtcctaaggtttacgtactaaacgttcggttcccggttaccccgttttaccgttacggttttcccggggaacggttaccggggtaaacccaacggttaccggttaacgaaacttaccggtaaaacgtacgtagggttccgacggtcggtaaccctaaccgttactacccgtttagttacccgtttaccacccgttccccgtttacccgtaaccttaccggttaccgttagttaaccttaacg

SEQ ID NO: 192394 - DNA, 695 bp, Homo sapiens
  misc_feature: GYAE6OF01BTKBX.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgtcttcttctgttggagcagcgtcaccatcacttggccggcgagtcaggttcgtttcggtgtctgttcgccttggttacaaacgaaaaaggggcgacggaccctaaggtcctcgtctcgtcgtacgaaccagtacgtaggaaggtacgacggtcccgtaccgtaggttacacggtcgaccgtacgtccggtagggtcgggtcgggaccggtacgtccacctctaccacgtagttacgccgaccgtcggccgtcgtagtaagtacttcgacgtaccttaacttttacgtttcgtgtactacgactagtactactaacgttacgtaccgtccccgttttagttacccggttttcgggaccgggtaacggggtaccctaaacggtacggtaacggtaaaacctaacgtaaacgtacggtggtacgtacctcgacccgttaacgtacgttccttacggttcccttaccgtcccttttaccccgtccccgtacccttaattccgtaacgttacttaacg

SEQ ID NO: 192395 - DNA, 497 bp, Homo sapiens
  misc_feature: GYAE6OF01BWDCD.44.23.C01.1.454.CMB.1.raw
  modified_base (482)..(497): a, c, t, g, unknown or other
  misc_feature (482)..(497): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtccaccgtctcctcacgcctcccaccgaacgggccccagttccggtccctttcccccgtcggccctacccctccctcccaacgcgaccacccttcggtgggggccacgacggccggccccgtgggcctcgcccgtcggtcgaaaggaccttaccttcccgtcgactcggtcgtcgtggacggccgggcgtcgggacgacgggccgacgataggnnnnnnnnnnnnnnnn

SEQ ID NO: 192396 - DNA, 553 bp, Homo sapiens
  misc_feature: GYAE6OF01BYWPX.44.23.C01.1.454.CMB.1.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (446)..(446): a, c, t, g, unknown or other
  misc_feature (446)..(446): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgtttcggngctgttgcctggtttcaacgaaaaagggggnacggccctaaggtcctcgtctctcgtgaaaccngactggaaggtagacgtcccgtcaggttcagtgccagtccaggtggngggccgagtccactctcaccattagcgacctgcggcctggaagnttcngactaactttattctgtcagctagtatcagttagtcgtccccgtttntacgttttgggacctaggggaccaaggctaggaaactcgaaacgtactggtggctcgaccacgtactctacgttcttcacttcccttcccgacctattctgtataac

SEQ ID NO: 192397 - DNA, 859 bp, Homo sapiens
  misc_feature: GYAE6OF01D7ASS.44.23.C01.1.454.CMB.1.raw
tcagacagtatatacacgaccggtgctcgatttagtacacgtgattagggattgggggagtcagaccctgtcgaggggacagcatggacatgagggtccccgctcagctccgtggggctcctgctgctctggcctcccgaggttcgagatgtgacagtcgagatcgaccctagttccttcccttccttcctgttcctttcttctggttggagcagtccgtacacctatcctacgttcggaccgggcgtacgttcgtagggtttccgttttcggcgtcgtttggttcgtccgtttaggtttaaccgaaaacgggtaaaaagggggcgtaaccggtaccccgttaacggttcccgttaccgtccttaccgtacggtaaccgtaaaaccgaggtaacggtacgggtaaacggttacggtaccggtttaccccggtacggttacggtttcgaacggtccggtaccgtaacggtaccgggtaggggttcggggtaccggggacccgggtacgtacccgtaaccgttccgtaaccgtaaccgttaacggttaccggtacccggtacccgtacgggcccggttacccgtaaggtaaccgttacgtttaccgtacgttaacccttttaacgttttacgtttacgttacggtacacggtacttaacggtacttaacgttaacgtaccggtttcccgttccccgtttacggttaccgtttccgggaacccggtaacgggtaacctaaggtaccgtaacgtaaacgtaccgtaaaccggtacgtcgtacggtacgtaccgaccgtaacgtcttccgttcgttccttaccgtaccctttaccccgttacccgacttatcgtatcgtttaac

SEQ ID NO: 192398 - DNA, 652 bp, Homo sapiens
  misc_feature: GYAE6OF01ANZD3.44.23.C01.1.454.CMB.1.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
tcagacagtatatacacgaccggtgctcgatttagtacacgtgattagggagttgggggagtcagaccctgtcaggggacagcatggacatgagggtcccgctcagctcctgggctcctgctgctctggctccgaggttcgagatgtgacatcgagatgacccagtctccttccttcctgtcttcttctgttggaggcagtcgtccacatcacgttggccgggcgagtcgaggttcgttttggngtcttgttcgccgttggtttacaaacgtaaaaagggggntacggacccttaaggtcctcgtactcgtcgacgaaaccngacgtaggaacggtacgacgtcccgtacgaggttcagtcgccgtagtccgagggtcggcgggtccgaggtccactctcgaccgtagttcgaccgtacctggccggtctaggaacgtcgttcctcgacttaactttagttccgttgaacgagtcgagttaactcgtacgtacgtccgttccccgttgtaacgtttcgggaccgtaacggggtacccaaggttcgtacggaaacttacgaaacggtacttcggtaagcgttaccgaacgtcccgtaagttccgtagttcctacgttacttccccgttacacgttaactcgtacgtattaacg

SEQ ID NO: 192399 - DNA, 626 bp, Homo sapiens
  misc_feature: GYAE6OF01EWFQ0.44.23.C01.1.454.CMB.1.raw
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
  modified_base (445)..(445): a, c, t, g, unknown or other
  misc_feature (445)..(445): n is a, c, g, or t
  modified_base (570)..(570): a, c, t, g, unknown or other
  misc_feature (570)..(570): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctggttggaggcagcgtcaccatcacttgccgggcgagtcaggttcgttttcggngctgttgcctggtttcaacgaaaaggggganacggcccctaaggtcctcgtctctcgtacgaaaccagacgtggaaggtacgacgtcccgtacaggttcacgtgccagtccgagggtggtcggggccggtagtccactctccactacgttacgccgtacccgtggaccggcctaggaacgtctttacgagtacctaactttntttcgtgtaccagtctaagtactctaattacgtccgtccccgtttactacgtttcgggacccgaggggtaacccaggcgttaggaaacttacgaaacgtaccgtggtcgctacggacctaccgtnttcttcggtcctttacaccttcccgtttccccgctaaccgttctaagtacttaacg

SEQ ID NO: 192400 - DNA, 1021 bp, Homo sapiens
  misc_feature: GYAE6OF01CRFL4.44.23.C01.1.454.CMB.1.raw
  modified_base (241)..(241): a, c, t, g, unknown or other
  misc_feature (241)..(241): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacttgccggcgagtcaggttcgttttcggngtctgttcgctggtttacaaacgaaaaggggagacggcccgtaaggtcctcgtctcgtcgtacgaaccagacgtaggaaggtacgtaacggtcccgtaccgtacggttcgtacgtcggccgacggtaccgacgggtgggtacggggccggtacgtacccgtacgtccgtacgtacctaagtacggtaccgacccgttcggccggtacccgtacggtaacgttacgtttaccgttacgggtaccctttaaaccgttttaaccgttttaccgtttcgggttaccgtaacggtaaccgtaaccggttttaacttaccgttaaaccggtttaaacggttccccgggttttaccccccccgtttttaacccggtttaaccccgggttttttacccggggtacccccggggtaaaaccggggggttaaaccccggttaaaccgggtaaacccgggttttaaacccgggtaaaaaccggtttaaaccccgtaaaaccgggttaaacccgggtttacgggtttaccggggtaaccccgttaccggggtaaccccttaaaaccccccggtttaaccggttttaacccccgtttttacccggggtttttaacccccccgttttttaaacccccctttttaaaaccccccccggttttttacccccccccggggtttttttaaaccccccccccgggggttaccccccctttttaaaaaacccggtttttccccccgggtttttaaaacccggttttaaaacccggtttttttttaaaaaaacccccgggg

SEQ ID NO: 192401 - DNA, 929 bp, Homo sapiens
  misc_feature: GYAE6OF01ARD2E.44.23.C01.1.454.CMB.1.raw
  modified_base (255)..(255): a, c, t, g, unknown or other
  misc_feature (255)..(255): n is a, c, g, or t
tcagacagtatatacacgaccggtgctcgatttagtacacgtgattagggagttgggggagtcagaccctgtcgaggggacagcatggacatgacgggtccccgctcagctcctggggctcctgctgctctggctcccaggttcgagatgtgacatcgagatcgacccagtcctccttccttcctgttcttcttctgttggagcagcgtcaccatcacgttcggccgggcgagtcgagggtttccggttttcggngtcgttggttcgtccgttggtttaccgaaaacggaaaaaggggggtcgaaccgggtccccgttaaggttcccttcggttccttccgttaccggtaacgaaacccgtaggtaaccgttagggaaacgggtacgtacccggttccccggtaccggtaacgggtttaccgacgttccgacccgtacggtccggtaagggggttcggggtaccgggggcccgggtacgtaccccgtaacttcccgttaacccaaccccgttaagttaccggaccccggtaacccggttcgggtacccgggtacccgttaagggtaaacgttacgtttcccgtacggtaacctttaaaccgttttacttttccgtcgtaccgtaacggtaccgttaaggtttaactaccgtaacgttaccgggttaccccggtttacccccggttttacgtttacccgggtttttacggggacccggtttaaacggggaacccgtaaccgggtaaccggtttaaacgggtaaaaccttaacccgggtaaaacccggttacggttaccgggtaccggtaccgtttacccggaacccgtaaccgttacgtttccgttaccggttttccctttaacccgtaccttttccccgtacccccgttacccttaaacgtttcccggttaagttaacttttaaacccg

SEQ ID NO: 192402 - DNA, 610 bp, Homo sapiens
  misc_feature: GYAE6OF01B56J4.44.23.C01.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgaccagtcctccttccttctgtcttcttctgttggagcagccgtcacatcacgtgccggngagtcaggttcgtttgngctgtcgtcgtgttacaaaggtaaaaggggnacgacccgtagtcctcgtctcacgtanaaaccgagacgtaggaagtacgacgtcccgtacaggttcagtcgaccgtacgtaccggagggtcgggtcgggaccggtacgtcctaccgtctaccaccgttaagtacgcgtacctcggacggtacctagaactnttccgacgtaccttaactttntttcgagttacagtatacgtatcgatcgtccgtccttactacgttacggaccgaaggtaccaagtcgtaacggaaataccgtaacggtatcggtcgtactcgaacctactgttacctagttcctaccacgttcccttacgactatcgtagtaacttacg

SEQ ID NO: 192403 - DNA, 819 bp, Homo sapiens
  misc_feature: GYAE6OF01EVMB4.44.23.C01.1.454.CMB.1.raw
  modified_base (207)..(207): a, c, t, g, unknown or other
  misc_feature (207)..(207): n is a, c, g, or t
  modified_base (260)..(260): a, c, t, g, unknown or other
  misc_feature (260)..(260): n is a, c, g, or t
  modified_base (528)..(528): a, c, t, g, unknown or other
  misc_feature (528)..(528): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctccctaggttcgagatgtgacatcgagatcgacctgtcctccttccttcctgttctttcttcgtggttggagcgngccgtcacctatcctacgttcggccgggcgtagtcgtacggtttcgtttcggngtcgttgttcgtcgttaggttaacgaaaggaaaaggggcgacgtacccgtaggtcctacgtctcgtacgtacaacgacggtacgtaggacggtacgaccggttacccgtcgtaggttcagttccgaccgtacgtaccggtaggggtcgggtaccgggaccgtaccgtcctaccgtccaaccgtaccgttacgttaccgggacccgttaccgtggccccggtaacgttaggtaaacgtttcttacgtaccgttaaccttaaccgttttnttttcgaacgtcggtaactaggttaacttacttacggttaacgttaccggttcccccttaccggttttacggtttaacccggttttccgggaacccgggaacggggtttaacccaacgggttacgtaaaacggtttaaaccgtaaaccggtaaaccggttacgtgggggttaccctaccgttaaaccggacccgttaactttaccggtggttttacccttacgttacccgtttaccccgtccccgtttaaccccggacgtttaccgtaacgtttacttaaacgtttaaccg

SEQ ID NO: 192404 - DNA, 916 bp, Homo sapiens
  misc_feature: GYAE6OF01AHG2L.44.23.C01.1.454.CMB.1.raw
tcagacagtatatacacgaccggtgctcgatttagtacacgtgattagggattgggggagtcagaccctgtcaggggacagcagtggacatggagggtccccgctcagctcctggggctcctgctgctctgctcccaggttcgagatgtgacatcgagatgacccagtctccttccttcctgttcttcttctgttggacgcagtcgtcctacccatcctacgttcggccgggtacgtacggttaccgtacgggtttccggttttttccgggtgtccgtttcggtttcgtcccgtttagggttttaaccgaaaaaccgggtaaaaaaaggggggggtcgtaaccgggttaccccccgtttaaacgggttcccgttaccgggttccttacccggttaccggttaacggaaaaaccccgtagggtaaccgttacggggtaaaacggttaacggtaaccggtttaccccccggtttacgttaacgggtttaacctacggttaccgaacccgttacggttcccggaaggggtttcggggtaccgggggacccggtacgtaccccgtacgttcccttaccgaacccgtaagtttaaccggacccggtaacccgttcgggtacccggtaccctaaagggtaacgttactttacccgtacgttaacctttaaacgtttttacgtttcgtacgggttaacacggttactaacggttaccttacgtaacgttaaccgtcccgttaccccccgtttacgttaccgttttaccgggacccgtaacggggtaaccctaacggtaccgttaacggaaaccttaaccggtaaaccgtaccgttggtacgggtacctacgaccgtaacctagttccgtacgttcccttcacccgtttccctaccccgtactattccggttataaccgtttac

SEQ ID NO: 192405 - DNA, 749 bp, Homo sapiens
  misc_feature: GYAE6OF01BYL11.44.23.C01.1.454.CMB.1.raw
  modified_base (194)..(194): a, c, t, g, unknown or other
  misc_feature (194)..(194): n is a, c, g, or t
tcagacagtatatacacgaccggtgctcgatttagtacacgtgattagggattgggggagtcagaccctgtcgaggggacagcatggacatgagggtccccgctcagctcctggggctcctgctgctctggcctcccgaggttcgagatgtgacatcgagatcgacccagtcctccttccttcctgtcttcttntggttgagcagcgtcacatctacgttggccggcgacgttcgagggtttccggttttcggtgtcgttgttcggtaccttgggtttaaaccgaaaacgggaaaaagggggtcgaaccggtaccccgttaaacggtcccgttaccgttcctaccgttcggtaacgaaaacccggtagtaccggtaagggtaaacggttaccgtaccggttcccccggtacgtacgggttactaacgggtccgaccgtaacggttcccgtaaggggtcgggtccggggaccgtacgtcccgacttccacgaacctagtacgcgtacctcggaccggtctaagaagttcttcgtagtacttaacgtttacttcgtagtcgtaacgtatagtactacgtagtaccgtccgtacccgttcttacgtttacgaccggtaacgggaacctacggaccgtaagaaacgtacgtaaacgtacgtacggtcggtacgtccgtaaccgtacctacgttccgtcgttaccttactcccgtcccttaccccgacttaccgtacgttacgtaacgttaacg

SEQ ID NO: 192406 - DNA, 707 bp, Homo sapiens
  misc_feature: GYAE6OF01BRVXQ.44.23.C01.1.454.CMB.1.raw
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (410)..(410): a, c, t, g, unknown or other
  misc_feature (410)..(410): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacgttcgccggcgagtcgaggttcgtttcggngtctgttgccgttaggtttacaaaacggaaaaggggngacggtaccccgtaaggtcctacgtctctacgtacgaaaccaggaccgtgggaaggtacgtacggtcccggtacgtaggttacacggtcgcctaggtccgaagggttcgggtcggggccgacgtccactcnccgtaactacgttagccgtaccgtggaccgggtacctaggtaacgtcttcgtacgtaaccttaacgttttacgttttcgtacggttacacgtacgtaacgttaactaccgtaagttacggtcccgttacccccgtttagtaccgttttacgggacccgtaacggggtaaccaacgggtacccgtaaaggaaaccgttaacgtaaaccggtacgttagggcggtacctcggtaccctacgtactccgttcgttaccttctaaccgttcccgttcccgacttataccgttgaacgttac

SEQ ID NO: 192407 - DNA, 841 bp, Homo sapiens
  misc_feature: GYAE6OF01EATCD.44.23.C01.1.454.CMB.1.raw
  modified_base (167)..(167): a, c, t, g, unknown or other
  misc_feature (167)..(167): n is a, c, g, or t
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (829)..(829): a, c, t, g, unknown or other
  misc_feature (829)..(829): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccngtccttccttccttcctgtctttcttctgttggagcngctcaccatcacgtcgccgggngacgtcgacggttcgttttcggtgtcttggttcgtccgtttacggtttaaccgaaaaacggtaaaaaggggggacgaaccggtacccccgttaaagggttcccttccggttacctcgtaccggtaacggaaaaccgaggtaacggtagggtaaacggttacgaccggttccccgtacgtacgggttactaacggtcgaccgtacggttccggaggggttcgggtacgggggacccggtaacgtcccgacgttcctaccaacgttaagttccggacccgtaccgtcgggaccggtacccgtaggtaacgttactttcgtaccgtaacctttaaacgttttacttttcgttagtaccgaacgtacgtaaacgttacttaaccgtaggtttaacccgtccccggtttaccccgttttacgtttaccgttttccggggaaccggtaaccggggaactaacggtaccgttaaggtaaactaacccgtaaaggtacgtggtaccgaccgtcgtaaccctacccggttattacccggtttacgttacccttaacttccccgtttacccccgttacccccgggtactttaaccgtttccgttaaaccgttnttttaaaacccg

SEQ ID NO: 192408 - DNA, 781 bp, Homo sapiens
  misc_feature: GYAE6OF01AOMJZ.44.23.C01.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (613)..(613): a, c, t, g, unknown or other
  misc_feature (613)..(613): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccntcacttgccgggcgagtcaggttcgttttcggngctgttcgccttggtttaccaaacgaaaaagggggcgacggaccccgttaaggtccctcgttcctctaccggtacgtaaacccaggtaaccgttagggtaaaggtacgtacggtccccgtacgtacggtttaccgaacgttcgacctacggttcccgagggttcggggtcggggacccgggtacgttcccgaacgttccgtaccgtaacccgtagtttaaccggacccgtaacccgtcgggtaccgggtacccttaagggtaacgttaaccgttttccgtacggttaaccgtttaaccgttttaacgttttccgtacggttactacgggtacctaggttactacgtaacgttacggtccgtaccccgtttnttaccgtttcggaccgttacgggaactacgacgtaagaaacgtctaaaccggtatacggttcggacttaccggacctaaccgtacggttccgttacgttccgtttacccgtccgttttaaccccgtttccccggaacttacccgtttaccgttaaggtactttaaacc

SEQ ID NO: 192409 - DNA, 747 bp, Homo sapiens
  misc_feature: GYAE6OF01ELLZX.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtggggctcctgctgctctggcctcccaggttcgagatgtgacatcgagatcgaccctagtccttcccttccttccttcgttcctttcctcgttggttggaggtcacgccgtaccacctatctacgttcggccggcgtagtcgtacggtttcgtttggcgtcgttgtcgtccgttaggttaaccgaaacgggtaaaaggggctaccggtaccccgttaaggttcccttacgtcgtaccgtacggtaaccgaaaccgaggtacgtagggaacggtacgacgttcccgtacgtaggttcagtccgactacgtcggagggtcggcgggccgtacgtcctacgtccgacacggtacttacggccgtaccgtgccggtactaggtaacgttccgttacgtaccgttaaccttacgttttacttacgttcgtaacgtagtcgttaactactacgtaacgttaccgttccccgttacccgtttacttaccggttttcgggaaccgggtaaccggtaaccgtaggtaaccgtaaaggtaaacctacggtaaaccgtcggtcggtacggtactccggaacctacgtacttgttacccgtccttaccgtccttccggtacccttacgtactttacacgttaattacg

SEQ ID NO: 192410 - DNA, 726 bp, Homo sapiens
  misc_feature: GYAE6OF01EBV7G.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgtactctattcgttgggtctggtacgtccggcaccggcccccgaggggacgggaacgtgggaggtgggtagttgggtacgtacgtactaccgtagttacgtacggtcggggacgtaaccgttaccgtaccgttcctacccgtccctacgaacgtacgttaccgtctactaaccgttacgtttacggacgggtacctacggtacctagtaccgtaacccgtccttaccctacccgtaagtaacctccgtacccgtccggtacgacccggacccgtaccggaccgtaccgggttaccgttttagttccgtcggtacgacgggtacgaccggtacgttaccggtcgtttaccttactaacgttcgttacgggtcgggtaccgtcggtacccgttacccggttacggtcctacgttccggttccttcccgtacgtaccgttaccctacccgaaccggtaccggtcccgtacggttcccccgg

SEQ ID NO: 192411 - DNA, 683 bp, Homo sapiens
  misc_feature: GYAE6OF01E0XDT.44.23.C01.1.454.CMB.1.raw
  modified_base (247)..(247): a, c, t, g, unknown or other
  misc_feature (247)..(247): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgttggagcagcgtcaccatcacttggccgggcgagtccgagggttcgttttcggngtcttgttcgtccgttggtttaccaaacgaaaaagggggcgacggtccccgtaaggtcctcgtctcgtcgtagaaccgagacgtggtaaggtacgacggtcccgtcgaggttacagtcgccagtccgagggtcggtgggccggtagtccacgttcctacacctagttcgcgtacccgtggccggcctagaacgtcttcagtacttaactttatttcctgtacgacgtactaagttactcgtaactacggttcccgtccccgtttcttaccggttttaccgggaccggtaacggggaaccaacggtacgttaaggtaaaacttaaccggaaacgtaacgtcggtacggtaccgttacgacctacgtacttacgttaccgttcccttacgtacctttaccccgttaccccggtacttaacttccgttgtaacttaacg

SEQ ID NO: 192412 - DNA, 729 bp, Homo sapiens
  misc_feature: GYAE6OF01CUFKI.44.23.C01.1.454.CMB.1.raw
  modified_base (666)..(666): a, c, t, g, unknown or other
  misc_feature (666)..(666): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatggtgacatcgagatgacccagttctccttccttcctgtctttcttctggttggagcagcgtcaccatcacgttcggccgggacgtagtcgaggttcgttttcggtgcttgttcgccgtttggtttaaccgaaaaggtaaaaacgggggacgaccggtaccccgttaaaggttcccgttaccgtccgttcgttaccgtaacgaaacccgtaggaaccgttagggaacggtacggaccggtaccccggttaccgtaggttacgacggtcgaccgtacggtaccggtaggggttacgggtacggggtccggtacggtccctaccgtcctacccgaactaacgttacggccgtaccgtcgggtaccgccgtaaggacgtagtttaccgtagtaacccttaacttttacgtttctacgttccgaaggtacctagttctacgtagttaccggtacctccccgttactacggtttcgaccgtacgggaacagtagtacgaaatacgaacgtacgtcgtacggctccncgtaacctgtacgttacgtcgttactaccttcccgttaccctactattccgtgttaacttacg

SEQ ID NO: 192413 - DNA, 766 bp, Homo sapiens
  misc_feature: GYAE6OF01CFLPL.44.23.C01.1.454.CMB.1.raw
  modified_base (275)..(275): a, c, t, g, unknown or other
  misc_feature (275)..(275): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttctgtcttcttctgttggaggcagcgtcaccatcacttgccgggcgagtcaggttcgttttcggtgctgttcgccttggttacaaacgaaaaagggggnacggccctaaggtcctcgtctcgtcgtacgaaaccagacgtagggaaggtacgacgtccccgtcgtaggttcaggtcgccgtacggtccgtaggggtcgggtacggggtccggaagttcccgacttccgtaccaaccgtaacgtttacggcccgtaccgtcggccggtcctaggaagttacttccgtacgtaaccttaacctttattttaccgtcggttactaacggtacgttaaagtacttcgtaagtttaccggttcccgttccccccgttttacttaccgggtttttcgggaccccggtaacgggggtaacccttaagggtaccggttaacgggtaaaacttaaaccgaaaacccgggttacgtaccgggttcgggaccgttacggaaccccttaacgtacgtttacccgtttcggtttacccgttacccttaacgtttccccctttaaccccggccttaacggttcctttaacggtaatttaaaccg

SEQ ID NO: 192414 - DNA, 739 bp, Homo sapiens
  misc_feature: GYAE6OF01EI6SU.44.23.C01.1.454.CMB.1.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccagtcttccttccttctgtcttcttctgttggagcagcgtcacatcacttgccgggcgagtctaggttcgttttcggntcgttgttcgtccgttggtttacaaaacgaaaagggggngacggtccctaaggtcctcgtctcgtcgtacgaaaccngacgtagggtaaggtacgcgttcccgtacgtagggttcagtcgacctaggtccgagggtcgggtcgggcccgtagtccacgtctaccgacgtattacgccgtaccgtcggaccggtccgtaggaacgtactttcgtacgtaccttaacgttttactttcgtaggttctaggaccttaagttacttacgtaacgtttacggtttcccggttacccccgttttacgtttacccggtttttaccgggaacccgggtaaccgggggtaacccttaacgggtaccgttaaacgggtaaacttaaccggtaaaaccggtaacgttcgggtacggtccgtacggacccgtaaccgtcgttccgttaccggttcttacccgtaacctttccccgttacccgtacctagttacctagtaactttaacg

SEQ ID NO: 192415 - DNA, 707 bp, Homo sapiens
  misc_feature: GYAE6OF01A7MOB.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttcctgtcttcttctgttggagcagcgtcaccatcacttcgccgggcgagtcaggttcgttttcggngctgttcgcctggttacaaacggaaaagggggngacggccccgtaaggtcctcgtctcgtcgtagaaaccagacgtggaaggtacgacgtcccgtccgtaggttcagtcgacctaggtccgagggtcgggtcggggcccgtagtccacgtcctaccgacctagttacgccgtacctcgggccggtccctaggtaacgttacgtttccgtacggtaccctttaacgtttattttccgtagttacgacggtacctaggttaactcccgttaagttaccggttcccggttcccccggtttacgtttacccgtttttacgggacccggtaacgggggtaaccctaacggtccgttaacggtaaaactaccggaaacgtaccgttggtcgggtaccttggccctaaccgtacgttcttcggttcccttacgtaccttccccttacccgccctagtttcctgtaacttaacg

SEQ ID NO: 192416 - DNA, 615 bp, Homo sapiens
  misc_feature: GYAE6OF01ER1XY.44.23.C01.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgtttcggngctgttgcctggtttacaaacgtaaaagggggngacggcccctaaggtcctcgtctctcgtacgaaaccagacgtggaaggtagacgtcccgtcaggttcagtcgccagtccaggtcggtgggccggagtccactcncaccattacgcgtacctggccggcctaggaagtactttctgactaacgtttntttcgtatcaggctaagtatcgatacgtcgtccccgtttataccgttttgggaccgtaaggggaccctaaggccgtaagggtaaactaccgaaaacggtacttaggtcggaccttcgaccctaccgtattccgttcgttcctttacacctttcccttaccccggacctacgttcttagatttaacg

SEQ ID NO: 192417 - DNA, 795 bp, Homo sapiens
  misc_feature: GYAE6OF01DUQML.44.23.C01.1.454.CMB.1.raw
  modified_base (430)..(430): a, c, t, g, unknown or other
  misc_feature (430)..(430): n is a, c, g, or t
tcagacagtatatacacgaccggtgctcgatttagtacacgtgattagggagttgggggagtcagaccctgtcgaggggacagcatggacatggacgggtcccccgctcacgtcctccgtggggcctcctgctgctctggcctcccgtaggttcgagtatgtgactagtcgagatcgaccctagttcccttcccttccttcctcgttcttcttgtggttcggagtcagtaccgtaccaactattccgtacgtcgggccgggtagtacggttcggtaggtttccggtttcggacgttcgttggttccggtacggttaaagggttaaaaaccggaaaaagggggcgtaccggttacccgtaggttccgttcgtacgtcctacgaacgaaacgtgacggtaggaacgtcgtaccgtccgtagtacgtctgtcnctaggtcggtggtcgggcgtccggaacttccctaactccgtaccgtaccgtagtaccggctaccgtggacccgtacgtagggtaaacttcgttaccgtaacgttaactttacgttttaccgtttgtacgtaacacgttaactagtaaccttagtaccgtttaccgggtcccctttaccggttacggtttccgggttaaccgggaccggggaaacggttaacctacggggtaaacccggtaaataaaccggtacgtaaaccggttcgcggttaagtacccgctaacccggttatttaccggtcgttttacttaccccttacgtcctttccccgtacactttgtaacctacttaatcggtttacccg

SEQ ID NO: 192418 - DNA, 772 bp, Homo sapiens
  misc_feature: GYAE6OF01BMDY4.44.23.C01.1.454.CMB.1.raw
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccagtctccttccttcctgtcttcttctgttggaggcagcgtcacatcacttgccgggcagtcaggttcgtttcggngtctgtcgtccgttggtttacgaaacgtaaaaagggggacgtacggaccccgttaacggtcctacgttctcgtcgtacgaaaccngacgtaggaaggtacgacgttcccgtaccgtaggttcagtcgccgtacgtccgtagggtcgggtcggggaccggtacgtaccacgttcccgtacgaaccctagtttaacgccggtaacccgtcggtaccggtaccctaggaacgttacgtttccgtacggtacccttaacgttttactttccgttaagttccgtaaggtaccgtaagttaacttacgtaagttaccggttacccgttccccccggttttacgttaacccggttttaccgggaccgggtaaaccggggtaaccgttaaacggtaccggttaaacggtaaaacttaacccggttaaaacggaaccggtttggacggtaccgttcgggaaccctacgtaccttccggttactttaccgttccctaccgtttaccccggtccctacctaacttccggttagtactttaaaccg

SEQ ID NO: 192419 - DNA, 618 bp, Homo sapiens
  misc_feature: GYAE6OF01B14Q5.44.23.C01.1.454.CMB.1.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
tcagacagtatatacacgaccggtgctcgatttagtacacgtgattagggattgggggagtcagaccctgtcaggggacagcatggacatgagggtccctgctcagctcctgggactcctgctgctctggctcccagatactagatgtgacttccagatgacccagtcctccatccctccctgtctgcatcgtgtggganacagagtcaccatcacgttgccgggcagtcaggccattagctaattattagcctggtatcagcaagaaaccacgggaaacctccgtaacctcctagtacttctttgctcgcactcctactttcgactaatcgtacgggtcccatcgtcgttcgagcgacngtgatcgtggactagtatttctcgtctaccactacgtcacgcacgtcctgactacgtaccgttagaacgtagttcgttacgaccttaaacgtttaacttaacgtacggttaaactaaaacgtaacaaaccgtacggtaccaccccgttacaaccgttaccgtttccgggtaccctaacggggtaacctaaaaggtcggtaaacgtacgtaaaccgaaaacgtaacgtacgggtaacggtcctacggtccctaaacccg

SEQ ID NO: 192420 - DNA, 832 bp, Homo sapiens
  misc_feature: GYAE6OF01CYZOE.44.23.C01.1.454.CMB.1.raw
  modified_base (250)..(250): a, c, t, g, unknown or other
  misc_feature (250)..(250): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacgttcggccgggcgagtcgtacgggttccgttttcggngtcgttggttcgccgttagggtttaccgaaaacggtaaaaggggggcaccgggtacccccgttaaggtccctacggtacctccgtacggtacgaaaacccgtaggtaccgttaggggaacggtacggtaccggtaccccggtaccgtaaggttcaacgggttaccgacccgtacggtcccggtaaggggttcgggtccgggggtaccggtacgtacccctacgttcctaaccgtaacccgtaaggttacggacccgtacccgttgggaccccgggtacgttaacggaaacggtttcttaccgtacgtaccctttaaacttttcgtttccgtacggttaccgaacgtaccgttaagtacttaccgtaagttaccggttcccgttcccccgtttacgttaccggttttaccgggacccggtaacggggaaccctaacggtccggttaaggaaaccttaacgtaaaaccggtacggttacgggttaccggtaccgtacgtaccctaaccgtcgtttaccgttcggttaaccctttacggtacccttcccgttacccccgattaccgttactagttacttaaaccg

SEQ ID NO: 192421 - DNA, 831 bp, Homo sapiens
  misc_feature: GYAE6OF01D4NLM.44.23.C01.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgttcttcttctgtggaggcagcgtcaccatcacgttgccgggngagtcgaggttcgttttcggntcgtgttcgccgttggtttaccaaacggtaaaaagggggcgacggtacccgttaaggtcctcgttccgttcgtacgtacgaaacccgaggtacgttagggaaacggtacgaccggttaccccgtacgtacggtttacacggtcgtacccgtaaggttcccgaaggggttcggggttacgggggcccggtaacggttaccccgtaaccgttccgttaaccccgtaaacccgttaaggtttaaccggggaaccccgtaacccggtttcgggaccccggggtaccccttaaacggggtaaacgtttacgttttacccggtaacggttaacccttaaaccgtttttacggtttttacccgttacgggttacctaacgggtacttaacgtttactaccgtaagtttaccgtacccggttccccgtttaccgttaaccggttttaccgggacccggtaacggggtaaccctacggtaacgttaacgggtaaactaacggaaacgtacgtacggtacggcgtacgacctaccgtacttatcggttaccttctacccgttccgttaccccgacttaacgtcttagtacttaacg

SEQ ID NO: 192422 - DNA, 670 bp, Homo sapiens
  misc_feature: GYAE6OF01CFQJY.44.23.C01.1.454.CMB.1.raw
  modified_base (115)..(115): a, c, t, g, unknown or other
  misc_feature (115)..(115): n is a, c, g, or t
  modified_base (163)..(163): a, c, t, g, unknown or other
  misc_feature (163)..(163): n is a, c, g, or t
  modified_base (216)..(216): a, c, t, g, unknown or other
  misc_feature (216)..(216): n is a, c, g, or t
  modified_base (635)..(635): a, c, t, g, unknown or other
  misc_feature (635)..(635): n is a, c, g, or t
  modified_base (649)..(649): a, c, t, g, unknown or other
  misc_feature (649)..(649): n is a, c, g, or t
  modified_base (661)..(661): a, c, t, g, unknown or other
  misc_feature (661)..(661): n is a, c, g, or t
tcagacagtatatacacgaccggtgctcgatttagtacacgtgattagggattggggatgctttctgagagtcaaggacctcctgtgcaagaacatgaagcacctgtgttttccnctgctggtggcagctccagatggtcctgtcccaggtgcagctgcaggngtccggccaggtactggtgacggcctttcgggaacccttgtctctcatctgcntgtctgtggctttcatctagttcagacttctacttcgtgggtctaggacgtccggcaccggtccccggaaggggacggggtaatcggggagttacggtaggttggcgtacgtagtaccgtagtttacgtacggtcgggaacgttaccgtacttaccgtccgttccgtcccgttaagaacgtacggtcttaccacgtacgtacttcggaacggtaccgacgttcgaacgttcgaacccgttcgtacctacgtacggaactcgtaccttccggacgtacccggcggtaccgtaccgtccggtttaccgtttacgttcgtacgtaccgggtcgttagggccggtagttaccgttcggttaacgtttactaacggttctagggttcggaccgttcgaccttccgtgtaccgtctcgtcctccngttactccgtaacnccggacgttccncgttcccgg

SEQ ID NO: 192423 - DNA, 539 bp, Homo sapiens
  misc_feature: GYAE6OF01C6FZ7.44.23.C01.1.454.CMB.1.raw
  modified_base (192)..(192): a, c, t, g, unknown or other
  misc_feature (192)..(192): n is a, c, g, or t
  modified_base (506)..(506): a, c, t, g, unknown or other
  misc_feature (506)..(506): n is a, c, g, or t
  modified_base (508)..(539): a, c, t, g, unknown or other
  misc_feature (508)..(539): n is a, c, g, or t
tcagacagtatatacacgaccggtgctcgatttagtacacgtgattagggattggggaagtcagccataatggaagcaccagctataacccgtccctcaagagtcgactcaccatcctccgtcgacacgtccaagagacagatgtccctgagtctgacgtctgtgacccgcgcggacgcgctgtgtatttcngtgcgagacggccctggaccaggcgagtcgtacctctaactctactctcgtggacgtcggtggggccgaggggacccgtcggtccaccgtcctcctcacgtccctaccgaaccgaacgggcccctacgttccggttcccccgtttcccccgtcggcccctacccctccctacccgaaagtccgacctacgtccggtcggggaccacgacggtcccggaccgtcggctccggtcgttcggactaaacggtccttaccttactacttactaaggttcgtacgagggacggtcggcggacggagtacggcagtacgngnnnnnnnnnnnnnnnnnnnnnnnnnnnnnnnn

SEQ ID NO: 192424 - DNA, 692 bp, Homo sapiens
  misc_feature: GYAE6OF01D3M89.44.23.C01.1.454.CMB.1.raw
  modified_base (218)..(218): a, c, t, g, unknown or other
  misc_feature (218)..(218): n is a, c, g, or t
  modified_base (461)..(461): a, c, t, g, unknown or other
  misc_feature (461)..(461): n is a, c, g, or t
tcagacagtatatacacgaccggtgctcgatttagtacacgtgattagggagttggggagtcagaccctgtcaggggacagcatggacatgagggtccccgctcagctcctgggctcctgctgctctggctcccaggttcgagatgtgacatcgagatcgacccagtctccttccttcctgtcttctctgttggagcagcgtcaccatcactgccggngagtcaggtcgtttcggtgctgttcgccttggttacaaacgaaaaggggcacggccccgtaaggtcctcgtctcgtcgtagaaaccagtacgtaggaaggtagacgtccccgtacgtagggttcaggtcgacctaggtccgagggtcgggtcggggccggagtcccgacttcctcgaaccgtattacggccgtaccgtcggccggacctaggaaacgtcttcgtacgtacccttaaacgtttntttaccgttacggtacaacggtactaacggtttactacgtaacgttacgtccggtacccccgtttagttaccgttttcgggacccgtaacgggggtaaccctaagggtaccgtaaggtaaaccttaccggaaaacggtaccgtgggtacgtacgtacgaccgtaaccgtacgttcgtacgttcgttaccgaccttccccgtacccgtacctaatttccgtagtattaaccg

SEQ ID NO: 192425 - DNA, 618 bp, Homo sapiens
  misc_feature: GYAE6OF01BUFK9.44.23.C01.1.454.CMB.1.raw
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgttcttcttctgttggaggcagcgtcaccatcacttgccgggcgagtcaggttcgttttcggtgctgttgccgttggtttacaaacgaaaaagggggagacggacccctaaggtcctcgtctctcgtagaaaccagtacgtagggaaggtacgacggtcccgtcagggttccagtcgcctagtccagggtggtcggggccgagtccnctcncacattacgcaccgtggccgcctgaagtcttcgtgtactaactttatttctntcagtctagtactcattcgtcgtaccccgttnttaccgttttgggaccgtacggggaaccaaggtccgtaagtaaactaacaaacggtactggtacggaccgttcgacctaccgacttcgtacgttcccttacgtacctttcccgttaccccgactacttccttgtaacttaacg

SEQ ID NO: 192426 - DNA, 878 bp, Homo sapiens
  misc_feature: GYAE6OF01BQCRL.44.23.C01.1.454.CMB.1.raw
  modified_base (842)..(842): a, c, t, g, unknown or other
  misc_feature (842)..(842): n is a, c, g, or t
tcagacagtatatacacgaccggtgctcgatttagtacacgtgattagggagttgggggagtcagaccctgtcaggggacagcatggacatgacgggtccccgctcagctccgtgggctcctgctgctctggcctccgaggttcgagatgtgacagtcgagatcgaccagtctccttcttcctgttcttcttcgtgttggagcagcgtcaccattcacgttcggcggacgagtcgtacggtttcgtttcggcgtcgtggttcgtaccgttacggtttaacgaaaacggaaaacgggggtcgtaacggtaccccgttaaggttcctccgttacttaccgtacgtaacgaaacccgtaggtacgtacggtaagtacgtaaccgtccgtaccgtagttacgacgttcgaccgtacgtccggagggtcgggtacgggtacccggtacgacgtccgtactccgtaaccgtagtttaccgaccgtaccgtcggtaccggtaccgttaaggtaacttaccggtttacgaccgttaacgtttaaaccgttttcgtttacgttaccgttaagtaccgttaacggtaacgtttaacttccggttaaacgtttcccgggttaccgttacccccggttttaacgtttaaccgggtttacccggggaaccccgggtttaacggggaaacccttaaaccgggtacccgtttaaaacgggtaaaaccgtttaaacccgaaaacccggttagggttaacggtacccgggttccgtaaccggtacccctaacccggttaaacgttccggttttaacccgtccccttttaacccggtccctaccccgttttaaccccccncgtttaaaccttaccggttagtttaaaccgttaccg

SEQ ID NO: 192427 - DNA, 914 bp, Homo sapiens
  misc_feature: GYAE6OF01DC8O1.44.23.C01.1.454.CMB.1.raw
  modified_base (232)..(232): a, c, t, g, unknown or other
  misc_feature (232)..(232): n is a, c, g, or t
  modified_base (841)..(841): a, c, t, g, unknown or other
  misc_feature (841)..(841): n is a, c, g, or t
tcagacagtatatacacgaccggtgctcgatttagtacacgtgattagggattgggggagtcagaccctgtcaggggacagcatggacatgagggtccccgctcagctccgtggggcctcctgctgctctggcctcccgaggttcgagatgtgacatcgagactgaccagtcctccttccttctgtcttcttcgtggtggaggcagcgtacacgatctacgttggcccgggngtagtcgtagggtttcggtttacggtcgtcgttggttcggccgtttagggtttaaccgaaaaacgggtaaaaacgggggggcgtaaacccgggtaccccccgttaaagggtcccttaccgtacccgttacgtaccggtaaccgtaaaacgacggtaaccggtaaggggtaaacggttacggaacccggttaccccgtacccgttaagggttcctaaacgggttccgaccgttaacggtacccgggtaaggggttccgggtccgggggtacccggtacgttacccccaacgttacccgttaccgaaacccgttaacgttaccgggcccgtaacccggtcggacccggggtaaccttaagggaaactttcgtttaccgtaccggtaaacccttaacgtttttaccttacggttcgtaacgaacgtacgtaagttaacctcgtaacgttcccggtaccgtttacccccgttttaaggtaccccgggtttttacccgggaacccggtaaaccggggtaacccgtaaaggttcccgggttaaaacgggtaaacctaaacccgggtaaacgttacggttacggtcggttacccgacgtacccgaaaccccgtttnttacccgttcggttacccttaacgttaccccgtcccgttccccaacctacgtttcgtaactaagtttaacccg

SEQ ID NO: 192428 - DNA, 590 bp, Homo sapiens
  misc_feature: GYAE6OF01DMYPB.44.23.C01.1.454.CMB.1.raw
  modified_base (278)..(278): a, c, t, g, unknown or other
  misc_feature (278)..(278): n is a, c, g, or t
  modified_base (412)..(412): a, c, t, g, unknown or other
  misc_feature (412)..(412): n is a, c, g, or t
  modified_base (462)..(462): a, c, t, g, unknown or other
  misc_feature (462)..(462): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttcgccttggtttacaaacgtaaaagggggganacggaccccgtaaggtcctcgtctctcgtagaaaccagactggaaggtagacgtcccgtctaggttcagtcgccagtccgagggtggtgggtcggagtccactctcacctatacgcgacctgcggcctgaagtnttctgctaactttattctgtcagtcagtatctagttgtccgtcccgtttntaccgtttcggccgtaacggggaccaggtcgtaaggaaacttaccgaaaacgtcgtaggtacgtctacgccaacctatcttcggttccttacgaccttcccgttccccgactagttactgtagttaac

SEQ ID NO: 192429 - DNA, 773 bp, Homo sapiens
  misc_feature: GYAE6OF01BTT4V.44.23.C01.1.454.CMB.1.raw
  modified_base (250)..(250): a, c, t, g, unknown or other
  misc_feature (250)..(250): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgttggagcagcgtcaccatcacgttcggccgggcgagtccgtaggttcggttttcggngtccgttggttcgccgttaggttttaccgaaaacggtaaaaaagggggggacgaaccgggtacccccgttaacgggttccctcgttccgtaccgttacggtacgaaaccacggaacgtagggaaggtacgtacggtcccggtaccgtaggttccagtcgaccgtagtccgagggttcggtcggggcccggtagtccctacgtccgtacctaacctagttacgaccgtacccgtggccggtcctaggtaacgtacttccgtacgtaccttaacttttagtttcgttacgtaccgtagtaccttaaggtacttacgtaagttaccgtccggttacccccgtttacgttacccggtttttcgggacccggtaacggggtaaccctaaggtacccgttaaggaaaaccttacgaaaccgtacgttacgggtccggtacgtacgacctaaccgttacgttccttacgttccttaccgtacccttaccccgtttccccggaccttacgttccgttacgtaatttaaccg

SEQ ID NO: 192430 - DNA, 748 bp, Homo sapiens
  misc_feature: GYAE6OF01CJE7Z.44.23.C01.1.454.CMB.1.raw
  modified_base (225)..(225): a, c, t, g, unknown or other
  misc_feature (225)..(225): n is a, c, g, or t
tcagacagtatatacacgaccggtgctcgatttagtacacgtgattagggattggggagtcagaccctgtcgaggggacagcatggacatgagggtccccgctcagctccgtggggctcctgctgctctggctccaggttcgagatgtgacatcgagatcgaccagtctccttccttctgtcttcttctgttggacgtcagcgtcaccatcgacgttcggccggngacgtcgtaggttcgttttcggctcgttgttcgtcgttggtttaacgaaaacggaaaaggggagacggtacccgttaacggtcctcgttacgtacgtcgtaacgaacgtacgacgtaggaagtacgacgtccgtacgtagttcagtcgccgacggtcgagggtcggtcggcggacgtccacgtcctacgaacgtacgttaacgccgtaccgtcggacggtactacggtaacttacgttacgtacggtaaccttaaccgttttagtttcccgtaggtaccgtaacgtacgttaacgttacgttaacttacgtaaaccggttcccgttaccccgtttacggtttaaccgtttaccggacccgggtaaaccggggtaccttaaaacggtaccgtaaacgggttaaacttaaccggaaaaaccgtcggtacggtagtaccctacggtccaaccgttacgttccgttaaccgttcttacccgtaccgttccccttacccgtactaaccgtttctagtactttaaaccg

SEQ ID NO: 192431 - DNA, 861 bp, Homo sapiens
  misc_feature: GYAE6OF01EP1TW.44.23.C01.1.454.CMB.1.raw
  modified_base (298)..(298): a, c, t, g, unknown or other
  misc_feature (298)..(298): n is a, c, g, or t
tcagacagtatatacacgaccggtgctcgatttagtacacgtgattagggattgggggagtcagaccctgtcaggggacagcatggacatggagggtccccgctcagctcctggggctcctgctgctctggctcccaggttcgagatgtgacatcgagatgacccagtctccttccttcctgtcttcttctgttggaggtcagcgtcaccatcacgttgccggtcgagtctacgggttcgttttcggtgtcttggttcgtccgtttaggtttaaccgaaaacggtaaaaaaggggggngtaaacgggtaccccccgttaagggttcccgttaccggttccttaccgttaccggttaacgaaaaacccgtacggtaacggttacgggtaaaacgggggttacggaaccggtttcccccggaaccgttaacgggggttacctaacgggtttaccggaccccgtaagggttaccccggtaagggggggtttcggggtaccgggggggacccggtaaaccggttccccaaccgttcccgtaaccctaaacccgtaaggtttaaccggccgtaaccccgttcggggacccgggtaccctaagggtaactacgtttcacggtaactaacttttactttccgtagtaacaacgtctaagtttctaactaagttaccggttcccgtaccccgtttactttaccggtttcgggaacccggtacgggggtaaacctacgggtacgtagggaacggttaaactaacggaaacggtacgtggtagggtaccagtaccacttaacggttctacgtttacccttacccgtactttaccccgttacccccgaattaaccgttccgtaaggttaaac

SEQ ID NO: 192432 - DNA, 589 bp, Homo sapiens
  misc_feature: GYAE6OF01APL47.44.23.C01.1.454.CMB.1.raw
  modified_base (271)..(271): a, c, t, g, unknown or other
  misc_feature (271)..(271): n is a, c, g, or t
  modified_base (412)..(412): a, c, t, g, unknown or other
  misc_feature (412)..(412): n is a, c, g, or t
  modified_base (452)..(452): a, c, t, g, unknown or other
  misc_feature (452)..(452): n is a, c, g, or t
  modified_base (531)..(531): a, c, t, g, unknown or other
  misc_feature (531)..(531): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgtttcggtgctgttgcctggtttacaacgaaaagggggnaggccctaaggtcctcgtctctcgtagaaccagactggaagtagacgtcccgtcaggttcagtgccagtccaggtggtggccgagtccactctacacattagccgtactgccggtctagaagtattcgagactaacgtttntttctgtcagtctaagtactcagtacgtcgtaccccgttntacgttttcggaccgtacggggaaccaggccttaagggaaacttacgaaaaccgtacgtgtacggctacgaccaacctnttcctgttcccttaccgtaactttccccgtccccgtacctattccttagtacttaacg

SEQ ID NO: 192433 - DNA, 793 bp, Homo sapiens
  misc_feature: GYAE6OF01CJ8PO.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgctactgtctctggtacgtttccattctagttctgattctagtttcgttggggccttaggacgttcccgggcgtaaccggaccccccggaagggggaacggggaaacgtggggtaaggttagggtaacggtttgggtaggtaaccaattacccgtaagtttaacgtaccggtacgggggaccgtaaccggttaaccgtacgttacccgttaccccgttacccctacgtaacggtacggttccgttacctacgtaacccgtagtttaccggacgggtaaccctaccgtacctacgtacgtacccgtccttaccgtaccctagaaacctcgacccttcgcgtaacccgcggcgacgtaccggtctttacgttcgtcggtcgacggtcggacgtaacggaccgttaggttctttaaccgagttcccgtagggtccggggtcccggtacggtccccgtacccgtttagggtaccccgtaacgtttccggttaccccttacccgttaccgtaaccccggttcccgttaaaccccctacccgggaaaaccccgggtcccccttaaacgggtttcccccccggg

SEQ ID NO: 192434 - DNA, 721 bp, Homo sapiens
  misc_feature: GYAE6OF01ESOVS.44.23.C01.1.454.CMB.1.raw
  modified_base (200)..(200): a, c, t, g, unknown or other
  misc_feature (200)..(200): n is a, c, g, or t
  modified_base (443)..(443): a, c, t, g, unknown or other
  misc_feature (443)..(443): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgtcttcttctgttggagcngcgtcaccatcacttggccggcgagtcgaggttcgttttcggtgtctgttcgtccgttggttacaacgaaaaggggacgacgcccgtaggtcctcgtctctccgtagaaccagacgtggaaggtcaagacggtcccgtaccgtaggtaccgagtcgaccgtcgtccggacgggtgggtcggaccggtacgtcctaactcgtcgaacctacgttacgccgtaccgttcggacggtccgttaggntaacggtacttacgtcgtactaacgttactttacgttcgtcgtaagtcgtaataccgttacaccgtttacgacccgttttaccccgggtaccctttacgggttttaccgtaaccggaaccgggtaacccggtaaaacgttaccggtaaacggtaaaccgttaaaccgtaaaaccggtacctaacgggttacgtaccgttacgtcccctaacgtacccttccgttccgttaccgtttacccgtaccttcccgtccccgttaccttaccgttacgttacg

SEQ ID NO: 192435 - DNA, 775 bp, Homo sapiens
  misc_feature: GYAE6OF01A9OJ3.44.23.C01.1.454.CMB.1.raw
  modified_base (197)..(197): a, c, t, g, unknown or other
  misc_feature (197)..(197): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgtggngcagcgtcaccatcacttggccggcgagtccgagggttcgttttcggtgtcttggttcgccgttggtttaacgaaaacggtaaaaaggggggtcgaccggtacccccgttaaaggtcccttccgttccgttccgtacggtacgaaaccctaggaccgtagggaaacgggttacgaccggttccccggtaccgtaaggtttccaaggttccggaccgtacggtaccggtaacggggttcgggtcgggggacccggagttcccctacgtcccgttaccgaaccgtaagtttaccgaccggtaacccgtcgggcccggtacccgttaaggaaagttcctttccgtacgtaaccttaacgttttacttttcgtcgtacgacgtacgtaagttactcgtaacgttccgtccgttacccccgtttattaacccggttttcgggacccggaaggggtacccaaggtccgtaaaggtaaactaccgtaaaccggtacgtgtacgggtactccgtaccgaccgttacttcgttaccgttccttaccgtactttccccgtacccgacttacctcgtgtaaatttaccg

SEQ ID NO: 192436 - DNA, 731 bp, Homo sapiens
  misc_feature: GYAE6OF01B5I8U.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctctgctggtggcagctccagatgggtcctgtcccaggtgcagctgcaggacgtcgggcccaggactgggtgacggccgttcgggaaccctggtcctacgtcatctgcacgttgtctcgtggtacgtttccatctagttctagatctagttcgtgggctggatccggtcacggccccgagggtagggagtggagtgtagtggtagactagtcagttatcgtgggctacggttaactacgtcctccgtacccgtacgaagtacggtcgtactaccgtactacgttccgaacgggtaccacgtaccagtaccgaaccgtctacctaccgtaagaacctacgtacccgtaccgtcggaaccccgccggtaccggtaccggtaaccggttccggttttaactttccggttacgtacgggacggtaacgggtcggaacggtccggttacgggtttacctttaccgaaagtttccggttaacgggtaccggggtccggttacggtacccgtaacccgttcggggtaaccctacgtttcccggttccttacccccgtagtaccccggttacccctaaacccgtacccgggtaaaccgggtccccgtaaacgtttccccccggg

SEQ ID NO: 192437 - DNA, 748 bp, Homo sapiens
  misc_feature: GYAE6OF01ARY3S.44.23.C01.1.454.CMB.1.raw
  modified_base (244)..(244): a, c, t, g, unknown or other
  misc_feature (244)..(244): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtctccttccttcctgtcttcttctgttggagtcagcgtcaccatcacttgccgggcgagtcgtaggttccgttttcggngtcttgttcgaccttgggttttaccaaaacggtaaaaagggggtcgacggacccccgtaaggtcctcgttcctcgtcgtacgaaaccgagacgtaggaaggtacgacgtcccggtacgtaggttcagtcgacccgtagtccgtaggggtcggtcgggaccggtacgtcccgacgttcctaccgtaacctagttaacgcccgtacccgttggaccggtacctaggaacgtacttcgtacgtaccgttactttatttccgtagtaccagtacctagtactactacgtacgttccgtaccccgtttcgtaccgttttacggacccggtaacgggtaacccgtaacggtacggtaacgtaaacgtaccgtaaaaccggtaacctgggttaccggtacgttaccggaccctaaacccgttacgttacgttaccggtttccgtttacccttaacgttcccccgtttaccccggtaccctaacgttttcccttaaggttacctttaaaacg

SEQ ID NO: 192438 - DNA, 904 bp, Homo sapiens
  misc_feature: GYAE6OF01BYDOD.44.23.C01.1.454.CMB.1.raw
  modified_base (131)..(131): a, c, t, g, unknown or other
  misc_feature (131)..(131): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
tcagacagtatatacacgaccggtgctcgatttagtacacgtgatttagggattgggggagtcagaccctgtcaggggacagcatggacatgagggtccccgctcagctcctggggcctcctgctgctcgnggcctcccgaggttcgagatggtcgacagtcgaggtactacggaccctagttccctcccgtttccttacccgttcgttctttccgtttcgtcggtttacgggacgaccgtaacggtcccgttacctaaccgtacgttaccgtaaccgtttcggggacccggggtaaccgtaacggttccgtaacggggttttcccgttttcggggtacgtaccgtttagggttccgttaccggtttaacgggtttaaccgaaaaaaccgggtaaaaacgggggggtcctaaccggggttacccccttaaacgggttcccgttaccggttaccgtacgttaccgggtaaacgaaaaccccggtggtaacccggttagggaaaaccggttacggtacccggttaccccgtccgtaaggttaccaggttcccggaccgtaagtccggaagggttcgggcggtaacccgagtacccgtataccaccgtacagttacccggngttacccnggaacccggtctaggaactttagtccgttacgacttaaaccggtttacttcgtacggtactaacggtactaacggttaccttaacgaacgtttacccggtccggtaccccctttaggttacggttccgaacgggtaacggtaacccgaaaggttcgaaacggttaaacacgtaaaccggtccttagggacctacgtacccgacgttaccgtcctaggttccgtacctttaccgtaccttcccggttacggacccttaggttaccgaacgttgtaaacg

SEQ ID NO: 192439 - DNA, 984 bp, Homo sapiens
  misc_feature: GYAE6OF01CWFVE.44.23.C01.1.454.CMB.1.raw
  modified_base (195)..(195): a, c, t, g, unknown or other
  misc_feature (195)..(195): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctccaggttcgagatgtgacatcgagatcgaccagtctccttccttctgtcttcttctgtggagcngcgtcacatctacttcggccgggcgtacgtcgtacgggtttcgttttcggtcgtcgttggttcgtccgtttacgggtttaaccgaaaacgggtaaaaacggggggacgtaacccgggtacccccgtttaaacgggttcccttccggttacccttaccggttaccggtaaacggtaaacccgagggtaaccggttaaggggaacggttaacggtacccggttcccccggttaccgtagggtttaccgaaggttccggacccgtacggttaccgggtacggggttcggggtaccggggtacccggtacgtacccctaacgttccgttaccctaacccgttaggttacggaccccggtacccgttcgggaccccggtaccttaagggtaaccgttacgtttacccgttaacggtacccttttaaaccgttttttacgttcccggttaacgttacccggtaagttacccggttaagtttacccttaacggtaacccggttttacgggttccccccggttaacccccggttttttacgtttaacccgggttttccgggggaaacccgggtttaaaccgggggtaaacccttaacgggtttaacccgggtaaacggttaaaacccgtttaaaccggaaaaacccgggttgggtttaaccgggtccgtaaccggtttaccgacccgtttaaaccggtacgttttcccgtttaccgggtttacccttccccgtttaaaccggttccccccgtttaccccggattaacccgtttcgggtacttttaaaccggttaacc

SEQ ID NO: 192440 - DNA, 222 bp, Homo sapiens; identical to SEQ ID NO: 192231
  misc_feature: GYAE6OF01EX1HO.44.23.C01.1.454.CMB.1.raw
  modified_base (220)..(222): a, c, t, g, unknown or other
  misc_feature (220)..(222): n is a, c, g, or t

SEQ ID NO: 192441 - DNA, 661 bp, Homo sapiens
  misc_feature: GYAE6OF01CIYHX.44.23.C01.1.454.CMB.1.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (454)..(454): a, c, t, g, unknown or other
  misc_feature (454)..(454): n is a, c, g, or t
  modified_base (606)..(606): a, c, t, g, unknown or other
  misc_feature (606)..(606): n is a, c, g, or t
tcagacagtatatacacgaccggtgctcgatttagtacacgtgattagggattgggggagtcgagaccctgtcaggggacagcatggacatgagggtccccgctcagcctcctggggctcctgcgtgctctggctcccaggttcgagatgtgacatcgagatgaccaagtctccttcctcctgtcttcttctgttggagcagcgtcaccatcacgttggccgggcagtcgaggttcgttttcggngctgtcgccgttaggttacaaacggaaaaggggnacggaccccttaaggtcctcgtctctcgagaaaccaggacgtaggaacgtcgacgtcccgtacgtaggtcagtcgccagtccgagggtgggtacgggaccggtagtaccctactctacgaacctagtacgcgaccgtggcggtcctaggaactcgttcgacgtaccttaactttnttccgtagtccgaagtaccgtattactacctagttaacggtcccgtaccccgttttgtaacgttttaccgggacggtaacgggacctaaggtaccgtaagggaaaattacccgaaagttccgtggtacgctacgtacccaacgtcgttaccngtttccaccgtatttaccccgtaccccggtacttagtaccgttgtaaaccttacg

SEQ ID NO: 192442 - DNA, 645 bp, Homo sapiens
  misc_feature: GYAE6OF01B9LOZ.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (633)..(633): a, c, t, g, unknown or other
  misc_feature (633)..(633): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacaatcgagatgacccagtctccttccttcctgtcttcttctgttggagcagcgtcaccatcacgtgccgggcagtcgaggttcgtttcggngctgtcgcttggttacaaacgaaaaggggnacggaccctaaggtcctcgtctcgtacgtacaacgagacgtaggaagtacgcgtcccgtcgaggttcagtgacctagtccgagggtcggtcggaccgtagtccacgtctacgactaacgttacgccgtaccgtggccggactggaacgtattccgtagtaccttaaacgtttgtttcgtacgtacgtaagtactaagttactacggttaacgttaccggttccgtacccccgttttagtaccggtttttccgggaaccgggtacggggtaaaccacggtaacgtaaggaaaaccttacgaaaacgtcgtaggtcggaacctgacctacctagtcttcggtacttcacttccgtcccgacttntactataagtac

SEQ ID NO: 192443 - DNA, 991 bp, Homo sapiens
  misc_feature: GYAE6OF01E10WD.44.23.C01.1.454.CMB.1.raw
tcagacagtatatacacgaccggtgctcgatttagtacacgtgattagggattggggatgctttctgagagtcaaggacctcctgtgcaagaacatagaagcaccttgttggttttttcctcctgctggtggcagcctccagagttgggtcctgtcccaggtgcagctgcgaggcgtccgggacccagggactgggtgacggtcccgtttaccgggaacccttggttcctctcgactcgtcgacctacgttgttacctcgtaggtacgttttccagttcctagttcctagtattcgtagtttcggttgggtactacggacgtcccggacgacccggccccggaagggggaacggtaaggtgggaggttggtaaggttcggtagacctaccgttacgtaacgttaacgttaacgggtcgggaaccgttaaccgttacccgttacgttccccgttaccgttaccccgtaacgtaacggtaccgttaccgtacgttaccgttaacccgttaaggtttaaccgggtaaaccggggttaacccttaaccggtaaccccgttaacggttaacccgtaaccccgttacccgttttacccggttaacccccgttaacgttaaacccgttaccccggttaaccccgtttacccggtttacccggaccccgggtaacccccggaaccgggttaacccggttacccgggttttacccgtttttaaccgtttccggtacgggtttaccggtacccggggtaacgggtccggttaacgggttacccgtttacgggttttacctttaaaccgtttacggttaacggttacccggggttaccggggacccggtttacccgggtcccgttaaacccgggttcggttaccccggtttaacccgtttacgtttccccgtttacccggttaccgtacccggttaccccggtttaacccccgaaacccgggttaaccccggtaaccccgttacccggtttacccccccggg

SEQ ID NO: 192444 - DNA, 840 bp, Homo sapiens
  misc_feature: GYAE6OF01ERLFS.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggtactgggtgacggtccttcgggaaccctgtctctcatctgctactgtctcgtggtacgtttccattctacgttctgtaacttctacgttcggttggggtctgggtacgtcccggtcgaaccggtcccccggaagggggtaaggggaagtaggggtacggtagggtaggtttagggtcgtaacgtacgttaccgtaagtttacgtacggtcggggtacgtaaccgttaccgttaaccgttcccgttacccggttacccctacggtaaacggtacgttccgtaccttaacctaacccggtttaacgtttaccgggaaccggggtacctaaccggtaccgtaacgtaaccggtaacccgtcccgttttacccgtacccgtaacgtaaaccgttccggtaacccccgtaccgggttaccgaccccggtacccgggaccgggtaacccgtaccgggtttcccgttttacgtttccggttggtcggtaccgggacggtacgtacgtaccgtttaggttcctttacgacgttacgtacggggtccgggtccggtcggtacccgtaccggttaccgggtaccttcggttcctttcccgtcccgttacgtacccgttccttaaccccggaacccggtaacccggttccccgtaaccggtttcccccggg

SEQ ID NO: 192445 - DNA, 765 bp, Homo sapiens
  misc_feature: GYAE6OF01BPUCE.44.23.C01.1.454.CMB.1.raw
  modified_base (747)..(747): a, c, t, g, unknown or other
  misc_feature (747)..(747): n is a, c, g, or t
tcagacagtatatacacgaccggtgctcgatttagtacacgtgattagggattgggggagtcagaccctgtcaggggacagcatggacatgagggtccccgctcagctcctggggcctcctgctgctctggcctcccgaggttcgagatgtgacatcgagatacgacctaagtctcccttccttcctcgtcttcttcgtgttggagtcagcgtcaccatcacttcggcggacgtagtcgtacggttcgtttgcgtcttggtcgtccgttaggtttaacgaaaacggaaaaagggggtcgaaccggtaccccgttaaggtccgttaccggtcttaccgttacggtaaccgtaaacccaggtaaccgtagggaaggtacgtaccggtccccgtacgaggttacaggtcgaccgtcgtaccggagggttcgggtacgggccggtacgtacccacgtccgtactaaccgtacgttaacggacccgtacgttcgggaccggttaccgtagggaaaccgttacgtttaccgtacggtaacctttaaaccgttttagttttccgtaacgtccgtaacggtacgtagttactaccgttaaagtaccggtcccggttacccgtttacgttacggtttacgggaccggtaaggtaaccgacgtacgtaaacgtaaactacggaaaaccgtgtggtacgacgtcggaaccagttaccgtactcggttaccttactacccgttacccgttcccgacttntacgtacttaaggtaacc

SEQ ID NO: 192446 - DNA, 838 bp, Homo sapiens
  misc_feature: GYAE6OF01BEOF6.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttctgtcttcttctgttggaggcagcgtcaccatcacgttgccggcgagtcgaggttcgtttcggtgtcgtggttcgccgttaggttttaccaaaaggtaaaaaagggggctacggaccccgttaagggtcccttcggtctaccgttacggtaacgtaaacctaggtaccgtagggtaacggtacgtaacggtccccgttaaccgagggtttacaacggtcgaccgaacggttcccgaaggggttcgggtaccgggggacccggttaacggtcccaacgttccgtaaccacccgtaaagtttaaccggacccggtaaccgtcgggtaccggtaaccgttaaggaaacggttaactttacccgtaggtaacccttaaaccgtttttaatttcgtacgtaacgtaacggtaacttaaggttaacttaacgtaaacgttaccgtttaccggtacccccgttttaacgttaacggttttcccggaaccgggtaaacgggggtaaacctaacgtaacccggtttaagggaaaaaccttaccgaaaaaccggtaacgttgggtaacggtcgacccgttaagaacccgttaagttcccgtaggtttaaccctacgtaacccgtttaccgtttcccccgaaagttacgttaaccctaggttacttaaacg

SEQ ID NO: 192447 - DNA, 875 bp, Homo sapiens
  misc_feature: GYAE6OF01DNS9E.44.23.C01.1.454.CMB.1.raw
tcagacagtatatacacgaccggtgctcgatttagtacacgtgattagggagttgggggagtcagaccctgtcgaggggacagcatggacatggacgggtccccgctcagcctccgtggggcctcctgctgctctggcctccgaggttcgagtatgtagactagtcgagtactcgacccgtagttcccttccttcctttcgtcgttctttctttcgtggttcggacgtcgacggtcctaccgaacctcgtaccgtacggttccggcccgggtcgttaggttaccgttacgggttttccggttttcggtgtccgtttacggtttccggtaccgtttaaggttaaaccggaaaaaccggggtaaaaacgggggctaacccgggtaaccccggtttacggttcccttcgttcccgttaccggtacggtaaaccgtaaaccgtacgggtaaccggtaagggtaacggtacccggttaacccggttcccccggttaaggttaaccggttacgaaccgggtttccgccggttaacggtccggtaggggttaccggccggggtacctaccgtcctactcgtaccaacgtaggttccgaaccggtaccgtggaccgtacgttaagtacgttcttacgcgtaaaccttcgtttacgtctagtacgctaagttagtaacctcgtacgttccgttacccgttccgtttacgttaccggtacggacgggttacgaaccgtacggtaacgttaacggaaacctttaacggaacgtcgggttacgtcggtacctaccgggaacctacggttcgttccgttacgtttcccttaaaccgtcccgtttaccccgtacgtacccgtttagtacgtttaactaaacggtttccg

SEQ ID NO: 192448 - DNA, 1199 bp, Homo sapiens
  misc_feature: GYAE6OF01C9ZJK.44.23.C01.1.454.CMB.1.raw
tcagacagtatatacacgaccggtgctcgatttagtacacgtgattagggtagttgggggagtcgagacccgtgtcagggacacgcgatcggacatgaggtccccgctcgagctccgtgggcctccgtgctagctctggacctccgaggtcgtagatgtgactagttcgagtagtacgtaacctaaagttccttcccttcctttccgttcgttaccgttttccgtttccgttacgggtttgggacgggtacgaacgggtccgggttaccgaacctacgttccgtaaccggtttccggggaccccgggtacggtaaacgttccgtaacgggtttccggtttttacgggtcggaccgttagggtttccggtcccgtttaaggggttttacccgaaaaaaaccgggtaaaaaaggggggtaccgtaaccgggtaacccccggtttaaaacgggttcccttacggtacctttaacgttaccggttaaccggtaaaaccccgtaacggtaacccgttaaggggtaaaaccgggttacgggtaacccgggttaacccccggttaccggttaaacggggtttacccgaaagggttttacccggtaaaccccgggtaacccgggtttaaaccccgggtaagggggttttacccggggttaaaacccgggggtaccccgggttaaaccggttaacccccgttaaacccggttacccgttaaaccccggtaaaaaccgttttaaacggtttaccggtaccccgggtaaaccccggtttcggggtaacccccggggttaaccgttaaacggggtaaaaaccggttaccgttttaacccggttaaccggaaacccctttaaaaaccgttttttacgtttaccccgttaacgggtttaaccgtaaaaccggttaacgttaaccggtttaaaccgtaacggtaaacggtttaaaccgggtccccggttaacccccgttttacgtttaacccgggtttttacgggaaccccggttaaaacggggtaacccctaaaacggttaacccggttaacggtaaaaaccgttaaacccggtaaaaaccggttaccggttaacgggttaccggggttaaccttacgggtaaacccgacccgttaaaacgttccgttaacggtttaacccttaacgttacccgtttaccccgttaaccccgaaccgtttatttaacccggtg

SEQ ID NO: 192449 - DNA, 835 bp, Homo sapiens
  misc_feature: GYAE6OF01ER6DB.44.23.C01.1.454.CMB.1.raw
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgactatcgagactacgacccagttccttccctttccttccgtcgttctttcctttcgttggtttaggaggtccagtccgttaccacctatctacgttggtcgggcgtagtcgtaggttcgttttcggntacgttcgttcgtccgtttaggttaaccgaaaacggtaaaaacggggggtcgaaccggtaccccgttaacgggtccttacggttacttaccgtacggttaacgaaaaccggtacggtaaccggttagggtaaacggtaccggacgttccccggtacgtacgtttacgaagttccgaccgtaggtacccggtgggttccgggtcggggaccggtacgttaccccgaaccttcccgtactaacccgaaaggtttacccggaccggttacccgtcgggcccgggttacctaaagggtacccgtaatttaccgtacggtaacctttaaccgtttagttttcccgtaggtaccaagtaccgtaagttactacgtagttaccgtacgttccccgttaacgttaccgtttcggaaccgggtacggacgtaaccgtcgttaaacggtaaactaacgtaaacggtacgtacgtcggtacgttaccgaacttaaccgtacctacgtttacgttccttaacgacccttttcccgtaaccccacgtttactaaccgtcttaaaggttaccc

SEQ ID NO: 192450 - DNA, 750 bp, Homo sapiens
  misc_feature: GYAE6OF01E2LHA.44.23.C01.1.454.CMB.1.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttcctcctgtcttcttctgttggaggcagcgtcaccatcacttgccggcgagtcaggttcgttttcggngctgttgccttggttacaaacgaaaagggggnacggcccctaaggtcctcgtctcgtcgtagaaacccagacgtggaaggtgacgtcccgtcgaggttcagtcgcctagtccgagggtggtcgggccggagtcccacgtccgtacaaccgtattacgccgtaacccgttgggcccggtcccttagggaaacgtactttccgacgtacccttaaaccttttacttttcccgtaggttacctaacggtacgttaaacggttacttaccgtaaacgtttaccggttcccgttaccccccggttttacttacccggttttttcggggaaccccgggtaaccgggggtaaacccctaaacgggtacccgttaaacgggtaaaacctaacccggtaaaaccggtaacggttcgggtaccgggtccttacgacccgtacccgtacgttcccgttacgttccctttacgtaccgtttaccccgttccccgtacctacctttccgtagtaagtttaaac

SEQ ID NO: 192451 - DNA, 226 bp, Homo sapiens
  misc_feature: GYAE6OF01EGJ2R.44.23.C01.1.454.CMB.1.raw
  modified_base (220)..(226): a, c, t, g, unknown or other
  misc_feature (220)..(226): n is a, c, g, or t
tcagacagtatatacacgaccggtgctcgatttagtacacgtgattagggattggggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnnn

SEQ ID NO: 192452 - DNA, 1008 bp, Homo sapiens
  misc_feature: GYAE6OF01BIEEK.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatcgacccagtctcccttccttcctgtcttcttctgttggaggcagcgtcaccatcacgttcggccgggcgtaggtcgtacgggtttcggttttcgggtgtcgttggttcgtccgtttacgggttttaaccgaaaacgggtaaaaaacggggggtacggaaccgggtaccccccgttaaacgggttcccgtttccggttaccttccgttaccggtaaccggaaaacccgtaggtaaccggttaggggtaacgggttacggtacccggttaccccggtacccgttaacgggtttaccgtaaggtaccgtccgtaacggttccccggtaggggttccggggtacggggcccggtaccggttcccaacccgttccctaccgaaccccgttagttaccggaccccggtacccgtcgggaccccggtaccgtacggtaaacggttacctttccggtaccggtaaccctttaaccgttttaactttttcccgggttaacttacccggtaaaggtacccgttaacggtttaacttaccggttaaacgtttacccgggtttacccgtttaccccccgggttttaccttttaacccggggtttttacccgggtacccgggttaaaacccgggggtaacccgttaaaccgggttaccgttaaaacggggaaaacctttaaacccggaaaaccggtttaaccgggttcccggggttacggtaacccggttacccggtaaccccgttaaccctttaccgtttacccggtttacccgttttcctttaacccgttcccgttttaccccccggtttacccccgtaaccgtttacctttacccggttaaaccgtttaaatttaccccg

SEQ ID NO: 192453 - DNA, 1066 bp, Homo sapiens
  misc_feature: GYAE6OF01DDDZC.44.23.C01.1.454.CMB.1.raw
tcagacagtatatacacgaccggtgctcgatttagtacacgtgattagggattgggggagtcagaccctgtcgaggggacagcatggacatgacgggtccccgctcagctccgtggggctcctgctgctctggcctcccgtaggttcgagatgtgacatcgagatacgaccctacgttccttccctttccctttccttcgtttccttttccgttttcgttcgggtttagggacggtaccgacggtccgttacccaaccctacttacccgtaacggtttccggggccccgggggtacggtacggttaccggttacggggttttccgggttttttcgggtcggttcggtttggtttccggtcccggtttaagggtttaaccgaaaaaacggggtaaaaaacgggggggtaccgtaacccgggtaaccccccgtttaacgggttcccttccggttaccgttaccggtaccggtaaaccggtaaaacccgaacggtaacggttaacggggtaaacgggttaccggtaacccggttacccccggttaaccggttaacgggttaccgacgggtttaccgaccccggttacgggtaaccggtaacggggggttcggggtacgggggtacccgggtaaccgtccccgttaaccgttacccggttaccctaaaacccggtttacggtttaaccggaccccggttaacccggttccggggtacccggttaccgtaaaagggtaaacgttaccgtttccggttaacgtaaccctttttaaaccggttttacgttttacgttacggttaccgtaacggtaaccgttaactttaacgtaccgttaacgtttacccggtccccggtttacccccgttttgtttaacccgggttttaccgggaccggggtaaccgggtaaccgtacgggttaaaccgtaaagggtaaaccttaaaccgttaaaccggtacgttcggtaccggacgtaccgtaccgtaacccgtagttacccttacggtttaccttacccgtacctttacccccgtccgtaacccttagtttacgtagttaactttaaaccg

SEQ ID NO: 192454 - DNA, 735 bp, Homo sapiens
  misc_feature: GYAE6OF01BCN8T.44.23.C01.1.454.CMB.1.raw
  modified_base (266)..(266): a, c, t, g, unknown or other
  misc_feature (266)..(266): n is a, c, g, or t
  modified_base (543)..(543): a, c, t, g, unknown or other
  misc_feature (543)..(543): n is a, c, g, or t
  modified_base (674)..(674): a, c, t, g, unknown or other
  misc_feature (674)..(674): n is a, c, g, or t
tcagacagtatatacacgaccggtgctcgatttagtacacgtgattagggattgggggagtcagaccctgtcaggggacagcatggacatgacgggtccccgctcagctccgtggggctcctgctgctctggcctccgaggttcgagatgtgacagtcgagatacgacccagttccttccttccttccttgttcttcttcgtgttggaggcagccgtacacctatctacgttcggccgggtgacgtcgtacgggtttcgtttcggngtcttggttcgtaccgtttagggttaaccgaaaacgggtaaaaaggggggcgtaaccggtaccccgttagggttcccttccggttcgtaccgttacgaacggtaaaccgtagtacggttagggtacggtacggtaaccggttcccgtaccggtaaggttacgcggtaccggacgtaccggtccggtagggggtccggtccgggggaccgtacgtccgtacgtcctacgacctaaggtcgccgacgtgacggctagattacgtctgtacttacgtttnctcggtctagtcgtaagttctaagtacgtacttcccggttcccttacggtttccttacgggacccgggttaacgggaccttaaggaccgtaagtaacgtaacaacggttatggacgtcaccgttcctacgnttcgttaccgtcttaccgcctttaaccttcccggactttaactcgggtaaataacttacgg

SEQ ID NO: 192455 - DNA, 733 bp, Homo sapiens
  misc_feature: GYAE6OF01AY0FH.44.23.C01.1.454.CMB.1.raw
  modified_base (237)..(237): a, c, t, g, unknown or other
  misc_feature (237)..(237): n is a, c, g, or t
tcagacagtatatacacgaccggtgctcgatttagtacacgtgattagggattgggggagtcagaccctgtcaggggacagcatggacatgaggtccccgctcagctcctggggctcctgctgctctggctcccaggttcgagatgtgaacatcgagatcgaccctagttccttactttccttccttgttcttctttcgtggttggagcagcgtacaccatctacgttcggccgggnacgtcgtacggtttcggttttcgtgtcttggttcgtccgttaggtttaaccgaaacggtaaaaaggggggacgaccggtaccccgttaaggttcccgttaccgtcttccgtacgttacgaaaccgagtacggtagggtaacgggtacgtaccggttcccggtaccgtacggttacgacgtcggcctacgtccggtagggtcgggtcggggccggacgttccgtaccgtctacacgtacttacgccgtaccgttggaccggtccgtaagtacggttacttccgtacgttacctaacttttacgtttctcgtacgtacgacttaagttacttactaacgtaccgttccgttacccgttacgttacgtttcgggaccgtacggaacctaggaccgttaaggaacttacgaacgtagtacggtggacgtcgctaccgtcgttgtacgttccgtttacctcctttacccgtaccccgattacccgtacgttatgtttaacg

SEQ ID NO: 192456 - DNA, 902 bp, Homo sapiens
  misc_feature: GYAE6OF01EUQ16.44.23.C01.1.454.CMB.1.raw
  modified_base (269)..(269): a, c, t, g, unknown or other
  misc_feature (269)..(269): n is a, c, g, or t
tcagacagtatatacacgaccggtgctcgatttagtacacgtgattagggattgggggagtcagaccctgtcaggggacagcatggacatgacgggtccccgctcagctccgtggggcctcctgctgctctcggcctcccgaggttcgagtatggtagactagtacgagaactcgaacctaacgttcccttccctttccttccgttcgttcctttcttcgtaggttggacgacgtacgccgtaccaaccatccgtacgtcgggccgggngtaacgtcggtacgggtttccggtttcggtcgtcgttcggttcgtccgttaggttaaccgaaaacgggtaaacgggggccgaacccggtaccccgtaacggttccctaccggttcctaccgtacggtaaccgaacccgtaggtaaccggtacgggtaaacggttaccggtacccggtacccgtaccggtaggttacctacgtaccgaccggtacggacgtagggggtcgggtacggtaccggccgtaccctacgtccgtactaccgtacgtacgaccgtcccggacggaccgtaccgtaaggtacttaccgtttacgaccgttaacctttaacgtttcttacccgtagtaccgtaaccggtattaacggttactacgtaaccgtttccggtacccccggtaccgttttacggtaccggggttccgaaacgggttacccggtaacgtaacccggttacgggtaaacgttaaacccggtaacccgggtaacgggtaacgtttccgggaacgtttccccgaaacgtacccgtttaacccgtccgttttaccgggtacccttttcccgtaaaccgtttcccccggtttaccccgtacccggttaaccttagggtttaaccgttactaaaccgtttcg

SEQ ID NO: 192457 - DNA, 787 bp, Homo sapiens
  misc_feature: GYAE6OF01AH2JB.44.23.C01.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtcctccttccttcctgtcttcttctgttggacggcagcgtcacntcacttggccggngagtcagggttcgtttttcggngtcgtgttcgtccgttggtttaacgaaacggtaaaagggggcgaaccggtaccccgtaaggtccgttcgtcttcctacggtacgaaacccgaggtacggtagggtaacggtacggtaccggttaccccggttacggtacggtttaccgtacggtcgacccgtacgtccggtagggggttcgggtccgggggtacccggacggtaccctaccgttaccctaccgtaacctagtttaaccggacccgggtacccgtcggacccgggtccttaggtaacgttactttccgtacgtaccctttaacgttttacgtttccgttacgtacaacggtccttaagttacgttacgttacgttccggttacccgttccccgtttacgtttaccggtttcgggaaccggttcggggaaaccacgtacggttaacgtaaacgttaaccgaaacggtacggttgggacgtccgtacgaccgtaccttagttcgttacggttccttaccgtccctttacccggtccccagttaccttacgtacgttatttaaccg

SEQ ID NO: 192458 - DNA, 238 bp, Homo sapiens
  misc_feature: GYAE6OF01CMMIR.44.23.C01.1.454.CMB.1.raw
  modified_base (217)..(238): a, c, t, g, unknown or other
  misc_feature (217)..(238): n is a, c, g, or t
tcagacagtatatacacgaccggtgctcgatttagtacacgtgatttagggagttgggggaagaggaagactgacggtcctcccaggagttcaggtgctgggcaccttgggcacggggagtgtgtcacaagatttgggctctgggcacagcggccctgggctgcctggtcaaggctacttctatatactgtctgagcgggctggcaaggcgcatagnnnnnnnnnnnnnnnnnnnnnn

SEQ ID NO: 192459 - DNA, 766 bp, Homo sapiens
  misc_feature: GYAE6OF01DTCDB.44.23.C01.1.454.CMB.1.raw
  modified_base (605)..(605): a, c, t, g, unknown or other
  misc_feature (605)..(605): n is a, c, g, or t
  modified_base (690)..(690): a, c, t, g, unknown or other
  misc_feature (690)..(690): n is a, c, g, or t
  modified_base (742)..(742): a, c, t, g, unknown or other
  misc_feature (742)..(742): n is a, c, g, or t
  modified_base (755)..(755): a, c, t, g, unknown or other
  misc_feature (755)..(755): n is a, c, g, or t
tcagacagtatatacacgaccggtgctcgatttagtacacgtgattagggattgggggagtcagaccctgtcgaggggacagcagtggacagtgacgggtccccgctcagcctccgtggggctcctgctgctctggtcctccgaggttcgagatgtagaccagtcgagataccgacccagttccttcccttccttcttgttctttctcgtaggttggagtcaggacctcaccctatccgtacggttccgggaccggtagtaacgttcggtacggtttcggtttcggacgtcgtttcggttaccggtctttaggtaaaccgaaaagggaaaacggggcgtaccggtaacccggttaggtcctccgttactcggtacgtaacgaaccgtaggtaagtacgggtaaggtacgtcggtaccccgtagtacggtctaagcgtacgtgacgggtgggttaggccggggtaccgactcccgtaatacccgtactacccggtaagtacgtaccggtccgtacgggacgtccttaaagggtaacgtccgttagtaccgtaaaccgttttaaccgtttagtttacccgtaggtacccgtaaggaacctaacgttntaacggttaacgttcgtaccccggttaccttcggtacgttcgggacccgtaacggaactacccgtaaggtaaacacgaataaacncggatcggcaggccaacttcctaagtcttactaccgttcgtaccgttacccnggttattacggtntaagttaaccc

SEQ ID NO: 192460 - DNA, 697 bp, Homo sapiens
  misc_feature: GYAE6OF01ELAAJ.44.23.C01.1.454.CMB.1.raw
  modified_base (243)..(243): a, c, t, g, unknown or other
  misc_feature (243)..(243): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatgacccagtctccttccttcctgtcttcttctgttgagcagcgtcaccatcacttggccggcgtagtctaggttcgttttcggngtcttgtgtccgttaggttaaacgaaaaaaggggcgaccggaccctaaggtcctcgtctctacgagaaccagacgtaggaagtacgacgtcccgtcgtacggttacagttcgaccgacgtccgtagggtcgggtcgggccggtacgtccgtacgtcctaccacgtacgttacgccgaccgtcgaccggtccgtagaactacgttacgtacgtaccttaactttactttcttacgtcgtacgtacctagtactacgaacgttacgtccgtaccccgtttcttaccggttttcggaaccggtacggggtaacctaaggtacgtaagggtaaactaaccgaaacgtagtacggtcggtcctacggtacccaaccgttattccggtttacgttacttcccgtaccgtttaccccgttacccccgtaccttacgttacttacgttaagttaacttacgg

SEQ ID NO: 192461 - DNA, 718 bp, Homo sapiens
  misc_feature: GYAE6OF01B7T8N.44.23.C01.1.454.CMB.1.raw
  modified_base (232)..(232): a, c, t, g, unknown or other
  misc_feature (232)..(232): n is a, c, g, or t
  modified_base (454)..(454): a, c, t, g, unknown or other
  misc_feature (454)..(454): n is a, c, g, or t
tcagacagtatatacacgaccggtgctcgatttagtacacgtgattagggattgggggagtcagaccctgtcaggggacagcatggacatgacgggtccccgctcagctccgtggggctcctgctgctctggcctcccgaggttcgagatgtgacatcggagatacgaccctagtcctcctttccttcctgttccttcttcgtgttggagtcagctcacatcacgtgccggnagtctaggttcgtttcggtgcttggttcgtaccgttaggttaacgaaaacggaaaaaagggggtctaaccggtacccgtaaaggtccttcgtcctcgtacgtacgaaacagtacgtaggaagtacgacgttaccgacgtaggtacagtcgaccgtcgtaccgagggtggtacgggcgacgtccacgtccacgactagtacgcacgtgcgtacgtagaacgtntacgtacgtacttaactttacgttctacggtaacgaacgtagtaacgttaatctaacgttaccggtaccgttaccccggtttacgttaacgtttccgggaaccggaaccggggttaaccaaaggtaacggttaacggtaaaacgtaaccgtaaaacgttactacgggttacggtaacctacggtaaccaaaccgttacttaccgttagttccttacgtaacccttacccgttacccgacttaacgttacgtaagtacttaaacg

SEQ ID NO: 192462 - DNA, 750 bp, Homo sapiens
  misc_feature: GYAE6OF01B02RV.44.23.C01.1.454.CMB.1.raw
  modified_base (263)..(263): a, c, t, g, unknown or other
  misc_feature (263)..(263): n is a, c, g, or t
tcagacagtatatacacgaccggtgctcgatttagtacacgtgattagggagttggggagtcagaccctgtcaggggacagcatggacatgagggtccccgctcagctccgtggggctcctgctgctctggcctcccgaggttcgagatgtgacagtcgagatcgaccctagtccttccctttccttcctgttctttcttctggttggaggtcagcgtcaccatcacgttcggccgggcgtagtcgtaggttccgttttcggngtcgttgttcgtcgtttaggttaacgaaaacggaaaaagggggctaacggaccccgttaagggtcccttcggtaccttcgtaccgtaacgaaaccgaggtacgtagggtaacggtacgaccgttacccgtacgtaggttacgagttccgaccgtacggtaccggagggttgggtaccggggccgtacgtccgactcgtacacgtagttacgccgtaccgtggccggtactaggacgttcttcgtacgtaactttaacgttttcttcgttacgtactacggtacttaagttactgttaacgttccgttcccgtaccccgttttagtaccggtttaccggaaccgggaacgggtaaccctaagggtccctaaaaggttaaacctaaccggtaaacgtacgttgggaccgttcgtaccgacctacgttagttccgttacgttcctacgttacttccccggtacccattaacccgtttgaattacgttaac

SEQ ID NO: 192463 - DNA, 772 bp, Homo sapiens
  misc_feature: GYAE6OF01BVYFO.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccaccctgtctgcatctgtaggagacagagtcaccatcacgtgccggcagtcagagtattagtgttgtgctgtatcagacaacgaacgagggaaaccacccctaaactcctagactactaataacggctaattcgttaaggtttagggaaacggttcggggtaccctacgttacgtaaggttcacggcggactaggtagggattcggtacgggaacaaggtaacttccggtaccttactaccgtaaccctagttaccgacgcccgtaacgtcccgtacggtacccgtacggtacccgtacggtaacgtttacgggtttacttttaccgggtaccttaaaccttttaacgtttaaccgtacgtaacccttaaacgttaaacgtttaaagtttaaacgttttacgggttttttaccgggtaacgggttacccgggttttaaccggaaccggtttaaacgggggtaaccgttaaaggggttaaccgggtaaacgttaaaccggaaaaacggttaccggttagggttacgggtaccgttacggaccctaaacgttacgttcgtttacggttaccttacgttacccgtttcccgttacccccg

SEQ ID NO: 192464 - DNA, 510 bp, Homo sapiens
  misc_feature: GYAE6OF01BTK7P.44.23.C01.1.454.CMB.1.raw
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (467)..(481): a, c, t, g, unknown or other
  misc_feature (467)..(481): n is a, c, g, or t
  modified_base (483)..(486): a, c, t, g, unknown or other
  misc_feature (483)..(486): n is a, c, g, or t
  modified_base (488)..(510): a, c, t, g, unknown or other
  misc_feature (488)..(510): n is a, c, g, or t
tcagacagtatatacacgaccggtgctcgatttagtacacgtgattagggattgggagtatctattatagtgggagcacctactaacaacccgtccctcaagagtcgagtcaccatatcagtagacacgtccaagaaccagttctccctgaagctgagctctgtgaccgccgcggacacggccgtgtattactgtgcgagagtaggntagttcgtcaccaactactttgaccacgtcggggccacgggaaccctggtccaccgtcctcctcncgcctccaccgacggccaccccttcggtccttcccccgtggcccacccctcctcccaacgacgccacctcggtgggggccacgacggccggcccgtcgggctcgtccgtggtacgaacggactaccgttccacgtcctacgtcgactggacggcgggtccgtacgggacgaagggcgtcgagtacgancgangcnnnnnnnnnnnnnnngnnnntnnnnnnnnnnnnnnnnnnnnnnn

SEQ ID NO: 192465 - DNA, 869 bp, Homo sapiens
  misc_feature: GYAE6OF01B1SWN.44.23.C01.1.454.CMB.1.raw
  modified_base (170)..(170): a, c, t, g, unknown or other
  misc_feature (170)..(170): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggcctccgaggttcgagatgtgacatcgagactacgacccngttccttcccttccttcctgttctttcctttctggttgggacggcagtccgtaccaccactccgtacttcggccgggngtacggtcgtagggtttccgttttcggngtcgttggttcgccgttacggtttaacgaaacgggtaaaaacgggggacggtaaccggtaccccggttaacggttcccgttaccgttccgttaccgtacggtaaccggaaaccgtacggtaaccggttaaggggtaacggttaacggtacccggttccccggtaaccggtacgggttaccgtacggtccggtaccccgtacgggttaccggtaggggtttcgggggtaccgggggacccggtacgtaccccgttacgttacccgtacccgtaacccgttacggttaacccggccggtaacccgtcgggtaccccggtaccggtaacggaacgttcgtttaccgtaccgttacgtttaactttcgtttcttacgtacgtagacgtaacttagtaccgttaagtccccgtttaccgttacccgtttacgtttaccggtttccgggacggtaacgggtaaccgttaacgaccgttaaagtaaccgtaacgtaaacggtacgttcggtacggtacctcggaccctaaccgtttcgttaccttacgttcttcccgtaaccgttcccgttcccctactatttccctggtaaccttaacg

SEQ ID NO: 192466 - DNA, 892 bp, Homo sapiens
  misc_feature: GYAE6OF01B9ENX.44.23.C01.1.454.CMB.1.raw
  modified_base (876)..(876): a, c, t, g, unknown or other
  misc_feature (876)..(876): n is a, c, g, or t
tcagacagtatatacacgaccggtgctcgatttagtacacgtgattagggagttgggggagtcagaccctgtcgaggggacagcatggacatggacgggtccccgctcgagcctccgtggggcctccgtgctgctcgtcggtcctccgtaggttcgagtagtgtacgactagtcgagtactccgaccctcgttccttccttccttcctcgttctttcgttcgtggttcggacgtcgacgtccgtaccaccgtactcgtacggttcgggacccgggaggtaacgttcggttacgggttttccggttttcggtcggttcgtttacggttcggttaccggtttacggttaaaccggaaaaacggggtaaaacgggggtccgtaacccggtacccggttaaccggtccttaccggtcgttacccggtaacggtaaccggtaaaccgtacgggtaacgttaacgggtaacggtaccgtacccggttcccggttaaccggtacggttaccgtacggtaccgtacccggtacggtccggggttacggggtcgggtaccgggtacccggtacctacccgtacccgttccgtaaaccgtacgtaacggttaccggacccgtacggtccgggtacgtacccgtaagtaacgttacttcccggtaacttaacttttaaccgtttcgttcgtacggtacgttaagtacctttaaaggtacccttcggttaacggttaccccggttccccttaaccggttttacggtccggttaccgggaaccccggtaggaacctacggtaaccgtaagaccgttaacgaaccgtaggtcggacgtaccacgtaacctgtacctcttacgttcccagttcccctacgtcccgaattancgttaaacttagtacg

SEQ ID NO: 192467 - DNA, 862 bp, Homo sapiens
  misc_feature: GYAE6OF01EJ6AZ.44.23.C01.1.454.CMB.1.raw
  modified_base (250)..(250): a, c, t, g, unknown or other
  misc_feature (250)..(250): n is a, c, g, or t
tcagacagtatatacacgaccggtgctcgatttagtacacgtgattagggattgggggagtcagaccctgtcaggggacagcatggacatgagggtcccgctcagctcctggggctcctgcctgctctggctcccaggttcgagatgtgacatcgagatcgacccagtcctccttccttcctcgtctttcttctagttggagcagcgtccacgatcacttggccgggcgagtcagggttccgttttcggngacttgttcgtcccgttggtttaccaaacggtaaaaaacggggggtcgtacgggtaccccgttaaacggtccttaccggttcctccgtacggtaacgtaaaacccgaggtaaccgtagggaaacggggtacggtaaccgtccccggttaccgtaacgggtttcaagtcggtcccgtaaaggttcccggtaaggggttcgggtcgggggaccggtaacggttccctaaaccgttccggtaacctaacccgtaacgttaacggtacccggtaaacccgtcggtacccggacccgtttaaaggaaacggttaccgttttaccgtcggtaaacccttaacggttttaacttttcccggtagtttaacccgacggtacctaaaggtttaacgtacccgtaagttaccggttacccgtacccccgtttacgttaaccggtttttccgggacccggtaaccgggggtaacctaacggtcccgtaaagggtaaaccttaccggaaaacgtaacggtccgttaggccgttacgccctaaacgtcttaccggttagtttaccgttaccgtaacgttcccctttaaccccggtcaaactttccggttaagaattttaaaccgg

SEQ ID NO: 192468 - DNA, 504 bp, Homo sapiens
  misc_feature: GYAE6OF01D5W5R.44.23.C01.1.454.CMB.1.raw
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (464)..(466): a, c, t, g, unknown or other
  misc_feature (464)..(466): n is a, c, g, or t
  modified_base (468)..(469): a, c, t, g, unknown or other
  misc_feature (468)..(469): n is a, c, g, or t
  modified_base (471)..(472): a, c, t, g, unknown or other
  misc_feature (471)..(472): n is a, c, g, or t
  modified_base (476)..(504): a, c, t, g, unknown or other
  misc_feature (476)..(504): n is a, c, g, or t
tcagacagtatatacacgaccggtgctcgatttagtacacgtgattagggattgggggaagtcagccataatggaagcaccagctataaaccccgtccctcaagagtcgactcaccatctccgtcgacacgtccaagagacagatgtccctgagtctgacgtctgtgaccgccgcggacgcggctgtgtatttctgtgcgagacggccctggtaccaggcgagtggtaccctctactactactctcgtggacgtcgtggggccgaggggccgcggtccaccgtctccncncncctccaccaacggcccatccgtccttccccngccncctcctccagcgcacctcgngggcacgcgcggccgtggctcgtcgtcggtacgaacgtacttaccttccgtacgactcgtcgtcgtcggacgggccgggtctacgggaccgtaagggccgacgtagtacgntnactnnntnngnntcgnnnnnnnnnnnnnnnnnnnnnnnnnnnnn

SEQ ID NO: 192469 - DNA, 856 bp, Homo sapiens
  misc_feature: GYAE6OF01EBM1J.44.23.C01.1.454.CMB.1.raw
  modified_base (361)..(361): a, c, t, g, unknown or other
  misc_feature (361)..(361): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccgaggttcgagatgtgacatcgagactcgaccctagtccttcccttccttcctgttcctttctttcgttggttcggaggtcaggccgtaccacctattccacgttcggccgggcgtacgtccgtacgggtttcggttttcggcgtcgttgtacgtccgttaggttacgaaaacgggaaaagggggcaccggtacccttaggtcctccgtctctacgtaacgtaacnggacgtagggtaaggtacgtaccggtcccgtacgtaggttacaggtacgcccgtaggtccggtagggtcgggtaccggggcgtaacgtcccacttacccgtaccgaaccgttagttacccggacccgtacccgtacgggtccccggtcgttaaacggaacgtttacgttcccgttaggttaaccccttttaacggtttttaccctttttacggtacgggttaacctacgtaacgttaacggttactttaacccgggttaacgttaccggtttcccccgggtttaaccccccggtttagttttacccggttttacccgggggaaccgggtaaccgggtaaaccgaccgggttaaacgtacggtaaaaccgtaacccgaaacggtacgttcggacggttcgacctacccgtaacgtccttttaggcccgttacctttacccgtcctttaccccccgttcccgcccgtttaagtttccggttaactaacgtttaaacg

SEQ ID NO: 192470 - DNA, 571 bp, Homo sapiens
  misc_feature: GYAE6OF01CUC9I.44.23.C01.1.454.CMB.1.raw
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (530)..(538): a, c, t, g, unknown or other
  misc_feature (530)..(538): n is a, c, g, or t
  modified_base (540)..(541): a, c, t, g, unknown or other
  misc_feature (540)..(541): n is a, c, g, or t
  modified_base (543)..(544): a, c, t, g, unknown or other
  misc_feature (543)..(544): n is a, c, g, or t
  modified_base (546)..(552): a, c, t, g, unknown or other
  misc_feature (546)..(552): n is a, c, g, or t
  modified_base (554)..(571): a, c, t, g, unknown or other
  misc_feature (554)..(571): n is a, c, g, or t
tcagacagtatatacacgaccggtgctcgatttagtacacgtgattagggattggggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtaggagggacgggggggcaacgtggcctaccggaccccggtcggggccgacggggaccctcgggtccacccgtcctcctcacgccctccaaccgaacgggcccacgttccggtcccttccccccgtcggccctaccccctccgacctaacgcgcctacccgtcggtcggggaccacgacggcccggaccgtcgggctcgtccgtggtaccgaacgggtacctttacctaccgtaccgttctaccgcggtcgtacggcgggacggggtcgtaggggaccgtaagggccgtaacgtagtacggnagtcancgtnnnnnnnnncnncnncnnnnnnngnnnnnnnnnnnnnnnnnn

SEQ ID NO: 192471 - DNA, 838 bp, Homo sapiens
  misc_feature: GYAE6OF01BOIF0.44.23.C01.1.454.CMB.1.raw
  modified_base (551)..(551): a, c, t, g, unknown or other
  misc_feature (551)..(551): n is a, c, g, or t
tcagacagtatatacacgaccggtgctcgatttagtacacgtgattagggattgggggagtcagaccctgtcgaggggacagcatggacatggacgggtccccgctcagcctccgtggggctcctgctgctctggctccgtaggttcgagatgtgacatcggaagatacgacccgtacgttccttccctttccttcctcgttcctttcttcgttggttggacggcgtagtccgtaccacctactccgtacggttcgggcccgggtcgtaggttccgtacgggtttccggttttcggtgtcgttggttcgtaccgtttggttaaaccgaaaacgggaaaacgggggtacggacccggtaacccggttaacggtcccgttccgtccgttccgtaacggtaaccgaaacgacgtacggtacgggaacggtacgtaccggtcccgtacgtggtaccagtacgccgtacgtcggagggtcgggtcggggaccgacgtccgactcgtaccaacgttaacgtcggtccgacggtcgacccggtgtacgtagtacgttntacgtactttaacgtttcgttacgtcgtaacgtaccgtatacggtaactcggttaacgttcccggtcccgtttacccgttcgttacggttcccgggaaccggtaaccgggtaacgtacggtaaaccgggttaactaaaacggttaaccggtaacccggttaagtcccggggttacaccgtacccggtacctaacgttcccgtttcggttaaccggtttcccttacccgttaccggttcccccggttaaccctaccggttaacttccgttaagtttaacgttaaccgg

SEQ ID NO: 192472 - DNA, 746 bp, Homo sapiens
  misc_feature: GYAE6OF01D3524.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacagtcgagatgaccaagtccttccttccttcctgttcttcttctgttggagcagcgtcaccatcacgttcggccgggcgagtcgtaggttcggttttcggtgtcttgttcgccgttggtttacaaaacggaaaaagggggagacggtaccccgtaaggtcctcgtcctctacgtacgaaccaggtacgtagggaaggtacgacgtccccgtcgtacggttcagtcgccgtagtccgtagggtcgggtcggggaccggacgtcctactcctaccaacctacgttacgcccgtaccgtcggaccggtccgtaggaacgtcttcgtacgtaaccttaacttttatttaccgttgtacgacgtacgtaagtttactaccgtaagttccgtccccggtttccccgtttacgtttaccggttttaccgggaccgggtaacggggtaaaccgtaacggtacgttaacggtaaaacttaaccgtaaaaccgtacggttacgggtacgtaccgtaccgtaccctaccgttacgtttcgttaaccgtttccgttacttaccgttaccccgttccccgtacttcgtttactcggtttaacttaaacg

SEQ ID NO: 192473 - DNA, 242 bp, Homo sapiens
  misc_feature: GYAE6OF01CKXBK.44.23.C01.1.454.CMB.1.raw
  modified_base (138)..(138): a, c, t, g, unknown or other
  misc_feature (138)..(138): n is a, c, g, or t
  modified_base (156)..(156): a, c, t, g, unknown or other
  misc_feature (156)..(156): n is a, c, g, or t
  modified_base (220)..(220): a, c, t, g, unknown or other
  misc_feature (220)..(220): n is a, c, g, or t
  modified_base (226)..(242): a, c, t, g, unknown or other
  misc_feature (226)..(242): n is a, c, g, or t
tcagacagtatatacacgaccggtgctcgatttagtacacgtgattagggagttggggggaagaggaagactgacggtcctcccaggagttcaggtgcgtgggcaccgttgggcgacgggggaggtgtgtcacaagtntttgggctcgtgggcacngcggccctgggctgcctggtcaaggtctacttcgtgatcgcgtctgacggcggctggcagggcncaatgnnnnnnnnnnnnnnnnn

SEQ ID NO: 192474 - DNA, 935 bp, Homo sapiens
  misc_feature: GYAE6OF01CSM9A.44.23.C01.1.454.CMB.1.raw
  modified_base (217)..(217): a, c, t, g, unknown or other
  misc_feature (217)..(217): n is a, c, g, or t
  modified_base (282)..(282): a, c, t, g, unknown or other
  misc_feature (282)..(282): n is a, c, g, or t
tcagacagtatatacacgaccggtgctcgatttagtacacgtgattagggattgggggagtcagaccctgtcaggggacagcatggacatggacgggtccccgctcagcctccgtggggcctcctgcctgctcgtggcctccgaggttcgagtatgtcgacagtcgagatcgaccctagtcctccttcctcctgttcctttcttgtggttggacgcncggccgtccacctatccgtacgttcgggacccggtgacgttaccggacggtttccggttttcggnggtaccgttggttccgttacgtttaacggttaaccgaaacgggttaaaacgggggacgtacccgggttaacccgtttaacgggtcccgttccgttaccgtaccggtacggtaaaccggtaaacccgtaggtaaccggtacgggtaagggtaaccggtaccccgtttacccggtcccggtaagggtttacccgacgtttaccggacccgtaacggtcggtaaccgggggtcgggtaccggccggttaaccgaccgttacccgttaccgcgaaacccgtaggtttaccgaccggtacccgttacggaacccggtctacggaagttccgtttacaccggttaacttaccgtttacgtaccgttcgtaacgtactacgtagttaacgtctaacgggttaccgtcccgttacccgtttcggtaacccgttaccgggaacggtaccgggtaaacccgtacgggttaaccggttaacgaaacccgggttaaacggtaacccgtacgggttaccggtaaccggttcccgggttaacctaacccgaaaccgttccgttaaccgggtttacccttaccctttaaccccgttaacccccggttccggtaaaccccccgttttacgtacccggtttaattaaccccgggttaattttaaacccgg

SEQ ID NO: 192475 - DNA, 859 bp, Homo sapiens
  misc_feature: GYAE6OF01BAC1O.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcgagggttcgtttttcgggtgcttggttcgccgttaggtttacgaaaacggaaaaaggggggcgacgggtacccccgtaaggtcccttcggtctccgtcggtacgaaacccgagtacgtagggtaaggtacggacgttccccgtacgtacgggttcaaggtcggccgtaaggtcccgtaaggggttcggggtcggggacccggtaacgttccccgaacttccgtacctaaccgtaacgtttacggaccgtaaccccgttgggcccgggtaccctagggtaaacggttactttaccgttcgtaaccgttaaaccgtttttacgttttacccttaggttaccgtaacggtaccgtaacgtttaccgttacgttaaccgtttaccggttccccggttacccccgttttacggttacccggttttttacccggggacccggtaaaccggggggttaaccctaacgggttaccgttaaccgggtaaaaccgttaaccggtaaaaccggttaaccggttcgggtaccgggttaccgtacggtaccgtaaccccgtaacgtttccggttaccggtttccttaccgttaaccttcccgttacccccggaccttaacgtttaccgttagttaatttaaaccg

SEQ ID NO: 192476 - DNA, 753 bp, Homo sapiens
  misc_feature: GYAE6OF01CXVJT.44.23.C01.1.454.CMB.1.raw
  modified_base (661)..(661): a, c, t, g, unknown or other
  misc_feature (661)..(661): n is a, c, g, or t
tcagacagtatatacacgaccggtgctcgatttagtacacgtgattagggattgggggagtcagaccctgtcaggggacagcatggacatggagggtccccgctcagctccgtggggctcctgctgctctggcctccgaggttcagtatgtgacatcgagaactcgaccctagtcctccttccttcctgttcctttcttcgtggttgggacgcagtccgcaccattcgacgttcggaccgggtcgtacgtcgacgggttttcgtttcggagtccgttaggttccgtacgttaggttaaccgaaaaggaaaacggggcgacggtacccgttaacggtcctcgtctacgtacggacgaaactaggtacgtagggtaacgtacggtaccgtcccgtacgtaggttaccaggtccgaccgtacggtcggtagggtcgggtaccgggtacccggacgttacccctacgttaccgtacctaacgtacggtacgaacccggtcgtaccggccggttcctaaaggtacgtccttacgacgtacctttaaacttgttaccctgtaccgaacgtctaagttacacgttaacgtacgtcccgttacccgtaccgttacgggtttccgacggtacggaacgtacgtaccgtaagtaacctaacgtaaaccgtntaccgggtactaccgtaggtccacttacggtcgtttaacggtccttccggtacttacccgttccggtacccttaaggtcctaagttacgtac

SEQ ID NO: 192477 - DNA, 794 bp, Homo sapiens
  misc_feature: GYAE6OF01EOU7O.44.23.C01.1.454.CMB.1.raw
  modified_base (158)..(158): a, c, t, g, unknown or other
  misc_feature (158)..(158): n is a, c, g, or t
  modified_base (186)..(186): a, c, t, g, unknown or other
  misc_feature (186)..(186): n is a, c, g, or t
  modified_base (394)..(394): a, c, t, g, unknown or other
  misc_feature (394)..(394): n is a, c, g, or t
tcagacagtatatacacgaccggtgctcgatttagtacacgtgattagggattgggggagtcagaccctgtcgagggacagcagtggacagtggacgggtccccgctcacgcctccgtggggcctccgtgctcgctcgtgcctccgtaggttcgagtnttggtgactagtacgagtactccgaccngttccttcctttccttacgttcgttctttcttgtaggttggacggcacgccgtaccactctacgtcgttcgggccgggtacgtacgtcggttacggttttcgttcggtcgtcgtttcggtacgtcgtttaacggtaaacgaaacggggtaaaacgggcgtacccggttaccgtacgtccgttcgtctagtacgtaaacgaccgtaggnggtaacggaagtccgtaccggtccggtaacgtcgtaactcggcacggtacggtccgggagggtcggtccgggaacgtttccgtacctcgttacgtaacctaacttacggttacggtacccgtcggtaacgggccgttaactaagtaacgttcgttacgttaccgttaactttaacggtttactttacgttacgtacacggttaacgtacggttactaccggttaacgttccggtttacccgtttacccgttggtttaacccgggttacgggaaccggtaaccggtaacgtaacggacgttaacgtaaacgtaacgttaacgcggttcgacgtacgcctacgtacgtttctacgttcttccctacgttcccgttacctcgtactagtcttaagtacttacg

SEQ ID NO: 192478 - DNA, 877 bp, Homo sapiens
  misc_feature: GYAE6OF01BVW6G.44.23.C01.1.454.CMB.1.raw
  modified_base (736)..(736): a, c, t, g, unknown or other
  misc_feature (736)..(736): n is a, c, g, or t
  modified_base (863)..(863): a, c, t, g, unknown or other
  misc_feature (863)..(863): n is a, c, g, or t
tcagacagtatatacacgaccggtgctcgatttagtacacgtgattagggattgggggagtcagaccctgtcgaggggacagcatggacagtgacgggtccccccgctcagcctccgtggggcctcccgtgctgctcctggcctcccgtaggttcgagtatgtagatactcgagatccgacccacgttcccttccctttcccgttccttcgttcctttctttcgttggttacgggcggtccgtacggtcccgtacctaacccattccgtaaccggttccggggaccccggggcgtaaaccggttccggttaacggggtttttcccggtttttcgggcgttccggtttcgtttacccggtaccggttttaaacggggttaaaaaacggggaaaaaaaaccgggggtcggtaccccggttaaccccggtaacggttccccgtaccgttcgtaccgttaacgtaacgaaaccgtacggtaggtaagggtaacggtaacgtcccggttacccgtcggtacggttcgacggtctacccgtacgggttccggagggttcccgggggtaccgggaccggttcctacccgtacccgtacctacccggtaactacggtaccgtaacccgtacccgggttgacccccggtagttacgaaagttccgtaccgtacttaccttaaacggtttctttaccgcgtaagtctaggtacttacctatacggttccgtcccgttttaccccgnttttaaccgggtccggaacggtaaggtacccgtaagtccgtaaagtaacctaacggtacgtgtccgacttcgactaacccgttactccggtacttcgttcctcgtccttaccccgccgtacctagtnttactatcgttaac

SEQ ID NO: 192479 - DNA, 979 bp, Homo sapiens
  misc_feature: GYAE6OF01CUCS0.44.23.C01.1.454.CMB.1.raw
  modified_base (251)..(251): a, c, t, g, unknown or other
  misc_feature (251)..(251): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgaccagtctccttctcctgtcttctcgtgtggagcagcgtacacatcacgttcggcccgggtacgacgtcgtacggttccggttttcggngttcgtggttcgtccgttacggtttaaccgaaaacggtaaaaaaacggggggtacggtaccgggtacccccggttaaagggtaccccgttacggtaccgttaccgttaccggtaaccggtaaaacccgtaaggtaacccgttaaggggtaaccgggtaacggtaacccggtacccccgggtaccgtaacgggtttacgtacgggtccggtaaccccgtacgtacccggggtaacggggttcgggggtaccgggggtaacccggtaccggttaaccctaccgttacccgtacccgtaaaacccgttaacggttacccggacccgtacccggtaccgggtacccggggttacccgttaagggtaaaaccgttactttaccccggtacgggttaaaccctttaaccgtttttaaaccttttcggtaccggtttaaccgtaaccggtccgtaaacgtttacgttaaccggtaaacggtttaacccgggttccccgggttaacccccgttttacggtttaacccggtttttacccgggggaaccgggtaaacggggttaaccccgaaacggttaccgggtaaacggtaaaccgttaaaccgtaaacgttaaccggttcgggaacgttacggacccgtacccgtaacctaggtttaccccttaggttacccgtttaaccgtcccgtttaccccgttaccccgtcgtaacgtttaccgttaggtaactttaaccg

SEQ ID NO: 192480 - DNA, 806 bp, Homo sapiens
  misc_feature: GYAE6OF01EU9UY.44.23.C01.1.454.CMB.1.raw
  modified_base (783)..(783): a, c, t, g, unknown or other
  misc_feature (783)..(783): n is a, c, g, or t
tcagacagtatatacacgaccggtgctcgatttagtacacgtgattagggattgggggagtcagaccctgtcgagggacagcatggacagtgagggtccccgctcagctccgtgggcctcctgctgctctggctcccaggttcgagtatgtgacatcgatatcgaccagtctccttcttcctgttcttcttcgtggttcggaggtcaggtccgtccactatccgtacttcgggaccgggtcgaacgttcgtacgggtttcggttttcggcgtcgttcggttacgtcccctttgggtttaacgaaaacgggtaaaaacggggggagtaacccgggacccgttaacggtccgttaccggttcgttccgttacggtaaccgaaaccggtagaccggttagggtaacggtacggtaccgttcccgtacgtacgggttcgagttccggacgtaggtacccggagggtcggcggggcccgtaacgtacctaccgtacgtccgtaaccgtacgttaccggacccgtaccgtccggtcccggtaccgtaggtaaacgttcgttccgtaaccgttacgtttaacctttacggtttccgtagtacgtaacgttaccgtaagtttacgttaccgtacggttaccgttccccgttacccgtttacgtttaaccgggttccggaaccggtaacggtaacccgtagtacgtaaaggtaacctaacgaaacggtcgtagtcgtacctccgactacgttacgttcctcgtttctaccgtaccttaccccggttaccccngtttaacctcgtgttaacttacg

SEQ ID NO: 192481 - DNA, 509 bp, Homo sapiens
  misc_feature: GYAE6OF01D2SB7.44.23.C01.1.454.CMB.1.raw
  modified_base (474)..(509): a, c, t, g, unknown or other
  misc_feature (474)..(509): n is a, c, g, or t
tcagacagtatatacacgaccggtgctcgatttagtacacgtgattagggattggggaagtcagccataatggaagcaccagctataaccccgtccctcaagagtcgactcaccatctccgtcgacacgtccaagagacagatgtccctgagtctgacgtctgtgaccgccgcggacgcggctgtgtatttctgtgcgagaggccctggtaccagcgagtcgtacctctactactacctctcgtggacgtcgtcggggccaggggaccgcggtcaccgtctcctcagcctcaccaagggcccatccggtcttccccctggccaccctcctccacggagccacctcgtgggggcacgacgccggaccctgggctcgcctggtacaaacggaccttacgttaccctatacttacctgttcctggtaacgggcccggggtattccggggacgtaacgggccgactagtacggatgcnnnnnnnnnnnnnnnnnnnnnnnnnnnnnnnnnnnn

SEQ ID NO: 192482 - DNA, 815 bp, Homo sapiens
  misc_feature: GYAE6OF01CMPLJ.44.23.C01.1.454.CMB.1.raw
  modified_base (719)..(719): a, c, t, g, unknown or other
  misc_feature (719)..(719): n is a, c, g, or t
  modified_base (805)..(805): a, c, t, g, unknown or other
  misc_feature (805)..(805): n is a, c, g, or t
tcagacagtatatacacgaccggtgctcgatttagtacacgtgattagggattgggggagtcagaccctgtcaggggacagcatggacagtgagggtccccgctcagcctccgtggggctcctgctgctctggcctcccaggttcgagactgtgacatcgagtactcgacccagttcctccttccttcctgttcttcttcgtgttggacgcgacgcgtaccaccactctacgttcggccggtcgtacgttcgtacgggtttcggtttcggtgtctcggtttctcgttggttaaccgaaaacgggtaaaagggggcgaccggtacccgttaacggtcccttcgtaccttcgttaccggtaagaacccgtagtaaccgtagggtaacggtacgtaccggttcccgtacgtacggttctacgtcggtacccgtacgtaccgggtagggttccgggtcggggtacccgtacgttaccccgtacgttccgtaccggtaaccctacgttacgggaccctcgtacggccggtacccttaagggtaaccgttcttacggtaccgttaacttacgtttttaccgttcgttaacgttcgaacgttcgaacgttaccgtactaacgttcgttccccgtcccgtttacgtacggttaccgggtccgggaaacggtacccgtaaggtccgtaaacgtaacgtaccgtaaagtcggttacggcggtaacccgngttaacccgaaccgttacttccggtttaccgttccgttaccctacccggtttccccgtacccttacggactttacgttaacccgtntttaaacccg

SEQ ID NO: 192483 - DNA, 572 bp, Homo sapiens
  misc_feature: GYAE6OF01D8FJD.44.23.C01.1.454.CMB.1.raw
  modified_base (232)..(232): a, c, t, g, unknown or other
  misc_feature (232)..(232): n is a, c, g, or t
  modified_base (366)..(366): a, c, t, g, unknown or other
  misc_feature (366)..(366): n is a, c, g, or t
  modified_base (368)..(371): a, c, t, g, unknown or other
  misc_feature (368)..(371): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
tcagacagtatatacacgaccggtgctcgatttagtacacgtgattagggagttggggaagtcagccataatggaagcaccagctataacccgtccctcaagagtcgactcaccatctccgtcgactacgtccaagagacagatcgtaccctgagtctgacgtcgtagtacgaccgccgacggtaccgcggcttgtacttatttcgtgtgacgagtaccggccttaggaccnggcgtagtacggtacctctacgtactactctcgtggtacgtcgtcggggaccgagggaccgcggtaccgaccgtcgtcctacacgtacctaccgaaccgacggacctacgttccgtcccttcccgtcgaccctnannnntagnacatacagcagtcncagagatnagtanagacngatacanacgngacgntacntgagttanancgttancgatagngaangacgatcgtanacgatacgacgtanagtagaacgtacgagtacgtacgtacgtacgtacgtacgacgtacgtaagagtacgtacgacgaacgtagtacgtaacgacgaagtacgtaag

SEQ ID NO: 192484 - DNA, 770 bp, Homo sapiens
  misc_feature: GYAE6OF01B0GIE.44.23.C01.1.454.CMB.1.raw
  modified_base (105)..(105): a, c, t, g, unknown or other
  misc_feature (105)..(105): n is a, c, g, or t
  modified_base (291)..(291): a, c, t, g, unknown or other
  misc_feature (291)..(291): n is a, c, g, or t
  modified_base (579)..(579): a, c, t, g, unknown or other
  misc_feature (579)..(579): n is a, c, g, or t
  modified_base (735)..(735): a, c, t, g, unknown or other
  misc_feature (735)..(735): n is a, c, g, or t
tcagacagtatatacacgaccggtgctcgatttagtacacgtgattagggattgggggagtcagaccctgtcgaggggacagcatggacatggacgggtccccgntcagctccgtggggctcctgctgctctcggcctaccgtaggttcgagtatgtagactagtcgagatacgaacctacgttccttccctttccttccttcgtttctttcgttcgtgggttcggaggtcacggtcctacacctactcgtacggttccggcgggagtacgtcggtcgggttcgtttcggntcgttgtacgtccgttagtaacgaaaaggaaaggggcgtacgtacccgtaacggtccttctctcggtacgacgaacgtaggtacggtaaggacggtaccgtacccgttcccgtacggttaggtaccacggtccgccggttaggtacgggtaggggttcgggaccggggaccggtaccgtccctacgtttcccgaactaacggtaacttaggacccgttaccgtcgggacccgttacgtaagttacgtcctttcgtacgttaacttaacgtttcgttaccgtagtacgngttaaccagtttaccagttaccgttaccgtccgttaccttacgttcggttaccgggacggttaacggtaaccgtaggttacgtaaaggaacctaacgtaacggtgtacgcgtaaccggcctaacggtcttacgttctaccgtttctacctttaccncccgtttacccgacttagttcctagttaaccctag

SEQ ID NO: 192485 - DNA, 887 bp, Homo sapiens
  misc_feature: GYAE6OF01E4YDL.44.23.C01.1.454.CMB.1.raw
  modified_base (270)..(270): a, c, t, g, unknown or other
  misc_feature (270)..(270): n is a, c, g, or t
tcagacagtatatacacgaccggtgctcgatttagtacacgtgattagggattgggggagtcagaccctgtcaggggacagcatggacatggacgggtccccgctcagctccgtggggctcctgctgctctggcctcccgaggttcgagtatgtgactatcgagatcgaccctagttcctcctttccttccttcgttctttcttcgtggttggaggcagtccgtacacctatcacgttcggcgggcacgtcgtacggtttcggttttcgngtcttggttcgtccgttaggttaacgaaaacgggaaaaggggcgtaccggtcccgtaggtcctccgttctcgtacgtaacgaaccgtaggtacgtagtaacggtcgaccggttccccgtacttacggttctacggtccaccggtagttccggagggttggggccggggtaccggttccgtacccaacgttcccgtaccgtaaccgtacggtttaacgcccgttaaccgtcggaccggtactacgggtaagtactttcgacggtaacctttaacgttttacgtttaccgttacggtaaccgacgtttacgtaaacgtttcgtaaccggtaaaggtttccccggttacccgttttaccccccggttttaacggtttttacccggggttttacccggggtaaacccggggtaacccgggggttaaaccccggttaacggtaaccgggttaaaacccggggtttaaaacaaccccggggttaaaaacgttacccgggttgttaccgggacctttaaccggaccccttaacggttaccctttgtttaccccggttcgttaacccttcccccgtaccccttaccccgtatttaaccgttccggttaacgtttaaacgtttacg

SEQ ID NO: 192486 - DNA, 819 bp, Homo sapiens
  misc_feature: GYAE6OF01CVCQE.44.23.C01.1.454.CMB.1.raw
  modified_base (107)..(107): a, c, t, g, unknown or other
  misc_feature (107)..(107): n is a, c, g, or t
  modified_base (758)..(758): a, c, t, g, unknown or other
  misc_feature (758)..(758): n is a, c, g, or t
  modified_base (776)..(776): a, c, t, g, unknown or other
  misc_feature (776)..(776): n is a, c, g, or t
tcagacagtatatacacgaccggtgctcgatttagtacacgtgattagggattgggggagtcagaccctgtcgaggggacagcagtggacagtgacgggtcccccgntcagctccgtgggctcctgctgctcgtaggcctccgaggttcgagatgcgacatcggatactacgacctaacgttcccttccctttccgttccttgtcctttcgttacgttggttacggaacggtccgaggtacccgtaccaaccctattaccgtacggttccgggacccgggtacgtaggttaccggttacggggttttccggttttaccgggtggtccgtttggttaaccggttcccggttttaaacgggtttaaaacggaaaaacggggtaaaacggggggtaccgtaaacccggttacccgttaaccgggtccctttaccggttcgtaccgtacgtaaccggaaactggtaacggtaaggtacgtacgtaccgttaccggtacgtacgtcgacggttacgccgtacggtacgggtacggtcgggttacggggaaccgtccgtaaccgtcccgtagtaccgtaacgtaggtaccgaccgtacgtccggctaaccggtacgtacgttactacgttacgttaacgttaactttgtacgttataaccgattaccggtaatcgtagtacgtccgtacccttcccgttagttcgttcgggaaaccgttcgggaattcggaacgttaagaactacgaacggttatcgagtaccncgtacctcgtacgttacncttcgtctcccggttaccctacgctaactttcgatcgtttacg

SEQ ID NO: 192487 - DNA, 800 bp, Homo sapiens
  misc_feature: GYAE6OF01EKN26.44.23.C01.1.454.CMB.1.raw
  modified_base (584)..(584): a, c, t, g, unknown or other
  misc_feature (584)..(584): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgttcctttcttctggttggagcacgtccgtcaccatcgtacgttcggcccgggcgaggtcgtagggtttccgttttcggtcgtcgttcggttcgtcccgtttagggtttaaccgaaaacgggaaaaaaggggggtcgaaccggtacccccgttaacgggtcccttacggtccttcgtaccggtacgaaaccgtagtacggtagggtaaggtacgaccgtcccgtacgtaggttcaaggtccgccgtacggttccgtaggggtacggggtccggggaccggtacgtacccgtaccgttcctaccctaacctagtttaacgcccggtaccgtccgggaccggtccttaaggtaacgttacttcgtacggtaccttaaacgttttctttcgtacgttacgacggtntaaccggtttataccgttgttaacccggtttcccggttacccccgtttagtttaacggtttcccgggaacccggtaacggggtaaacctaggtaccgtaaacggtaaacgttaacgaaaccgttagtcgggtaccgtactacggaccttaccgtcgttcgttacttccgtacctacgtttcccccgtaccggtactactttcgtagtacgttaacg

SEQ ID NO: 192488 - DNA, 890 bp, Homo sapiens
  misc_feature: GYAE6OF01BSYWR.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtggggctcctgctgctctggcctcccaggttcgagatgtgacatcgagatcgacccagttcctccttccttcctgttctttcttcgtgttggagcgacgcgtccactatctacgttcggccgggcgagttcgtacgggttccggtttttcggtgtcgttggttccgtccgttagggtttacgaaaacgggaaaaaggggggacgtaaccgggtaccccgttaacggttcccttcggttccgttaccgttaccggtaaccgaaaccgtaacggtaccggtaagggtaaacgggttacgaccgggtttaccccgtaccggtaacgggtttaccgacggttacgacccggttacggtaccgtaggggtcgggtaccgggggcccggtacggtccctacccttaccgtacctaaccgttaacgtttaccggcccgtaacccggtcgggacccggtaccggtaacggtaaacgttcgtttaccgtaaccggttacctttaacctttacgttttccgttacggttaccgtaggtacgttacgttaactccgttaacgtttacccggtcccgtttccccccgtttacgttttaccggtttacccgggacccggggtaaacgggaacccgttaaagggtccggtaaagtaaaccgttaaccgaaacggtaccggtacggtccgtaccggtaccgacctaccccgttgtttacccgtacgtttacccgttaccttcccggttcccccgttacccctaaccgtttacgtaccgtttcgttaaattaccg

SEQ ID NO: 192489 - DNA, 918 bp, Homo sapiens
  misc_feature: GYAE6OF01EAUDX.44.23.C01.1.454.CMB.1.raw
  modified_base (503)..(503): a, c, t, g, unknown or other
  misc_feature (503)..(503): n is a, c, g, or t
  modified_base (648)..(648): a, c, t, g, unknown or other
  misc_feature (648)..(648): n is a, c, g, or t
  modified_base (835)..(835): a, c, t, g, unknown or other
  misc_feature (835)..(835): n is a, c, g, or t
tcagacagtatatacacgaccggtgctcgatttagtacacgtgattagggattgggggagtcagaccctgtcgaggggacagcatggacatgacgggtccccgctcagctccgtggggctcctgctgctctggcctcccgaggttcgagattgtgacagtcgagtatacgaccagttccttcctttcccttcctgttctttctttcgtggttggacggcagtccgtaccaaccgtactccgtacggttcggccgggtacgcgttccgtagggtttccggtttttcggtacgtcgtttcggtttccgtccggttttaggtttaaacccgaaaacggggtaaaaaacggggggtcctacccgggtaccccgtttaacgggtcccgtttacgttaccgttaccgtcggtaaaccgtaaaccgtaacgacggtagggtaaacgggttaccggtacccggttccccggtacggttcggttacgtacgtcggaccgttacgtaccgggnggggtttacggggccggggtaccggttaccgtcccaccgttccgaaccgtacgtaacgttcggaccgtcccgtacgggtcccggtaccgttaaaggtaccgtttacgtttaccggtaacgttcctttaaactttggtttttcccncggtacgtaaccgtcgtaaattcctaacgtacgttacccggtccgtttaccccggttacgttttaccggtaaccgggcccgggttaaacgggaaccgttaaccggtccgggttaaaaacggtaaacttaaacccgggaaaacggtccgttgggggtaaccctacccggttccaacccgtaccgtttnttcccggtttacttcccctttaacccggttcccttaccccggtttaccccaacttaaggttcccgtttaaagttaccttaaag

SEQ ID NO: 192490 - DNA, 901 bp, Homo sapiens
  misc_feature: GYAE6OF01D3NHM.44.23.C01.1.454.CMB.1.raw
tcagacagtatatacacgaccggtgctcgatttagtacacgtgattagggattgggggagtcagaccctgtcaggggacagcatggacatggacgggtccccgctcagcctcctggggcctcctgctgctctggcctcccgaggttcgagtatgtgacatcgagatcgaaccctgtccttccttccttcctgttcttcttcgtgttggaggcgacgcgtccacctatcacgttcggccggtcgagtcgtaggttcgttttcgcgtcgttgttcgtaccgttaagggttaaaacggaaaaaacggggtcgtaccggaccccggttaacggttcccttacgttctaccgtacgtaacgaaaccgtaggtaccggtagggaacgggtacggtaaccggtcccggtacgttaacggttcacggttcgaccgtacggtaccggtaaggggttcgggtacggggtacccggtacgtcccctaacgttcctaccgtaaccgtaacgttacggacccggttaccgcgggtacccggtcggtaaacgtaacggttaacgtttccggtacgttaacccgtttaaccgttttacgtttccgttagttaaccgtacgggtaaacttaacggttaaccttacgttaaccgtttaaccgggttccccgtttacccggtttaaccgtttacccggggtttttacccggaacccggggtaacccgggggtaaaccctaaacggggttaacccggtaaaacggttaaacttaaacccgggaaaacggttacgggttacgggtaccgttacgtaccgacccctaacggttacttaccggttccgtttaacctttcccgtaacctttccccgtaaccccggtccttaaacgttcccggtaaacttaaccttagttaaccc

SEQ ID NO: 192491 - DNA, 745 bp, Homo sapiens
  misc_feature: GYAE6OF01DLMS6.44.23.C01.1.454.CMB.1.raw
  modified_base (107)..(107): a, c, t, g, unknown or other
  misc_feature (107)..(107): n is a, c, g, or t
  modified_base (175)..(175): a, c, t, g, unknown or other
  misc_feature (175)..(175): n is a, c, g, or t
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (430)..(430): a, c, t, g, unknown or other
  misc_feature (430)..(430): n is a, c, g, or t
tcagacagtatatacacgaccggtgctcgatttagtacacgtgattagggagttgggggagtcagaccctgtcgaggggacagcagtggacatggacgggtccccgntcgagctccgtggggctccctgctgctctggcctccaggttcgagatgtgacagtcgagatcgaaccngtctccttccttcttgtcttcttctggttggagtcagtcgtcacatcgacgttcggccgggntaggttcgtcggtttcgttttacggngtcttggttacgtccgttaaggtttaaccgaaaacgggtaaaagggggcgtaaccggtaccccgttaagggtccttccgttcgtacgttaccggtaacggaaaaacccgtggtaaccgttagggaaacggttacggtacccggttcccggtacgtggtttaaccggngttaccggccgtaaggtccgtagggtcgggccgggtacccgtagccctacgcttacgaacgtagttaaccggccgtaaccggtcgaccggtattagaaacgttcgttacgtcgtaacgtttacttacttcgtacgtacgacgtcgtaacggtactacgttacgtcgtacccgtaccgttctacgtttacggacggtaacgtacgtaacgtacgtaacggaacgtaaccgtaacgtacgtggtccgtacgtcgacctaccgtacgtcttacgtccgttaccttcgtacccttccgaacttacgtctagtattaacg

SEQ ID NO: 192492 - DNA, 884 bp, Homo sapiens
  misc_feature: GYAE6OF01EZFNT.44.23.C01.1.454.CMB.1.raw
  modified_base (244)..(244): a, c, t, g, unknown or other
  misc_feature (244)..(244): n is a, c, g, or t
  modified_base (836)..(836): a, c, t, g, unknown or other
  misc_feature (836)..(836): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctagtgaccgccgcggacgcggactgtgtatttctgtgcgagacggcctggtaccagcgaagtggtacctcgttactaactaccncttacgtaggaccgttacgtcgggggaccaggggaacccggtcggtaccgaaccggttccgtccgttaccgtaacggtcccgttaccgaacccgaaaccgggggccccaaaacgtttcccggggttaccctttaccccccccgtttacggggtaacccctaaccccccgttacccgtttaccccgaaaaacggtaccggtacctaaccccgtttaccggtttacgggggggggtacccaaaccgttaaaccgggccccgggtaccccggtttacggggaccccgttttacgggaccccggtttacgggttaacccggtaaaaccgggggtaaacccttttaaacccgttttcccggtttaaaaacgtttaaacgtttaaaccgtttaccgggtttacccgttacgggtaacgggttcccggggtacgttaccggggttaaccggaaacgggttcccggaacgtaaacgtaaacggtcgttaccgagttacgacgttaaccggattaccggaattccgaacgtcgaaagtcggttaccaaggtaaccttcggacgtacgtattaccggtagaccttaccgggataaaccgggngtacgtacgtacgtacgtacgtacgtacgacgtagcgtacgtagtacg

SEQ ID NO: 192493 - DNA, 835 bp, Homo sapiens
  misc_feature: GYAE6OF01AVWIU.44.23.C01.1.454.CMB.1.raw
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
tcagacagtatatacacgaccggtgctcgatttagtacacgtgattagggattgggggatgctttctgagagtcaaggaccctcctgtgcaagaacatgaagccacctggttcggttttttcctcctgtctgggtggcagtcctccagtagtcgggtccctcgtcccgaggtgctacggctggacgagggtcggtccgggccaggcgtggtcggacggtcccgtacgggtaccctgtcctctctactcngctcgttgtcgttcgtggtacttcatcgtagtctntactctacgttcggtggcgtcggtacgtcccgaccgacccgggtacccggaagggggaacgggtaggtagggtacggtaggttagttcgggaactaacgtactaaccggttagttaacggtaacgggtcgggtaaccgtaccttaccgtccgttacccgtccctaacgtacgtacgttactcccgtacgtacctacggtacgttaccgggacgtaccgtaccgtaacgtacgtaccgtcccgttacctacccgtacccgtacgtacgtacccgtccccgttaccggcccgtacccgggtaccggtacccgggtacccgggtttaccgtttacccgttttcgtccgggtacggtccggaaccgggtcgggtccgtaagggttacccgtttacggtttacttaccgttaacgttcggggaccgggttcggtaccggtccggtacccggttaaccgtttccggaccttccggttcgtacccttaccggtcgttcccccggttaacccggtccccgtaacggtccccggttaccccggttccgttaccccccggg

SEQ ID NO: 192494 - DNA, 761 bp, Homo sapiens
  misc_feature: GYAE6OF01AM541.44.23.C01.1.454.CMB.1.raw
  modified_base (152)..(152): a, c, t, g, unknown or other
  misc_feature (152)..(152): n is a, c, g, or t
  modified_base (308)..(308): a, c, t, g, unknown or other
  misc_feature (308)..(308): n is a, c, g, or t
  modified_base (734)..(734): a, c, t, g, unknown or other
  misc_feature (734)..(734): n is a, c, g, or t
  modified_base (744)..(744): a, c, t, g, unknown or other
  misc_feature (744)..(744): n is a, c, g, or t
  modified_base (751)..(751): a, c, t, g, unknown or other
  misc_feature (751)..(751): n is a, c, g, or t
tcagacagtatatacacgaccggtgctcgatttagtacacgtgattagggagttggggagtcagaccctgtcgaggggacagcatggacatgagggtccccgctcagcctccgtggggcctcctgccgtgcctctggcctcccgaggttcgngacgtgtgactatccggagacgtacgaccctagtccttcccgttccttcctcgttcctttcttccgttggttcggacggtcacggtccggttccaaccgacgtacctacggttccggcccgggtacgtaacggtcgtacgggttcggttttccggnggtccgtttcggttcgtccgttacggtttaaccgaaaacggaaaaacgggggtacgaccgggtaccccgttaacggtcccgttacgttcctacggtaccgtacgaaccgacgtacggtaggaacggtacgccgtcccgtacgtacggtcgtacgtcgtccgaggtaccgtgggtcggtcgggaccggtcgtcctactccgtctaaccgacgttacgcgtccgtcggtcggtaccgtagtacgtacttcgtcgtaacctactttactcgttcgtacgtagtaactacgtaacgtccgttaacgtaccgtcgttccctttacgttccggttaccgcggtaacgaacgtcgtagtaacgtaaacgtaacgtaacgagtcggtcgtctccgtaccgagttccgtaggtccgttacctctacccgttcccncccgttactntacggtntagttaaccg

SEQ ID NO: 192495 - DNA, 236 bp, Homo sapiens
  misc_feature: GYAE6OF01B7QMO.44.23.C01.1.454.CMB.1.raw
  modified_base (131)..(131): a, c, t, g, unknown or other
  misc_feature (131)..(131): n is a, c, g, or t
  modified_base (151)..(151): a, c, t, g, unknown or other
  misc_feature (151)..(151): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (225)..(236): a, c, t, g, unknown or other
  misc_feature (225)..(236): n is a, c, g, or t
tcagacagtatatacacgaccggtgctcgatttagtacacgtgattagggattgggggaagaggaagactgacggtcctcccaggagttcaggtgctgggcaccgttgggcgacgggggaggtgtgtacanaagatttgggctctgggcanagcggccctggggctagcctggtcaaggactacttcctatatacngtctggagcgggntggcaagggcnatagnnnnnnnnnnnn

SEQ ID NO: 192496 - DNA, 798 bp, Homo sapiens
  misc_feature: GYAE6OF01ETWN8.44.23.C01.1.454.CMB.1.raw
  modified_base (109)..(109): a, c, t, g, unknown or other
  misc_feature (109)..(109): n is a, c, g, or t
  modified_base (296)..(296): a, c, t, g, unknown or other
  misc_feature (296)..(296): n is a, c, g, or t
  modified_base (419)..(419): a, c, t, g, unknown or other
  misc_feature (419)..(419): n is a, c, g, or t
tcagacagtatatacacgaccggtgctcgattttagtacacgtgattagggattgggggggagtcagaccctgtcgaggggacagcatggaccatggacgggtccccgntcagctccgtgggggcctccctgctcgctcgtcggtcctcccgagggttcgagtatgtgacatcggagtatcgaccctacgttcctccctttccttcctcgttctttcttcgttggttgggacggcaggccgtccacctattcgtacgttcggccgggcgtacgtccgtagggtttcgttttcgggngttcttggttcgtccgtttaggttacgaaacggaaaggggcacggtacccgtaggtcctcgtctcgtacgacgaacctggtacgtggggaaggttacggccgttcccggtagtacgggttacncggtcaccgttacggtccgtaaggggttcgggaccggggtaccggtacttccgaccttcgtaccgacctacggttaccgcggttacccgcggccggtactaggaaccgtttctttcgaccgtacttaacttttcgtttcgtcggttaacacgtctaaacgttcgactttacggtaccgttcccgttaccctttaggtttacccggttacgggaacccggttaggggtaacccacgggttaccgttaaaggttaacctaaccggtaaaccgtacggttcgggtacggtccctaaggtaccccttacgttactttccgtaaccgtttccacgttacccgttccccgttacccgacgttacgtttacgtcgtaaccgtttac

SEQ ID NO: 192497 - DNA, 587 bp, Homo sapiens
  misc_feature: GYAE6OF01AUF1C.44.23.C01.1.454.CMB.1.raw
  modified_base (102)..(102): a, c, t, g, unknown or other
  misc_feature (102)..(102): n is a, c, g, or t
  modified_base (208)..(208): a, c, t, g, unknown or other
  misc_feature (208)..(208): n is a, c, g, or t
  modified_base (518)..(518): a, c, t, g, unknown or other
  misc_feature (518)..(518): n is a, c, g, or t
  modified_base (535)..(535): a, c, t, g, unknown or other
  misc_feature (535)..(535): n is a, c, g, or t
  modified_base (547)..(548): a, c, t, g, unknown or other
  misc_feature (547)..(548): n is a, c, g, or t
  modified_base (550)..(552): a, c, t, g, unknown or other
  misc_feature (550)..(552): n is a, c, g, or t
  modified_base (554)..(587): a, c, t, g, unknown or other
  misc_feature (554)..(587): n is a, c, g, or t
tcagacagtatatacacgaccggtgctcgatttagtacacgtgattagggattgggggaagtcagccataatggaagcaccagcctataaccccgtcccctnaaggagtcgacctcaaccatcctcccgtcgaccacgtccaagagacaggatgtcccctgagtctggacgtctgtacgacccgccgcggacgcgctggtgtatttcngtgccgagaccggccctaggtaccaggccgtagtccggtacctacttacctactactctcgtcggacgtcggtcgggggaccgacgggggtcccgcggtccaccgttcctccgacctcgaccctacccgaaccaacggggtcccctacgttcccggtccccttacccccgtggacccccaccccgttaccctccgaacgaccggaccctacgtccggtacggggacctacgacggtccggccccgtagggcctcggccgtacgtagaaacgtcttaccttaccgaccttctacgcgatcgaccggcggtntccgggacgaccgggcncgtaagtacgtnncnnncnnnnnnnnnnnnnnnnnnnnnnnnnnnnnnnnnn

SEQ ID NO: 192498 - DNA, 219 bp, Homo sapiens; identical to SEQ ID NO: 192143
  misc_feature: GYAE6OF02FGCTO.44.23.C01.1.454.CMB.1.raw
  modified_base (218)..(219): a, c, t, g, unknown or other
  misc_feature (218)..(219): n is a, c, g, or t

SEQ ID NO: 192499 - DNA, 221 bp, Homo sapiens
  misc_feature: GYAE6OF02HTA8B.44.23.C01.1.454.CMB.1.raw
  modified_base (217)..(221): a, c, t, g, unknown or other
  misc_feature (217)..(221): n is a, c, g, or t
tcagacagtatatacacgaccggtgctcgatttagtacacgtgattagggattggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnn

SEQ ID NO: 192500 - DNA, 225 bp, Homo sapiens
  misc_feature: GYAE6OF02IUT35.44.23.C01.1.454.CMB.1.raw
  modified_base (218)..(225): a, c, t, g, unknown or other
  misc_feature (218)..(225): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnnnnn

SEQ ID NO: 192501 - DNA, 219 bp, Homo sapiens; identical to SEQ ID NO: 192129
  misc_feature: GYAE6OF02IW4I3.44.23.C01.1.454.CMB.1.raw
  modified_base (218)..(219): a, c, t, g, unknown or other
  misc_feature (218)..(219): n is a, c, g, or t

SEQ ID NO: 192502 - DNA, 504 bp, Homo sapiens
  misc_feature: GYAE6OF02F76OE.44.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattggggcatgagtcagaccctgtcaggggacagcatggacatgagggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaggggnaggcccctaaggtcctcgtctctcgtgaaaccngactggaaggtagagtcccgtcaggttcagtgccagtccaggtggtgggccggagtccactctcaccattagcgacctgcgctgaagnttcngcaacttattctgtcagcagtatcatagtcgccccgttcacttttggcctaggggaccaagctggaaatcaacgactgtggctgcacatctgtcttcatctccgcatc

SEQ ID NO: 192503 - DNA, 253 bp, Homo sapiens
  misc_feature: GYAE6OF02FV97D.44.23.C01.1.454.CMB.1.raw
  modified_base (225)..(253): a, c, t, g, unknown or other
  misc_feature (225)..(253): n is a, c, g, or t
tcagacagtatatacacgaccggtgctcgatttagtacacgtgattagggattggggggtaagaggaagactgacggtcctcccaggaggttcaggtgctgggcaccttgggcacggggaggtgtgttcacaacgatttgggctctgggcacagcggccctgggctgcctggtcaaggctactccctatactacctgtctgagccgggctggcaaggcgcatagnnnnnnnnnnnnnnnnnnnnnnnnnnnnn

SEQ ID NO: 192504 - DNA, 225 bp, Homo sapiens
  misc_feature: GYAE6OF02HVDML.44.23.C01.1.454.CMB.1.raw
  modified_base (218)..(225): a, c, t, g, unknown or other
  misc_feature (218)..(225): n is a, c, g, or t
tcagacagtatatacacgaccggtgctcgatttagtacacgtgattagggattggggaagaggaagactgacggtcctcccaggagttcaggtgctgggcaccttgggcacggggaggtgtcgtcacaagatttgggctctgggcacagcggccctgggctgcctggtcaaggactacttccacgtctactgctgagcgggctggcaaggcgcatagnnnnnnnn

SEQ ID NO: 192505 - DNA, 221 bp, Homo sapiens; identical to SEQ ID NO: 192499
  misc_feature: GYAE6OF02F7JFE.44.23.C01.1.454.CMB.1.raw
  modified_base (217)..(221): a, c, t, g, unknown or other
  misc_feature (217)..(221): n is a, c, g, or t

SEQ ID NO: 192506 - DNA, 228 bp, Homo sapiens
  misc_feature: GYAE6OF02HIDQQ.44.23.C01.1.454.CMB.1.raw
  modified_base (218)..(228): a, c, t, g, unknown or other
  misc_feature (218)..(228): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnnnnnnnnn

SEQ ID NO: 192507 - DNA, 516 bp, Homo sapiens
  misc_feature: GYAE6OF02HY9B0.44.23.C01.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccngactggaaggtagagtcccgtccaggttcagtgccagtccaggtggtgggccggagtccactctcaccattagcgacctgcggcctgaagattctgcaacttatttctgtcagcagtatcatagtgccccgttnacttttggccaggggaccaagctggaatcaaacgactgtgctgcaccatctgtcttcatcttccgcctatctgatac

SEQ ID NO: 192508 - DNA, 422 bp, Homo sapiens
  misc_feature: GYAE6OF02FXT30.44.23.C01.1.454.CMB.1.raw
  modified_base (417)..(422): a, c, t, g, unknown or other
  misc_feature (417)..(422): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacagcggccctgggctgcctggtcaaggactacttccacgtctactgctgagcgggctggcaaggcgcatagnnnnnn

SEQ ID NO: 192509 - DNA, 222 bp, Homo sapiens; identical to SEQ ID NO: 192228
  misc_feature: GYAE6OF02GRPWI.44.23.C01.1.454.CMB.1.raw
  modified_base (218)..(222): a, c, t, g, unknown or other
  misc_feature (218)..(222): n is a, c, g, or t

SEQ ID NO: 192510 - DNA, 240 bp, Homo sapiens
  misc_feature: GYAE6OF02FVACR.44.23.C01.1.454.CMB.1.raw
  modified_base (217)..(240): a, c, t, g, unknown or other
  misc_feature (217)..(240): n is a, c, g, or t
tcagacagtatatacacgaccggtgctcgatttagtacacgtgattagggagttgggggaagaggaagactgacggtcctcccaggagttcaggtgctgggcaccttgggcacggggaggtgtgtcacaagatttgggctctgggcacagcggccctgggctgcctggtcaaggctactcctatatactgtctgagcgggctggcaaggcgcatagnnnnnnnnnnnnnnnnnnnnnnnn

SEQ ID NO: 192511 - DNA, 269 bp, Homo sapiens
  misc_feature: GYAE6OF02I2ERL.44.23.C01.1.454.CMB.1.raw
  modified_base (229)..(229): a, c, t, g, unknown or other
  misc_feature (229)..(229): n is a, c, g, or t
  modified_base (231)..(269): a, c, t, g, unknown or other
  misc_feature (231)..(269): n is a, c, g, or t
tcagacagtatatacacgaccggtgctcgatttagtacacgtgattagggtagtttgggggaagaggaagacttgacggtcctcccaggagttcaggtgctgggcaccttgggcacgggggaggtgtgtcacaagagtttgggctctgggctacagcggccctgggcttgcctggtcaaggtactacttccacgtctactgctgagcgggctggcaaggcgcgagtagngnnnnnnnnnnnnnnnnnnnnnnnnnnnnnnnnnnnnnnn

SEQ ID NO: 192512 - DNA, 220 bp, Homo sapiens
  misc_feature: GYAE6OF02G1ZI4.44.23.C01.1.454.CMB.1.raw
  modified_base (218)..(220): a, c, t, g, unknown or other
  misc_feature (218)..(220): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnn

SEQ ID NO: 192513 - DNA, 513 bp, Homo sapiens
  misc_feature: GYAE6OF02G96V9.44.23.C01.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngaggcccctaaggtcctcgtctctcgtgaaaccngactggaaggtagagtcccgtcaggttcagtgccagtccaggtggtggccggagtccactctcaccattagcgacctgcggcctgaagnttctgctaacttatttctgtcagcagtatcatagtcgccccgttcacttttggccaggggaccaagctaggaatcaaacgactgngctgcacntctgtcttcatctcccgcatctgata

SEQ ID NO: 192514 - DNA, 224 bp, Homo sapiens
  misc_feature: GYAE6OF02HVP4I.44.23.C01.1.454.CMB.1.raw
  modified_base (220)..(224): a, c, t, g, unknown or other
  misc_feature (220)..(224): n is a, c, g, or t
tcagacagtatatacacgaccggtgctcgatttagtacacgtgattagggagttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 192515 - DNA, 221 bp, Homo sapiens; identical to SEQ ID NO: 192133
  misc_feature: GYAE6OF02J1ZJE.44.23.C01.1.454.CMB.1.raw
  modified_base (218)..(221): a, c, t, g, unknown or other
  misc_feature (218)..(221): n is a, c, g, or t

SEQ ID NO: 192516 - DNA, 230 bp, Homo sapiens
  misc_feature: GYAE6OF02JDU5T.44.23.C01.1.454.CMB.1.raw
  modified_base (218)..(230): a, c, t, g, unknown or other
  misc_feature (218)..(230): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnnnnnnnnnnn

SEQ ID NO: 192517 - DNA, 516 bp, Homo sapiens
  misc_feature: GYAE6OF02HYEX4.44.23.C01.1.454.CMB.1.raw
  modified_base (271)..(271): a, c, t, g, unknown or other
  misc_feature (271)..(271): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccagactggaaggtagagtcccgtcaggttcagtgccagtccaggtggtgggccggagtccactctcaccattagcgacctgcgcctgaagnttcngctaacttatttctgtcagcagtatcatagtcgtccccttnactttggccaggggaccaagctaggaatcaaacgactgtgctgcacatctgtcttcattccttcccgctatctgata

SEQ ID NO: 192518 - DNA, 222 bp, Homo sapiens; identical to SEQ ID NO: 192154
  misc_feature: GYAE6OF02FW9Q7.44.23.C01.1.454.CMB.1.raw
  modified_base (218)..(222): a, c, t, g, unknown or other
  misc_feature (218)..(222): n is a, c, g, or t

SEQ ID NO: 192519 - DNA, 590 bp, Homo sapiens
  misc_feature: GYAE6OF02HG9ES.44.23.C01.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtgaaaccngactggaaggtagacgtcccgtccaggttcagtgccagtccaggtggtggccggagtccactctcaccagttacgcgacctgcggcctgaagntctgctaactttattctgtcagcagtatctatagtcgtccccgttctaccgtttttcgggccgtacgggggtacccaacggtaccgttacgggaaacttaccgaaaaccggtaacgtaggtacgggtactcgacctaaccgtacttccgtgttccttactacttccttccccgcctacttcctacgtattaac

SEQ ID NO: 192520 - DNA, 524 bp, Homo sapiens
  misc_feature: GYAE6OF02FOIM6.44.23.C01.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggttcaacaaaagggggnaggcccctaaggtcctcgtctctcgtgaaccagactggaagtgagtcccgtcaggttcagtgccagtccaggtggtggccgagtccatcncacattagcgactgcggcctgaagnttctgctaacttnttctgtcagcagtatcatagtcgcccgttctacttttcggccgtaggggacctaagcgtaggaaactcgaaacgtacgtgtcgctgcacctatctgtcttcattccttcccgactactctagtatac

SEQ ID NO: 192521 - DNA, 219 bp, Homo sapiens
  misc_feature: GYAE6OF02HG8SX.44.23.C01.1.454.CMB.1.raw
  modified_base (217)..(219): a, c, t, g, unknown or other
  misc_feature (217)..(219): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaagactacttcctatatactgtctgagcgggctggcaaggcgcatagnnn

SEQ ID NO: 192522 - DNA, 622 bp, Homo sapiens
  misc_feature: GYAE6OF02JS4CZ.44.23.C01.1.454.CMB.1.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (453)..(453): a, c, t, g, unknown or other
  misc_feature (453)..(453): n is a, c, g, or t
tcagacagtatatacacgaccggtgctcgatttagtacacgtgattagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgtttcggngctgttgcctggtttcaacgaaaaggggnaggcccctaaggtcctcgtctctcgtagaaaccngactggaaggtagacgtcccgtcaggttcagtgccagtccaggtgggtcgggccggagtccactctcaccattacgccgacctgcggtcctgaacgtattcgtgactaactttatttctgtcagctagtatcatacgtctcccgttntacgttttcggaccgtaagggggtacccaaggtcgttaagggaaaacttaccgaaaaccggtaacgttggtacgggtaccgtcggtaccctaaccgtacgtttacccgttacggttaccctttaccgtaaccgtttccccgtttacccccggtaccttacgtttacccg

SEQ ID NO: 192523 - DNA, 424 bp, Homo sapiens
  misc_feature: GYAE6OF02HVFMK.44.23.C01.1.454.CMB.1.raw
  modified_base (419)..(424): a, c, t, g, unknown or other
  misc_feature (419)..(424): n is a, c, g, or t
tcagacagtatatacacgaccggtgctcgatttagtacacgtgattagggattggggaagtcagccataatggaagcaccagctataacccgtccctcaagagtcgactcaccatctccgtcgacacttccaagagacagatgtccctgagtctgacgtctgtgaccgccgcggacgcggctgtgtatttctgtgcgagaggccctggtaccagcgagtggtacctctactactactctctggacgtctggggccagggggaccgcggtcaccgtctcctcagcctccaccaagggcccatcggtcttccccctggcaccctcctccaagagcacctctgggggcacagcggccctgggctgcctggtcaaggactacttcctcgatcgcgtctgagcgggctggcaaggcgcagtagnnnnnn

SEQ ID NO: 192524 - DNA, 220 bp, Homo sapiens; identical to SEQ ID NO: 192345
  misc_feature: GYAE6OF02GQ7UD.44.23.C01.1.454.CMB.1.raw
  modified_base (219)..(220): a, c, t, g, unknown or other
  misc_feature (219)..(220): n is a, c, g, or t

SEQ ID NO: 192525 - DNA, 529 bp, Homo sapiens
  misc_feature: GYAE6OF02H86EU.44.23.C01.1.454.CMB.1.raw
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtcaggttcagtgccagtccaggtggtgggccggagtccactctcaccattacgcgacctgcggcctgaagtntctgcaacttatttctgtcagctagtatcatagtcgcccgttctacttttcggccgagggaccaagctaggaatacgaaacgaactagtgctgcaccatctgtcttcacttccttcccgcctactctgataac

SEQ ID NO: 192526 - DNA, 645 bp, Homo sapiens
  misc_feature: GYAE6OF02IYDI3.44.23.C01.1.454.CMB.1.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaaacgaaaagggggnaggcccctaaggtcctcgtctctcgtgaaaccngactggaaggtagacgtcccgtccaggttcagtgccagtccaggtggtgggccggagtccacgtctcaccattacgcgacctgcggtcctagaagtcttcgtgctaactttatttctgtcagcagtatcattacggtcgtccccgtttctaccgtttttcgggacccgtacggggtaccctaaaggtccgtaacgggtaaacttaccgaaaaacggtaaacttcgggttacgggaccttcggacctaaccccgtaacgttccgttacggtttaccctttacccgtaacgtttccccgtttacccccggacccttaactttccgttacgtaactttaacg

SEQ ID NO: 192527 - DNA, 221 bp, Homo sapiens
  misc_feature: GYAE6OF02H5SRP.44.23.C01.1.454.CMB.1.raw
  modified_base (219)..(221): a, c, t, g, unknown or other
  misc_feature (219)..(221): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnn

SEQ ID NO: 192528 - DNA, 220 bp, Homo sapiens; identical to SEQ ID NO: 192512
  misc_feature: GYAE6OF02F8FMS.44.23.C01.1.454.CMB.1.raw
  modified_base (218)..(220): a, c, t, g, unknown or other
  misc_feature (218)..(220): n is a, c, g, or t

SEQ ID NO: 192529 - DNA, 499 bp, Homo sapiens
  misc_feature: GYAE6OF02HCJ9T.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (431)..(431): a, c, t, g, unknown or other
  misc_feature (431)..(431): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggtttcaacaaaaagggggnaggcccctaaggtcctcgtctctcgtgaaaccagactggaaggtagagtcccgtcaggttcagtgccagtccaggtggtgggccggagtccactctcacattagcacctgcgcctgaagnttcngctaacttatttctgtcagcagtatcatgtcgccctnctttgcagggcagctgaatcaaagctgngctgcacntctgtcttcattcttcccgcctatctgtatac

SEQ ID NO: 192530 - DNA, 567 bp, Homo sapiens
  misc_feature: GYAE6OF02HI72X.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (446)..(446): a, c, t, g, unknown or other
  misc_feature (446)..(446): n is a, c, g, or t
  modified_base (517)..(517): a, c, t, g, unknown or other
  misc_feature (517)..(517): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngctgttgcctggtttcaacgaaaaagggggngaggcccctaaggtcctcgtctctcgtagaaaccagactggaaggtagacgtcccgtcaggttcagtgccagtccaggtggtggccggagtccactctcaccattacgcgacctgcggcctgagtattctgactaactttatttctgtcagtcagtatcatagtcgtccccttntacttttcggccgaggggtaacccaagtcctaggaaactccaaaacggacttgtcggctggacctacccgnttccttgtccttacgacttcccgtttccccgacctattccgtagattaac

SEQ ID NO: 192531 - DNA, 595 bp, Homo sapiens
  misc_feature: GYAE6OF02HYXJZ.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaagggggnaggcccctaaggtcctcgtctctcgtagaaaccagactggaaggtagagtcccgtcaggttcagtgccagtccagggtggtggccggagtccacgtctcacattagcgacctgcggcctgaagatttcngctaacttntttctgtcagcagtancattagtcgccccgtttnacgttttggcctaaggggaccaaggtcctagggaaacttccgaaacgtaactggtacgggcttacggacctaccgtaattccgttacggttacctttccgaacgtttccccgtttacccccggccttaacgttccgttagtaactttaacg

SEQ ID NO: 192532 - DNA, 745 bp, Homo sapiens
  misc_feature: GYAE6OF02I5CZ7.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggngaggcccctaaggtcctcgtctctcgtgaaaccagactggaaggtagagtcccgtcaggttcagtcgccagtccgaggtggtcgggccggacgtccactctccaacctagtttacggccgtaacccgttgggccggtcctaggaaacgtctttccgtacggtaccttaaacgttttacttttccgtcgttaccgtaacggtactaaggttaacttactaagtttacggttaccggttacccccgtttcgttaaccgttttttccggggaccccggtaaacggggggtaaccctaaacgggtcccgttaaggggtaaaccttaccgtaaaaaccggtaccgtttacggtacggggtacctacgggtaaccctaacccgtaagttcccgtttacggtttacccttaccgttaccgttttaccccggtttacccccggtacccgttaacgtttcccgttacgttaacgtttaacccg

SEQ ID NO: 192533 - DNA, 517 bp, Homo sapiens
  misc_feature: GYAE6OF02F3KHT.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcagggcattagcaattattagcctggtatcagcagaaaccagggaaagctcctaagctcctgatctatgaaacatccattttgcaatcaggggtcccatctcggttcagcggcagtggatctgggacagatttcactctcaccgtcagcagcctgcagcctgaacgatgttgctaacttattactgtaccaaaagttataaacagtacgcccctcaacctactttacggccctacggggaccacgagtggaactatcgaaagcgtaaactcgtggacctgccacattaccg

SEQ ID NO: 192534 - DNA, 665 bp, Homo sapiens
  misc_feature: GYAE6OF02INS2U.44.23.C01.1.454.CMB.1.raw
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccggcgagtcaggtcgtttcggtgctgttgcctggtttcaacaaaaggggnaggcccctaaggtcctcgtctctcgtagaaccagactggaaggtagagtcccgtcaggttcaggtcgacgtacgtcgagggtggcggccggtacgtcctactctaccactagttacgccgtacncggccggtccgtaggaacgttactttcgtacgtaaccttaacttttacgttttcgtcgttacgacgacttaagtactacgttagttacggtacccgttccccgtttacttaccggttttccgggaccgggtaacggggtaacctaacggtacgtaaacggtaaactaaccgtaaaaccggtacttagggtacgtacgtacgaccctaccgtaattccgtcgtttccttactaccgtttccccgttcccgaccttacgttccttagtacttaacg

SEQ ID NO: 192535 - DNA, 858 bp, Homo sapiens
  misc_feature: GYAE6OF02IEHZ4.44.23.C01.1.454.CMB.1.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
tcagacagtatatacacgaccggtgctcgatttagtacacgtgattagggattgggggagtacgagaccctgtcaggggacacgcactgggactatgagggttccccgcttcgagctcctggggctcctagctgctctggcctcccaggttcgtaggatgtgacagtcgtagatgaccctagttactccttccttcctgtcttcttctgttggagcgagcgtcaccgatctacgttgccgggcgaggtccagggttccgttttcggtcgtcttggttgcccttgggtttaccaaaacgtaaaaaagggggggntacgggtacccccttaaagggtcccttacgttctcgtcgtacgaaaaccgnggtaccgttggggaacggtacggacggttcccccgttccgaaggggtttccgaaggttcggacccgtaaggttcccgaagggttcgggtcggggacccggtagttccgtacgttcgtaccacccgtagttaacgccgtaacccttggccgggtaccctaggaaacgttacgtttcgtacgggtaccctaaacttttaacttttccgttacgttaccgaacggtacctaaggtttaacttaaccgtaaacgttaaccgttaccggttaccccccgttttagttaacccgttttttacgggaacccgtaaacggggggtaaaccctaaacgtaccgttaacgggtaaaacttaccgaaaaaccggtaaccgttacggtaccgggtaccgttaccggtaaccctaacccgtaagttacccgttacggttacccgtttaacgtaccgtttaccccgttaccccggtacctaacgtttccgttacggtaagtttaaccg

SEQ ID NO: 192536 - DNA, 523 bp, Homo sapiens
  misc_feature: GYAE6OF02G9KYB.44.23.C01.1.454.CMB.1.raw
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaagggggnaggcccctaaggtcctcgtctctcgtgaaaccngactggaaggtagagtcccgtcaggttcagtgccagtccaggtgtgggccggagtccactctcaccattagcgacctgcggcctgaagnttctgcaactttattctgtcagcagtatcatagtcgccccgttctacttttggccaggggaccaagcgtaggaaactacgaaacgaactgtgctgcaccattctgtcttcatccttcccgcctatctgata

SEQ ID NO: 192537 - DNA, 264 bp, Homo sapiens
  misc_feature: GYAE6OF02F7IWX.44.23.C01.1.454.CMB.1.raw
  modified_base (262)..(264): a, c, t, g, unknown or other
  misc_feature (262)..(264): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacgtctactgctgagcgggctggcaaggcgcatagnnn

SEQ ID NO: 192538 - DNA, 222 bp, Homo sapiens
  misc_feature: GYAE6OF02H9CFT.44.23.C01.1.454.CMB.1.raw
  modified_base (218)..(222): a, c, t, g, unknown or other
  misc_feature (218)..(222): n is a, c, g, or t
tcagacagtatatacacgaccggtgctcgatttagtacacgtgattagggattgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnnn

SEQ ID NO: 192539 - DNA, 649 bp, Homo sapiens
  misc_feature: GYAE6OF02JA29Q.44.23.C01.1.454.CMB.1.raw
tcagacagtatatacacgaccggtgctcgatttagtacacgtgattagggattggggtagttcgagaccctgtcagggacagcatggacatgaggtccccgctcagctcctgggctccctgctgctctggcctcccaggttccgagatgtagacatcgagatgacccagtcctccttccttcctgtctttcttctgttggaggcagccgtccaccatcacttggccgggcgagtcaggttcgttttcggtgtcgtgttcgccgttggtttacaaacgaaaaagggggacgacggcccctaaggtccctcgtctctcgtacaaaccagactggaaggtagacgtcccgtccaggttcagtcgcctagtcccgagggtcggtcgggccgagtccgtacgtccgtcaccgtattacgccgtacctggccgcctagaacgtcttcgcgtacctaactttactttctgtcagtctagtatctattagtcgtcccgttactacgttttggaccgtacggggaacctacgtcgttaacggtaaacttaccgtaaaacggtacgttaggtacggcgttagacctaaccgtaagttccgttaggttcctttactaccgtttcccgttaccccgaccttagttcccttacgttattaac

SEQ ID NO: 192540 - DNA, 245 bp, Homo sapiens
  misc_feature: GYAE6OF02HVLRE.44.23.C01.1.454.CMB.1.raw
  modified_base (218)..(245): a, c, t, g, unknown or other
  misc_feature (218)..(245): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttccagtctactgctgagcgggctggcaaggcgcatagnnnnnnnnnnnnnnnnnnnnnnnnnnnn

SEQ ID NO: 192541 - DNA, 623 bp, Homo sapiens
  misc_feature: GYAE6OF02GQ6PR.44.23.C01.1.454.CMB.1.raw
  modified_base (309)..(309): a, c, t, g, unknown or other
  misc_feature (309)..(309): n is a, c, g, or t
  modified_base (519)..(519): a, c, t, g, unknown or other
  misc_feature (519)..(519): n is a, c, g, or t
  modified_base (580)..(580): a, c, t, g, unknown or other
  misc_feature (580)..(580): n is a, c, g, or t
tcagacagtatatacacgaccggtgctcgatttagtacacgtgattagggattgggggagtcagaccctgtcaggggacctagccagtggaccaagtcgtacgggtcccccgtcgttcagcctcctggggccttcctgcctgctcgtggctcccaggttcggaagtagtgtgacatcggtacgtatgaccccagttctaccgttccgttccctgtcttcttcgtgttggaggcaggcgtcaccggatctacgttcgccgggcgaggtccaggtcgtttcgtgctgttgcctggttcaacgaaaaggggntacggccccttaaggtcctcgtctcgtcgtgaaacctggacctggaagtacgacgtcccggtacgaggttcgaggtcggccgacgtaccgagggtaggtcgggccggagtccgattcacaactattagcgtacctgccggtccgtgaacggtattctcgactaacttttactttactgtacacgcaagtactcaattagtcgtccccttntaccttttcggaccgagggaccagcgtaggaactacgaaacgacgtgtgtctgactaccgngtctgtcttactacgtaccttcccgcgtactcgtacgtatacg

SEQ ID NO: 192542 - DNA, 554 bp, Homo sapiens
  misc_feature: GYAE6OF02JFHB1.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggngacggcccctaaggtcctcgtctctcgtgaaaccngactggaaggtagacgtcccgtcaggttcagtgccagtccaggtggtgggccggagtccactctcaccattagcgacctggccggcctgaacgtattctgctaacttatttctgtcagcagtatcatagtcgtccccgttntacgttttcggccgtacgggggaccaaggtcgtaggaaacttacgaaacggtaactggtggctgccacgatctgtccttcacttccttcccgacctactctgattac

SEQ ID NO: 192543 - DNA, 419 bp, Homo sapiens
  misc_feature: GYAE6OF02FWI57.44.23.C01.1.454.CMB.1.raw
  modified_base (417)..(419): a, c, t, g, unknown or other
  misc_feature (417)..(419): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacagcggccctgggctgcctggtcaaggactacttccacgtctactgctgagcgggctggcaaggcgcatagnnn

SEQ ID NO: 192544 - DNA, 219 bp, Homo sapiens; identical to SEQ ID NO: 192143
  misc_feature: GYAE6OF02FVUG2.44.23.C01.1.454.CMB.1.raw
  modified_base (218)..(219): a, c, t, g, unknown or other
  misc_feature (218)..(219): n is a, c, g, or t

SEQ ID NO: 192545 - DNA, 513 bp, Homo sapiens
  misc_feature: GYAE6OF02GW82M.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (392)..(392): a, c, t, g, unknown or other
  misc_feature (392)..(392): n is a, c, g, or t
  modified_base (486)..(486): a, c, t, g, unknown or other
  misc_feature (486)..(486): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacaaaaagggggnaggcccctaaggtcctcgtctctcgtgaaaccagactggaaggtagagtccgtccaggttcagtgccagtccaggtggtgggccggagtccactctcacattagcgacctgcggcctgaagnttctgctaacttatttctgtcagcagtatcatagtcgcccgttcacttttggcctaggggaccaagctaggaatcaaacgactgtgctgcaccntctgtcttcatcttcccgcatctgata

SEQ ID NO: 192546 - DNA, 571 bp, Homo sapiens
  misc_feature: GYAE6OF02G80YF.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (466)..(466): a, c, t, g, unknown or other
  misc_feature (466)..(466): n is a, c, g, or t
  modified_base (527)..(527): a, c, t, g, unknown or other
  misc_feature (527)..(527): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaaacgaaaaagggggnaggccctaaggtcctgtctctcgtgaaaccngactggaagtagacgtcccgtcaggttcagtgccagtccagggtcggtgggccggagtccacttctcgaccattacggcaccgtggccggtcctagaagtactttctgacctaactttatttcttgtcagccagttactcaagttacgtcgcccccgtttntaccgttttgggaccgaggggaccaagcgtaggaaactcaaaacgtactgtgctgccaccnttcctgttccttactacttcccttcccgcctatctacgattaac

SEQ ID NO: 192547 - DNA, 230 bp, Homo sapiens
  misc_feature: GYAE6OF02II2EJ.44.23.C01.1.454.CMB.1.raw
  modified_base (217)..(230): a, c, t, g, unknown or other
  misc_feature (217)..(230): n is a, c, g, or t
tcagacagtatatacacgaccggtgctcgatttagtacacgtgattagggagttgggggaagaggaagactgacggtcctcccaggagttcaggtgctgggcaccttgggcacggggaggtgtgtcacaagatttgggctctgggcacagcggccctgggctgcctggtcaaggctacttcctatatactgtctgagcggctggcaaggcgcatagnnnnnnnnnnnnnn

SEQ ID NO: 192548 - DNA, 427 bp, Homo sapiens
  misc_feature: GYAE6OF02F050O.44.23.C01.1.454.CMB.1.raw
  modified_base (419)..(427): a, c, t, g, unknown or other
  misc_feature (419)..(427): n is a, c, g, or t
tcagacagtatatacacgaccggtgctcgatttagtacacgtgattagggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccaggggaaccctggtcaccgtctcctcagcctccaccaagggccccatcggtcttccccctggcacccctcctccaagacgcacctctgggggcacagcggccctgggctgcctggtcaaggctactccacgtctactgctgagcgggctggcaaggcgcatagnnnnnnnnn

SEQ ID NO: 192549 - DNA, 669 bp, Homo sapiens
  misc_feature: GYAE6OF02IZ3XV.44.23.C01.1.454.CMB.1.raw
  modified_base (239)..(239): a, c, t, g, unknown or other
  misc_feature (239)..(239): n is a, c, g, or t
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttcctgtcttcttctgttgaggcagcgtcaccatcacttgccgggcgagtcaggttcgtttcggngctgttgccttggtttccaaacgaaaaagggggnaacggcccctaaaggtccctcgtctcgtcgtagaaacccngactggaaggtgacgtcccgtcaggttcagtgccagtccaggtggtcggccgtagtccactctcaccagttacgcgacctggccgtcctgaacgtnttcgtgtcaacttactttctgtctacgctagtactcacgtacgtcgtcccgttactacgttttcggaccgtacgggtacctaacggtctacgggtaaactccgtaaaaccggtacgttacggtacgggtaccgttacggtaccgtaaccgtaacgtttacccggttacggtttacccgtttaccggttaaccgtttaccccggtttaaccccggtacccgttaaccgtttacccggtttacggtaaccgttttaaaccgg

SEQ ID NO: 192550 - DNA, 607 bp, Homo sapiens
  misc_feature: GYAE6OF02G8HCI.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (395)..(395): a, c, t, g, unknown or other
  misc_feature (395)..(395): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaaccagactggaaggtagagtcccgtcaggttcagtgccagtccaggtggtgggccggagtccactctcaccattagcgacctgccggctgaagtnttctgctaactttatttctgtcagctagtactctattagtcgtccccgtttctaccgtttttcgggacccgtaacgggggtacccaaggtccgttaagggaaaacttaccgaaaaaccggtaacgttggttacgggccttgaccacccgtaattccttacggttcctttacctacttcccgtttccccgacctacttccgtagtaacttaac

SEQ ID NO: 192551 - DNA, 544 bp, Homo sapiens
  misc_feature: GYAE6OF02FV2JW.44.23.C01.1.454.CMB.1.raw
  modified_base (270)..(270): a, c, t, g, unknown or other
  misc_feature (270)..(270): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggnaggcccctaaggtcctcgtctctcgtgaaaccagactggaaggtagagtcccgtccaggttcagtgccagtccaggtggtgggccggagtccactctcacattgcgacctgcgctgaagnttctgctaacttatttctgtcagcagtatcatacgtcgtccccgttntaccgttttggcccgtaggggacccaagtccgtaggaaactaccgaaaacgtacgtgtacggctggccacgatctcgtcttcattccttcccgcctactctgtatac

SEQ ID NO: 192552 - DNA, 423 bp, Homo sapiens
  misc_feature: GYAE6OF02JGUW5.44.23.C01.1.454.CMB.1.raw
  modified_base (418)..(423): a, c, t, g, unknown or other
  misc_feature (418)..(423): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacgagcggccctgggctgcctggtcaaggactacttcctatatactgtctgagcgggctggcaaggcgcatagnnnnnn

SEQ ID NO: 192553 - DNA, 517 bp, Homo sapiens
  misc_feature: GYAE6OF02JB8GI.44.23.C01.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaagggggnaggcccctaaggtcctcgtctctcgtgaaaccngactggaaggtagagtcccgtcaggttcagtgccagtccagggtggtcggccggagtccactctcacattcgcgacctgcggcctgaagnttcngcaacttatttctgtcagcagtatcattagtcgcccgttctacttttggccgagggaccaagcgtaggaactcgaaacgtactgtgctgcacatctgtcttcattcctccgcatctgatac

SEQ ID NO: 192554 - DNA, 564 bp, Homo sapiens
  misc_feature: GYAE6OF02I7CDL.44.23.C01.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttcctgtcttcttctgttggaggcagcgtcaccatcacttgccgggcagtcaggtcgttttcggngctgttgccttggtttcaaacgaaaaagggggnacggcccctaaggtcctcgtctctcgtagaaaccngactggaaggtagacgtcccgtcaggttcagtcgccagtccaggtggtggccgagtccactcgtcacgattacgcgacctggccggcctaggaaacgtacttcgtgactaactttactttctgtacagtcagtatctatacgtcgtcccgttctacgtttcggaccgaggggtaccaaggtctaggtaaactcgaaacgtacgtgtaggctgacacgactctgtcttcacttccttcccgactactcgtagtattac

SEQ ID NO: 192555 - DNA, 516 bp, Homo sapiens
  misc_feature: GYAE6OF02IUTO8.44.23.C01.1.454.CMB.1.raw
  modified_base (273)..(273): a, c, t, g, unknown or other
  misc_feature (273)..(273): n is a, c, g, or t
  modified_base (512)..(512): a, c, t, g, unknown or other
  misc_feature (512)..(512): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccgaggtgccagatgtgacatccagatgacccagtctccatcctccctgtctgcatctgtcggagacagagtcaccatcacttgccgggcaagtcagagcattaggaactctttaaatggtatcagcagaggccagggaancccctcaactcctgatctatgctgcgtcctattttgactaaaggtcgggtcccatcgaaaggttcaggtggcaggtggatcgtgggacagattttcactctcaccatcagcagtctagcaactgaagtatttcgctacgtctttaattattgtacaacagtagtcaactaatactcccgactcgactttcggcggtaggacctattcgtggtagtactacgaaacgtaacgtgtacggntacg

SEQ ID NO: 192556 - DNA, 630 bp, Homo sapiens
  misc_feature: GYAE6OF02G0JRJ.44.23.C01.1.454.CMB.1.raw
  modified_base (272)..(272): a, c, t, g, unknown or other
  misc_feature (272)..(272): n is a, c, g, or t
  modified_base (393)..(393): a, c, t, g, unknown or other
  misc_feature (393)..(393): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggngaggcccctaaggtcctcgtctctcgtgaaaccagactggaaggtagagtcccgtcaggttcagtgccagtccaggtggtggggccgagtccactctcacattgcgactgcggcctgaagnttctgctaacttatttctgtcagctagtatctatacgtcgtccccgttctaccgttttcggccgtacgggggtaacccaacggtaccgttagggtaaaacttaccgaaaacggtaaccttaggttacgggaccgttacggacctaaccccgtaagtttccttacggttaccctttaccgtacctttacccgttttcccccggtacccgttaacgttcccgttaggtaacctttaacg

SEQ ID NO: 192557 - DNA, 154 bp, Homo sapiens
  misc_feature: GYAE6OF02II0SY.44.23.C01.1.454.CMB.1.raw
  modified_base (133)..(135): a, c, t, g, unknown or other
  misc_feature (133)..(135): n is a, c, g, or t
  modified_base (142)..(154): a, c, t, g, unknown or other
  misc_feature (142)..(154): n is a, c, g, or t
tcagacagtatatacacgaccggtgctcgatttagtacacgtgattagggagttgggtcacgagcggccctgggctgcctggtcaggactacttcacgtctactgctgtagcggctggcaaggcgctataggnnngcctgcnnnnnnnnnnnnn

SEQ ID NO: 192558 - DNA, 526 bp, Homo sapiens
  misc_feature: GYAE6OF02F7WZL.44.23.C01.1.454.CMB.1.raw
  modified_base (270)..(270): a, c, t, g, unknown or other
  misc_feature (270)..(270): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggngaggcccctaaggtcctcgtctctcgtgaaaccagactggaaggtagagtcccgtcaggttcagtgccagtccaggtggtgggccggagtccactctcaccattagcgacctgcggcctgaagattctgctaacttatttctgtcagcagtatcatagtcgtccccgttctacttttgggccctaggggaccaagctaggaactacgaaacgactgtgctgcaccatctgtcttcatcttcccgcctatctgatac

SEQ ID NO: 192559 - DNA, 532 bp, Homo sapiens
  misc_feature: GYAE6OF02HBK19.44.23.C01.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggnaggcccctaaggtcctcgtctctcgtgaaaccngactggaaggtagagtcccgtcaggtcagtgcagtccagggtggtgggccgagtccactctcacattagcgacctgcggcctgaagtnttcngactaacttatttctgtcagctagtatctatagtcgtcccgttctacgttttcggccgtaaggggaccaagtcgtaggaaactacgaaacgactgtcgctgcaccatctgtcttcatccttccgctactctgataac

SEQ ID NO: 192560 - DNA, 626 bp, Homo sapiens
  misc_feature: GYAE6OF02FUWBO.44.23.C01.1.454.CMB.1.raw
  modified_base (326)..(326): a, c, t, g, unknown or other
  misc_feature (326)..(326): n is a, c, g, or t
tcagacagtatatacacgaccggtgctcgatttagtacacgtgattagggattgggggagttcgagaccctgtcagggacagcatggacatgagggtccccgctcagctcctgggctcctgctgctctggctccaggttcgagatgtagacatcgagatgacccagtctccttccttcctgtcttcttctgttggaggcagccgtcaccatcacttggccgggcgagtcaggttcgttttcggtgcgttgttcgccgttggtttccaaacgtaaaaagggggacgtagggaccccctaaaggtccctcgtctctcgtacgaaaccngactggaagtagacgtcccgtcaggttcagtgccagtccaggtggtcgggccggagtccgactcgtacaccgtagttacgccgtaacctgccggtcctaggaaagtcgttcgtcgtactaactttatttcgtagtcgagtctaagtacttacgtattagttcgtccccgttacgtacgttttcggaccgtaaggggacctaagtccgtaggtaacttacgaaacgtacgtacggtaggctagaccaacgattccgtacgttcttacctacgttccttcccgtacctactctagtattacg

SEQ ID NO: 192561 - DNA, 582 bp, Homo sapiens
  misc_feature: GYAE6OF02HBVSL.44.23.C01.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccngactggaaggtgagtcccgtcaggttcagtgccagtccaggtggtgggccggagtccactctcaccattacgcgacctgcggcctgaagattctgctaactttatttctgtcagcagtatcatacgtcgccccgttntacttttggacccgtaagggggacccaaggccttagggaaaacttccgaaaaacggtactggtacggcttacggccaacccgtattccttggttcccttcgactttcccgttaccccgccctattccgttagtacttaac

SEQ ID NO: 192562 - DNA, 513 bp, Homo sapiens
  misc_feature: GYAE6OF02FH69G.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
  modified_base (486)..(486): a, c, t, g, unknown or other
  misc_feature (486)..(486): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggnaggcccctaaggtcctcgtctctcgtgaaaccagactggaaggtagagtcccgtcaggttcagtgccagtccaggtggtgggccggagtccactctcaccattagcgacctgcggcctgaagnttctgcaacttatttctgtcagcagtatcatagtcgccccgttnacgttttggccaggggaccaagctggaatcaaacgactgtgctgcacntctgtcttcatcttccgccatctgata

SEQ ID NO: 192563 - DNA, 228 bp, Homo sapiens
  misc_feature: GYAE6OF02GLT14.44.23.C01.1.454.CMB.1.raw
  modified_base (219)..(228): a, c, t, g, unknown or other
  misc_feature (219)..(228): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnnnnnnn

SEQ ID NO: 192564 - DNA, 553 bp, Homo sapiens
  misc_feature: GYAE6OF02FKZF1.44.23.C01.1.454.CMB.1.raw
  modified_base (315)..(315): a, c, t, g, unknown or other
  misc_feature (315)..(315): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagngtggagtcccagccaggttcagcggcagtggttctgggacacatttcactctcaccatcagcagcctgcagcctggacgtatttcgcgtacttattactgacctaacaattatttaccttttttattcccgttaacttacggtttttcggaccgtaacgggggacctaaggtcgttaggagatacgaaaggacgtaggtaggcttagccacacttctagttctttcattccttccccg

SEQ ID NO: 192565 - DNA, 520 bp, Homo sapiens
  misc_feature: GYAE6OF02GUOAM.44.23.C01.1.454.CMB.1.raw
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (491)..(491): a, c, t, g, unknown or other
  misc_feature (491)..(491): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggnaggcccctaaggtcctcgtctctcgtgaaaccagactggaaggtagagtcccgtcaggttcagtgccagtccagggtggtgggccggagtccactctcaccattagcgacctgcggcctgaagnttctgcaacttatttctgtcagcagtatcatagtcgtccccgttctacttttcggccaggggaccaagctaggaatcaaacgactgtggctgcaccntctgtcttcatccttccgcctatctgata

SEQ ID NO: 192566 - DNA, 435 bp, Homo sapiens
  misc_feature: GYAE6OF02IO9SN.44.23.C01.1.454.CMB.1.raw
  modified_base (425)..(435): a, c, t, g, unknown or other
  misc_feature (425)..(435): n is a, c, g, or t
tcagacagtatatacacgaccggtgctcgatttagtacacgtgattagggattggggaagtcagccataatggaagcaccagctataacccgtccctcaagagtcgactcaccatctccgtcgacacttccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatccggtcttccccctggccacccctcctccaagacgccaccctcgtgggggccacagcggccctgggctgcctggtcaaggactacttcctcgatcgcgtctgagcgggctggcaaggcgcatagnnnnnnnnnnn

SEQ ID NO: 192567 - DNA, 529 bp, Homo sapiens
  misc_feature: GYAE6OF02GPCJQ.44.23.C01.1.454.CMB.1.raw
  modified_base (270)..(270): a, c, t, g, unknown or other
  misc_feature (270)..(270): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
  modified_base (468)..(468): a, c, t, g, unknown or other
  misc_feature (468)..(468): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacaaaagggggngaggcccctaaggtcctcgtctctcgtagaaaccagactggaaggtagacgtcccgtcaggttcagtgccagtccaggtggtgggccggagtccactctcacattagcgacctgcggctgaagnttctgctaacttatttctgtcagcagtatcatacgtgccccgttnaccgttttggccaggggaccaagctgganatacaaacgactgtgctgccaccatctagttcttacacttccttacccgctactctgtaac

SEQ ID NO: 192568 - DNA, 591 bp, Homo sapiens
  misc_feature: GYAE6OF02F0X84.44.23.C01.1.454.CMB.1.raw
  modified_base (188)..(188): a, c, t, g, unknown or other
  misc_feature (188)..(188): n is a, c, g, or t
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggagttagggggaggtcaggaccgtgtcaggggacaggcatggacatgaggtcccgctcagctcctcgggctcctgctgctctggctcccaggttcgagatcgtgacatcgagatgacaagtctcttcttctgtcttctntgttggaggcagcgtcaccatcacttgccgggcgagtcaggttcgtttcggngactgttgaccttggtttcaaacgaaaaggggnaggaccctaaggcctggtctctcgtgaaaccagactaggaagtagagtccgtacaggttcagtgcagtccaggtggtcggcgagtccatctcaccattacgcgtacctggccgacgtcgaagtnttacgtagactaacgttatttctggttacagactaggtatacgtagtagtcgtacccgtttctacgttttcgaccgtagggaaccagcgttaaggaacttacgaaactaacgttgtacggtacgttgacgaccgtagtacttggtaccgttactaacgtcctttacccggaccgtaacttcgtcgaccgttaac

SEQ ID NO: 192569 - DNA, 592 bp, Homo sapiens
  misc_feature: GYAE6OF02ICZGI.44.23.C01.1.454.CMB.1.raw
  modified_base (271)..(271): a, c, t, g, unknown or other
  misc_feature (271)..(271): n is a, c, g, or t
  modified_base (450)..(450): a, c, t, g, unknown or other
  misc_feature (450)..(450): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcactatcacttgccgggcgagtcaggtcgttttcggtgctgttgcctggtttcaacgaaaagggggnacggcccctaaggtcctcgtctctcgtagaaccagactggaaggtagagtcccgtcaggttcagtgccagtccaggtggtgggccggagtccactctcaccatacgcgacctgccggcctgaacgtattctgctaactttatttctgtcagtctagtatcaatacgtcgcccccgtttntaccgttttcggccgaacggggaccctaaggtccttaagggaaacttccgaaaaccgtacgtggtaggcctagacctaccgtagttcctacgttcctttaccgactttcccgttcccgaccttacgttccttagactttacg

SEQ ID NO: 192570 - DNA, 530 bp, Homo sapiens
  misc_feature: GYAE6OF02GVYNE.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggnaggcccctaaggtcctcgtctctcgtgaaaccngactggaaggtagagtcccgtcaggttcagtgccagtccaggtggtgggccggagtccactctcaccattacgcgacctgcggcctgaagtnttctgctaacttntttctgtcagcagtatcatagtcgtccccgttntacttttggcctaggggaccaagtctaggaactacaaacgtactgtcggctgcacntctgtcttcattccttccgcctatctgattac

SEQ ID NO: 192571 - DNA, 610 bp, Homo sapiens
  misc_feature: GYAE6OF02GKKMR.44.23.C01.1.454.CMB.1.raw
  modified_base (268)..(268): a, c, t, g, unknown or other
  misc_feature (268)..(268): n is a, c, g, or t
  modified_base (392)..(392): a, c, t, g, unknown or other
  misc_feature (392)..(392): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggtgctgttgcctggtttcaacaaaaggggnaggcccctaaggtcctcgtctctcgtgaaaccagactggaagtagagtcccgtcaggttcagtgccagtccgaggtggtcgggccggagtccactctcaccattagcgacctgcggctgaagtntctgctaacttatttctgtcagtacagtatcatacgtcgcccgttctacgttttcggaccgtacggggacccaagtaccgttagggtaaacttaccgaaaacgtaaaccttaggtacgggtactacggaccaacccgtacgttaccgttacggttcctttaccgtaagtttacccctttccccggaccccgtaacttcccgttacggtaactttaacg

SEQ ID NO: 192572 - DNA, 541 bp, Homo sapiens
  misc_feature: GYAE6OF02FO89U.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggngaggcccctaaggtcctcgtctctcgtgaaaccagactggaaggtagagtcccgtcaggttcagtgccagtccaggtggtgggccggagtccactctcaccattagcgacctgcggcctgaagnttcngctaacttatttctgtcagcagtatcatagtcgccccgttntacttttcggcctaggggaccaaggcttaggaaacttcgaaaacgtacgtgtacggctgcacctatctgtcttcacttccttcccgcctatctagattaac

SEQ ID NO: 192573 - DNA, 563 bp, Homo sapiens
  misc_feature: GYAE6OF02ITO82.44.23.C01.1.454.CMB.1.raw
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngacggcccctaaggtcctcgtctctcgtagaaaccngactggaaggtagacgtcccgtcaggttcagtcgccagtccgagggtggtggggccggagtcccactctcaccattagcgacctggcggcctgaagtnttctgactaacttactttctgtcagcagtatnattacgtcgtcccgttctaccttttcgggaccgtaggggacccaaggtctaggaaactaccaaaacgactagtggctgacctaccgtatctgttcttctacttccttcccgcctactcttgattac

SEQ ID NO: 192574 - DNA, 540 bp, Homo sapiens
  misc_feature: GYAE6OF02HSKCH.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggcccctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggagaggcccctaaggtcctcgtctctcgtgaaaccagactggaagtagagtcccgtcaggttcagtgccagtccaggtggtgggccggagtccactctcaccattagcgactgcggcctgaagtattctgctaactttatttctgtcagcagtatcattagtcgtccccgtttctacgttttcggccgtaggggaccaaggcgtagggtaaatacgaaacgtaactgtgctgcactactctgtctctactccttcccgctactctgatata

SEQ ID NO: 192575 - DNA, 221 bp, Homo sapiens; identical to SEQ ID NO: 192155
  misc_feature: GYAE6OF02GFHMF.44.23.C01.1.454.CMB.1.raw
  modified_base (219)..(221): a, c, t, g, unknown or other
  misc_feature (219)..(221): n is a, c, g, or t

SEQ ID NO: 192576 - DNA, 426 bp, Homo sapiens
  misc_feature: GYAE6OF02ISYII.44.23.C01.1.454.CMB.1.raw
  modified_base (416)..(426): a, c, t, g, unknown or other
  misc_feature (416)..(426): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccagggggaccgcggtcaccgtctcctcagcctcaccaagggcccatcggtcttccccctggccaccctcctccaagagcacctcgtggggcacagcggcctggctgcctggtcaaggactacttccacgtctactgctgagcgggctggcaaggcgcatagnnnnnnnnnnn

SEQ ID NO: 192577 - DNA, 422 bp, Homo sapiens
  misc_feature: GYAE6OF02GF34F.44.23.C01.1.454.CMB.1.raw
  modified_base (414)..(422): a, c, t, g, unknown or other
  misc_feature (414)..(422): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggactctggggccaggggaccgcggtcaccgtctcctcagcctccaccaagggcccatcggtcttccccctggcaccctcctccaagagcacctctggggcacagcggccctggctgcctggtcaaggactacttccacgtctactgctgagcgggctggcaaggcgcatagnnnnnnnnn

SEQ ID NO: 192578 - DNA, 519 bp, Homo sapiens
  misc_feature: GYAE6OF02HOTXO.44.23.C01.1.454.CMB.1.raw
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtagaaaccagactggaaggtagacgtcccgtcaggttcagtgccagtccagggtggtgggccgagtccactctcacattacgcgacctgcggcctgaagnttcngctaactttatttctgtcagcagtatcatagtctcccgttnacttttggccgagggaccagctaggaatcaaacgatgtgctgccacatctgtcttcattcctcccgctatctgtataa

SEQ ID NO: 192579 - DNA, 565 bp, Homo sapiens
  misc_feature: GYAE6OF02H64F1.44.23.C01.1.454.CMB.1.raw
  modified_base (275)..(275): a, c, t, g, unknown or other
  misc_feature (275)..(275): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (453)..(453): a, c, t, g, unknown or other
  misc_feature (453)..(453): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaaacgaaaaagggggnacggcccctaaggtcctcgtctctcgtagaaaccagactggaaggtagacgtcccgtcaggttcagtgccagtccagggtggtgggccggagtccactcncaccattacgcgacctgcggcctgaagtnttctgactaactttattctgtcagcagtatctatagtcgtccccgtttntacgttttcggaccgtacggggaccaaggtcgtaggaaacttaccgaaaacgtaacgttggtaggcctagccacctatcctgtccttcacttcctcccgctactctcgatac

SEQ ID NO: 192580 - DNA, 688 bp, Homo sapiens
  misc_feature: GYAE6OF02IE2SR.44.23.C01.1.454.CMB.1.raw
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggattggggagtcagaccctgtcaggggacagcatggacatgaggtcccgctcagctcctgggctcctgctgctctggctcccaggttcgagatgtgacatcgagatgacccagtctccttccttcctgtcttctctgttggagtcagcgtcaccatcacttgccgggcgagtcgaggtcgttttcggngcttgttgccttggtttacaaacgaaaaagggggtnaggacccctaaggtcctcgtctcgtcgtacgaaaccagacgtaggaaggtagacgtcccgtcgagttccgagtcgccgtagtccgagggtgggttcggggaccggtacggtccacgtcctcaacctacgtagccgaacctcggcggtcctagaagtactttcgcggtactaaaccttttatttacctggtactagaccgtagttacactaagttactccgggtccccctttagtacgttttcgggaccgaacggggtaaccaaacggtcttaaacgggaaattacccgtaaaaacggtaacttcgggtaggtccgtacggaaccaccccggtaaatttccgttaggtttccctttaacccgtacgtttaccccgttccccccgacgttaactttaccgttaggtaacccttaaag

SEQ ID NO: 192581 - DNA, 534 bp, Homo sapiens
  misc_feature: GYAE6OF02HIEAP.44.23.C01.1.454.CMB.1.raw
  modified_base (271)..(271): a, c, t, g, unknown or other
  misc_feature (271)..(271): n is a, c, g, or t
  modified_base (447)..(447): a, c, t, g, unknown or other
  misc_feature (447)..(447): n is a, c, g, or t
  modified_base (505)..(505): a, c, t, g, unknown or other
  misc_feature (505)..(505): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnacggcccctaaggtcctcgtctctcgtagaaaccagactggaaggtagacgtcccgtcaggttcagtgccagtccagggtggtgggccggagtccactctcaccattacgcgacctgccggcctgaagtattcgtgactaactttatttctgtcagcagtatcatagtcgcccttntacttttcggccgtaggggaccaagctaggaactacgaaacgactgtcgctgacacgntctgtcttcattcctccgctatctgatac

SEQ ID NO: 192582 - DNA, 559 bp, Homo sapiens
  misc_feature: GYAE6OF02JCJ9P.44.23.C01.1.454.CMB.1.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
  modified_base (441)..(441): a, c, t, g, unknown or other
  misc_feature (441)..(441): n is a, c, g, or t
tcagacagtatatacacgaccggtgctcgatttagtacacgtgattagggattgggggagtcagaccctgtcaggggacagcatggacggatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggttcaacgaaaagggggnaggcccctaaggtcctcgtctctcgtagaaaccagactggaaggtagacgtcccgtcaggttcagtgccagtccaggtggtgggccgagtccactctcaccattacgcgactgcggctgaacgtnttctgactaacttattctgtcagcagtatcatagtcgccccgttntacgtttggcctaggggaccaagtcgtaggaaactacgaaacgtactggtacgctcgaccaccgtatccttcgttccttacgtacttcccgttacccgccttactcctagtattaacg

SEQ ID NO: 192583 - DNA, 608 bp, Homo sapiens
  misc_feature: GYAE6OF02IHK8A.44.23.C01.1.454.CMB.1.raw
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaagggggngacggcccctaaggtcctcgtctctcgtagaaaccngactgggaaggtgacgtcccgtaccaggttcagtcgccagtccaggtggnggccgagtccactctcacctattacgcgtacctggcggcctgaacgtntttctgactaactttatttctgtcagcagttanactaattagtcgtccccgtttctaccgttttcggccgtaaggggaaccctaagtacgtaggaaactccgaaaacgtacgttaggtcggtctaggacctaaccgtattccgtagttacctttaccaacgtttcccttcccggtacccttagtccgttaggtaccttaacg

SEQ ID NO: 192584 - DNA, 730 bp, Homo sapiens
  misc_feature: GYAE6OF02H6D52.44.23.C01.1.454.CMB.1.raw
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgcttgttgccttggttacaaacgaaaaagggggnacggccctaaggtcctcgtactcgtcgtacgaaaccagtactgggaaggtagacgttcccgtccaggtttccagtcgccctaaggtcccgaggggtcgggtcgggccggtacgtcctacgtctctaacctattacggccgtaccttggccggtccttagaaacggtactttcgtcggtaccttaacttttactttacgttggtacctaaggtacgtaacgttaagtacctaagtttacggtcgtacccccggttttacgtaacgtttttaccgggacccgttaaacgggggacccgtaaagtacccgttaaggtaaaaccgttaaccgaaaaccgtaacgttacgggtacggtaccgtacggtacctaacccgtaacgttaccgtttcggttaccctttaccgtaacgtttccccgttaccccgacccttaacgtttccgttacgtaactttaacg

SEQ ID NO: 192585 - DNA, 542 bp, Homo sapiens
  misc_feature: GYAE6OF02JI5D4.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaaccngactggaaggtagagtcccgtcaggttcagtgccagtccaggtggtgggccgagtccatctcaccattagcgacctgcggcctgaagnttctgcaacttatttctgtcagcagtatcatagtcgtcccgttctacgttttggccgtaggggacccaagtcgtaggaaactacgaaaacgtaactgtcggctgacaccgtatctgtcttctactccttcccggcctactctgtataacg

SEQ ID NO: 192586 - DNA, 553 bp, Homo sapiens
  misc_feature: GYAE6OF02HQ6MR.44.23.C01.1.454.CMB.1.raw
  modified_base (272)..(272): a, c, t, g, unknown or other
  misc_feature (272)..(272): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaaagggggngaggacccctaaggtcctcgtctctcgtagaaaccagactggaaggtagacgtcccgtccaggttcagtcgccagtccagggtggtggggccggagtccactctcaccattagcgacctgcgcctgagattcngctaaactttnttctgtcagtcagtatcatagtcgtcccctttntaccttttcggccgaaggggaccagtctaggaaacttacaaacgtactggtggcctagaccaccaatctgtcttcacttccttcccgctacttctagtataacg

SEQ ID NO: 192587 - DNA, 568 bp, Homo sapiens
  misc_feature: GYAE6OF02G7GZ5.44.23.C01.1.454.CMB.1.raw
  modified_base (271)..(271): a, c, t, g, unknown or other
  misc_feature (271)..(271): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacgaaaagggggngaggcccctaaggtcctcgtctctcgtgaaaccagactggaaggtagagtcccgtcaggttcagtgccagtccaggtggtgggccggagtccactctcaccattagcgacctgcggcctgaagnttcngctaacttntttctgtcagctagtatcatagtcgtccccgttctacgttttcggacccgtaggggaccctaaggtctagggaaactaccgaaaacgtactaggtcggacttcgacaccctattccgtcgttccttcctattccttccccgcctactcgttagtattaac

SEQ ID NO: 192588 - DNA, 644 bp, Homo sapiens
  misc_feature: GYAE6OF02G1NTA.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggtgctgttgtccgttggtttacaaacgaaaaagggggagacggacccctaaggtcctcgtctctcgtagaaaccagacgtaggaaggtagacgtcccgtcaggttcagtcgccagtccgaggtggtggccggagtccactctcacctattacgcgacctgcggcctgaagtacttctgtactaacttttatttctgtcagtctagtactctatacgtccgtaccccgttctaccgttttcgggccgtaacggggaacctaaggtcgtacggtaaacgtaccgaaaacggtacttacggtacggtccgtacgaccgtaacccgtaacttcccgttacgtttacccgtttactaccgtttaccccgtttacccccgtaccttaacgtttccttacgtaatttaacg

SEQ ID NO: 192589 - DNA, 542 bp, Homo sapiens
  misc_feature: GYAE6OF02F0BDD.44.23.C01.1.454.CMB.1.raw
  modified_base (272)..(272): a, c, t, g, unknown or other
  misc_feature (272)..(272): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaccagactggaaggtagagtcccgtcaggttcagtgccagtccaggtggtgggccggagtccacgtcncaccattagcgacctgcgcctgaanattctgcaacttatttctgtcagcagtatcatagtcgtcccgttctacgtttttcggccgacggggacccaaggcctaggaaactaccgaaacgaactgtagctgaccaccgatctagtcttcattccttcccgcctatcctgataacg

SEQ ID NO: 192590 - DNA, 659 bp, Homo sapiens
  misc_feature: GYAE6OF02J2IOY.44.23.C01.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgtgcctggttcaacgaaaaggggnaggccctaaggtcctcgtctctcgtgaaccngactggaagtagagtcccgtcaggttcagtcgcacgtccagggtggtcgggccggagtcccgactctccacctagttacgccgaaccgttggccgggtccctaggaacgtactttccgtcggacctaaacttttactttacttacggttacctacggtacgtaagttactactaagttacgttccgtccccgtttacttaccgttttcgggacccgtaacggggtaacccaaggtaccgtaagggtaaacttaaccgaaaaccgtaacgttaggttacgggtactcggtacctaaccgttaacgtcttacggttccttacgtaacttcccgttcccgacctacttaccgtacgtacttaacg

SEQ ID NO: 192591 - DNA, 712 bp, Homo sapiens
  misc_feature: GYAE6OF02JE6WJ.44.23.C01.1.454.CMB.1.raw
  modified_base (238)..(238): a, c, t, g, unknown or other
  misc_feature (238)..(238): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggagttgggggagtcagaccctgtcaggggacagcatggacatgagggtccccgctcagctcctgggctcctgctgctctggctcccaggttcgagatgtgacatcgagatgaccaagtctccttccttcctgtcttcttctgttgaggcagcgtcaccatcacttgccggcagtcaggtcgttttcggngctgttgcctaggtttacaaacgtaaaaagggggnacggcccctaagggtcctcggtctctccgtacgaaacctagactggaagtagacgtcccgtacacggttcaggttcgccgtaggtcccagggtcggtcggggccgtagtcccacgttctacgacccgtagttacggaccgtacccgttggcccgggtacccttagggaaacgttctttccgacggtaccctaaacttttcgtttctcgtaccgtaacggacttaagttactacttaactaacggtttccgtaccccgtttacttaaccgtttttacgggacccgtaacgggggttacccctaaacggtccgttaacggtaaacgttaccgaaaaacgggtacttgggtacggtactacggtaccaacccgtagtttccgtacggtttccttacctaaccttcccgttacccgtcctaacgttccttacgtacttaaccg

SEQ ID NO: 192592 - DNA, 531 bp, Homo sapiens
  misc_feature: GYAE6OF02F13XF.44.23.C01.1.454.CMB.1.raw
  modified_base (269)..(269): a, c, t, g, unknown or other
  misc_feature (269)..(269): n is a, c, g, or t
  modified_base (392)..(392): a, c, t, g, unknown or other
  misc_feature (392)..(392): n is a, c, g, or t
  modified_base (438)..(438): a, c, t, g, unknown or other
  misc_feature (438)..(438): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacaaaagggggnaggcccctaaggtcctcgtctctcgtgaaaccagactggaaggtagagtcccgtccaggttcagtgccagtccaggtggtggccggagtccactctcaccattagcgacctgcggcctgaagnttctgctaacttatttctgtcagcagtatcatagtcgtccccgttnaccttttggcctaggggaccaaggctaggaaactcgaaacgactgtgctgacaccatctgtcttctactttcccgcctacttctgtatattac

SEQ ID NO: 192593 - DNA, 591 bp, Homo sapiens
  misc_feature: GYAE6OF02HEILM.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggactccggcacgccccgagggagggaatggaggtggagttggtgacatactattacgtacgtggggcgtacgtactactctccgtcctcaacgtagtccgtctcactatttcgagggtacacgtccatcgaaccgtcttcctacctagaaactcgtaccctcgcgaccgccgacggaccgtacggtccgtttacttcgtgtcgcgaggcgagacgtggttactttacaacttcgtaggtcggggtccgtcggcctacccggtggtaccaccgttcgttccttccgtcgtacgttccttacccgacccggtaacggtcccgtagttcccgg

SEQ ID NO: 192594 - DNA, 540 bp, Homo sapiens
  misc_feature: GYAE6OF02GZQ9T.44.23.C01.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnacggcccctaaggtcctcgtctctcgtgaaaccngactggaaggtagagtcccgtcaggttcagtgccagtccaggtggtgggccggagtccatctcaccattagcgacctgcggcctagaagnttctgcaacttatttctgtcagcagtatcaatacgtcgtcccgttctacttttggccaggggaccaagcgtaggtaaactacaaacgaactgtagctacgcactactctgtcttctacttccttcccgcctactctagtataac

SEQ ID NO: 192595 - DNA, 538 bp, Homo sapiens
  misc_feature: GYAE6OF02G4SDP.44.23.C01.1.454.CMB.1.raw
  modified_base (271)..(271): a, c, t, g, unknown or other
  misc_feature (271)..(271): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (533)..(533): a, c, t, g, unknown or other
  misc_feature (533)..(533): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagaggtcccgtccaggttcagtgccagtccagggtggtgggccggagtccactctcaccattacgcgacctgcggcctgaatntctgctaacttntttctgtcagctagtatcatagtcgccccgttntacgttttcggcctaaggggaccaggtctaggaaatcaaaacgactggtgtctgcacatctgtcttactacttccttcccgcctactctnattac

SEQ ID NO: 192596 - DNA, 593 bp, Homo sapiens
  misc_feature: GYAE6OF02HO0WL.44.23.C01.1.454.CMB.1.raw
  modified_base (271)..(271): a, c, t, g, unknown or other
  misc_feature (271)..(271): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgccttggtttcaacgaaaaagggggngaggcccctaaggtcctcgtctctcgtgaaaccagactggaaggtagagtcccgtccaggttcagtgccagtccaggtggtgggccggagtccactctcacattagcgacctgcggctgaagnttctgctaactttntttctgtcagctagtatacatagtcgtccccgttctaccgttttgggaccgtaggggaacccaaggtaccgttagggaaacttacgaaaaccgtaacgttagtacggctacgaccaacccgtaattccttagttccttacaaccgtttccttacccccggtcctaaccttcgttacgtaattaac

SEQ ID NO: 192597 - DNA, 612 bp, Homo sapiens
  misc_feature: GYAE6OF02HHKBY.44.23.C01.1.454.CMB.1.raw
  modified_base (196)..(196): a, c, t, g, unknown or other
  misc_feature (196)..(196): n is a, c, g, or t
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtccccgctcagctcctgggactcctgctgctctggctccagatactagatgtgacttccagatgacccagtctccatcctccctgtctgcatctgtggganacagagtcaccatcacttgccgggcgagtcaggttcgttttcggngctgttgccttggtttacaaagaaaaagggggngacggcccctaaggtcctcgtctctcgtgaaaccagacgtaggaaggtagacgtcccgtacgaggtttcagtgccaggtccaggtgggtgggccggagtccactctcacctattacgcgtaacctgcgacctgaacgtattcgtagacttaacttatttctgtactagactagttatactatagtcgtccccgttataccgttttcggccgtaacggggaacctaacggtacgttaacggaaaacttaccgaaaacgtacgtaggttaggaccgttaggaccctaactacgttacgttagttccttcgtaacttcccgtttccccgacttacttaccg

SEQ ID NO: 192598 - DNA, 541 bp, Homo sapiens
  misc_feature: GYAE6OF02F0YIM.44.23.C01.1.454.CMB.1.raw
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaaacgaaaaaggggagaggcccctaaggtcctcgtctctcgtagaaaccagactaggaaggtagacgtcccgtcaggttcagtgccagtccaggtggtcgggccggagtccactctcacatagcacctggcgcctagaagattctgactacttatttctgtcagctagtatctatagtcgtcccgttctacgttttcggaccgtagggaccaagactaggaatacaaacgtaacgtgagctgaccacatctcgtcttcactcctccgcctatctagtattaac

SEQ ID NO: 192599 - DNA, 622 bp, Homo sapiens
  misc_feature: GYAE6OF02HYE12.44.23.C01.1.454.CMB.1.raw
  modified_base (221)..(221): a, c, t, g, unknown or other
  misc_feature (221)..(221): n is a, c, g, or t
  modified_base (270)..(270): a, c, t, g, unknown or other
  misc_feature (270)..(270): n is a, c, g, or t
  modified_base (405)..(405): a, c, t, g, unknown or other
  misc_feature (405)..(405): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcttcctgtcttcttctgttggaggcagcgtcaccatcacttgccgggnagtcaggtcgttttcggtgctgttgcctggtttcaacgaaaaagggggnaggcccctaaggtcctcgtctctcgtagaaaccagactgggaaggtagagtcccgtcaggttcagtgccagtccagggtggtgggccggagtccgactctcaccattagccgacctgccggcctgaacgtattcngtactaaactttatttctgttcagctagttactactaagttagtccgtaccccgtttctaccgtttttcgggccgtaacgggggtaccaaggtcgttaacggaaactaccgaaaaccggtaaacttcggtaggtccgtacgacctaaccctaacgttcctacggttaccttacctacgttcccgttacccgcctaacgttacctaggtaattaaccg

SEQ ID NO: 192600 - DNA, 542 bp, Homo sapiens
  misc_feature: GYAE6OF02HORYH.44.23.C01.1.454.CMB.1.raw
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggtgctgttgcctggtttacaacgtaaaagggggnacggcccctaaggtcctcgtctctcgtagaaaccngactggaaggtagacgtcccgtcaggttcagtcgcagtccaggtggtggccggagtccatctcaccattagcgacctggccgcctagaagtcttctcgctaactttattctgtcagctagtatcagtagtcgtcccgttctactttcggccgtagggaccaagcgtagaactacgaaacgactgtgcgtgcaccgatctgttctacgtacttccttcccgcctagtctgattac

SEQ ID NO: 192601 - DNA, 519 bp, Homo sapiens
  misc_feature: GYAE6OF02HR6WC.44.23.C01.1.454.CMB.1.raw
  modified_base (271)..(271): a, c, t, g, unknown or other
  misc_feature (271)..(271): n is a, c, g, or t
  modified_base (358)..(358): a, c, t, g, unknown or other
  misc_feature (358)..(358): n is a, c, g, or t
  modified_base (497)..(497): a, c, t, g, unknown or other
  misc_feature (497)..(497): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccagactggaaggtagagtcccgtccaggttcagtgcagtccaggtggtgggccgngtccactctcacatagcgactgcgctgaagatctgcaacttattctgtcagctagtatcatagtcgtcccgttctacttttggcctacggggaccaagctaggaatacaaacgaactgtgctgacacatctgtcttacnttctcccgcctatctgtataac

SEQ ID NO: 192602 - DNA, 602 bp, Homo sapiens
  misc_feature: GYAE6OF02JCHHR.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (397)..(397): a, c, t, g, unknown or other
  misc_feature (397)..(397): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaaccagactggaaggtagacgtcccgtcaggttcagtgccagtccaggtggtgggccggagtccactctcacctattacgcgacctgcggcctgaactnttctgactaactttatttctgtcagctagtatcatacgtcgtccccgttcgtacgttttcgggccgtaacggggaccaacggtacgtagggaaactaccgaaaacgtaacgttaggtacgggtcctcggaccaccgtacttccgttcggttaccctttcgtaactttccctttacccggcccttacgttccttacgtaacttaac

SEQ ID NO: 192603 - DNA, 616 bp, Homo sapiens
  misc_feature: GYAE6OF02HXUAX.44.23.C01.1.454.CMB.1.raw
  modified_base (275)..(275): a, c, t, g, unknown or other
  misc_feature (275)..(275): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaacgaaaaagggggngacggcccctaaggtcctcgtctcgtcgtacgaaaccagacgtggaaggtagacgtcccgtcaggttcagtcgccagtccaggtggtgggccggagtccactctcacctatacgcgacctgccggctagaacgtnttcngtactaactttatttctgtcagcagtatcagtagtcgtccccgttctaccgttttcgggaccgtacgggggaacccaaggtcgtaggaaactacgtaaaaccgtacgtgtcggacttacggacctaacccgtattccgttaggttccctttaccgtacgtttcccgttaccccggtacctaccttaccgttagtactttaac

SEQ ID NO: 192604 - DNA, 544 bp, Homo sapiens
  misc_feature: GYAE6OF02F3FGQ.44.23.C01.1.454.CMB.1.raw
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
tcagacagtatatacacgaccggtgctcgatttagtacacgtgattagggattgggggagtcagaccctgtcaggggacagcatggacatgagggtccccgctcagctcctgggactcctgctgctctggctcccagataccagatgtgacatccagatgacccagtctccatcctccctgtctgcatctgtgggagacagagtcaccatcacttgccgggcgagtcagggcattagcaattatttagcctggtatcagcagaaacagggaaacctcctaacctcctgatctttgctgcatccactttgctaatcgagggtcccatcaaggttcgagcggnacgtggagtcgnggacagattcactctacactancgagacagcctgcacgcctagattgttatttgactaactttattactacgaccaaactagtaattaagtaagtttacttcgtactagttaggtttacggaccggtaaggggtaaccaaggtccgtaggaagtacgtaacgtaaacggtaacgtcggtagtaccgtacgg

SEQ ID NO: 192605 - DNA, 612 bp, Homo sapiens
  misc_feature: GYAE6OF02IV5XV.44.23.C01.1.454.CMB.1.raw
  modified_base (424)..(424): a, c, t, g, unknown or other
  misc_feature (424)..(424): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgaggttcgttttcggtgctgttcgccttggtttacaaacgaaaaggggagacggcccctaaggtcctcgtctctcgtagaaaccagacgtaggaaggtagacgtcccgtcgtaggttcagtcgccagtccgagggtcgggtgggccggtagtccactctcacctattacgcgaccgtggccggccttaggaaacgtntttctcgactaactttagtttctgtcacgtcaagtatctagtagtaccgtcccgttctacgttttcgggccgtacggggaccaaggcttaagggaacttacgaaacgtacgttggtacgacttcgacctacgtgttaccgtcgttacctcgtacttcccgttacccgtcctactcgtagtacttaacg

SEQ ID NO: 192606 - DNA, 423 bp, Homo sapiens
  misc_feature: GYAE6OF02HP7E3.44.23.C01.1.454.CMB.1.raw
  modified_base (417)..(423): a, c, t, g, unknown or other
  misc_feature (417)..(423): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctgggggcacagcggccctgggctgcctggtcaaggactacttccacgtctactgctgagcgggctggcaaggcgcatagnnnnnnn

SEQ ID NO: 192607 - DNA, 592 bp, Homo sapiens
  misc_feature: GYAE6OF02HYN6G.44.23.C01.1.454.CMB.1.raw
  modified_base (346)..(346): a, c, t, g, unknown or other
  misc_feature (346)..(346): n is a, c, g, or t
tcagacagtatatacacgaccggtgctcgatttagtacacgtgattagggattgggggagtcaggaccctgtcaggggacagcatggacatgagggtccccgctcagctcctggggctcctgctgctctggctcccaggttcgagatgtgacatcgagatgacccagtctccgtcctcactgtctgcgtctagttggggacagagtcaccatcacttgccgggcgagtgccgacattaggactttttggccttggtttcagcaggagctggcaaagcccctaagtccctgatcttttcaggactccactttgaagagtggatcccagccagttcagcgcagtgtcnggacatattcactctcaccatcagtcagcctgcagcctggagtagtttcgcgtacttacttacgtgaccaaataattattaccttttttatcccgttaattacggtttttacgggaccgtaacggggtaacctaaggtacgtagggtacgaacgttacgaaacgggtaacgttcggttacggacgttcggacctaaccgtaacgttccgttcggttaccttaccgttaccgttcctttacccccgg

SEQ ID NO: 192608 - DNA, 594 bp, Homo sapiens
  misc_feature: GYAE6OF02JGDTA.44.23.C01.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (520)..(522): a, c, t, g, unknown or other
  misc_feature (520)..(522): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (567)..(567): a, c, t, g, unknown or other
  misc_feature (567)..(567): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
tcagacagtatatacacgaccggtgctcgatttagtacacgtgattaggagttgggaagtcagccataatggaacgcacccagactactaacccgtcccttcaagtagtcgactcaccatctccgtcgacacgtccaagagacagatgttcccgtgagtctgtacgttctgtgaccgtcgcggacgcgctgtgtatttcngtgcgagaggcctggtaccgagcgagtcgtacgtctacgtacgtacctctcgtgacgtcgtgggccagggaccgcgtcaccgtctcctcgacnggcctacgacccaagggtccccatcccggagttcccccctaggtccaaccctcctccgaacgacgtcgaccggtctcgggggcaaccgacgtacggaccctaggggacccttgggacccttagggtacctaaaacgggtacctaacggtttcccaacggttcctaacgttgacgttacggaacgtccgggactggaccgaaggtacgacgatagcagacagcagacnnngananacanacacgacgagacgacgacgagagtagtagtagtganagagtagagagtgtagtgngtgtnacg

SEQ ID NO: 192609 - DNA, 689 bp, Homo sapiens
  misc_feature: GYAE6OF02I24TO.44.23.C01.1.454.CMB.1.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgtcttcttctgttggaggcagcgtcaccatcacttggccgggcagttcgaggttcgttttcgngctgttcgccttggttacaaacgaaaaggggngacggtacccctaaggtcctcgtctcgtcgtacgaaacccgagacgtaggtaacggtacgacggttccccgtaccgtaggttccaagttcgccgtacgtccgaggggtcggtcggggacccgtaggtcctacgtcctaccaccgtagttaccggccgtaccgtcgggccgtaccgtgaaagtctttaccgtacgaccttaacgtttactttcgtacgtacctacgtcttaacgtatacctagttaacgttccggtaccccgtttacttaccgttttacgggacccgttaacgggggaacctaacggtacgtaagtaaacctaacgaaaaccgtacgtaggtcgacgttacgaccaccgtacttccgttagtccttactccttacccgttccgacctacttctacgtactaacg

SEQ ID NO: 192610 - DNA, 657 bp, Homo sapiens
  misc_feature: GYAE6OF02I6JDU.44.23.C01.1.454.CMB.1.raw
  modified_base (243)..(243): a, c, t, g, unknown or other
  misc_feature (243)..(243): n is a, c, g, or t
tcagacagtatatacacgaccggtgctcgatttagtacacgtgattagggattgggggagtcagaccctgtcaggggacagcatggacatcgagggtccccgctcagctcctggggctcctgctgctctggctcccaggttcgagatgtgacatcgagatgacccagtctccttcctcctgtcttcttctgttggaggcagcgtcacctatcacttgccgggtcgagtcaggtcgttttcggngctgttgccttggttcaacgaaaggggagaggcccctaaggtcctcgtctctcgtcgaaaccgagacgtggaaggtaggacgtccccgtccgaggttccaggtcgccagtccgagggtgggtcggggccggagtccctacgtcgtcaccgtagttaggaccgtaccgtggccggtcctggaaacgtcttctgacctaatttacttcgtagtcagtacgtattacgtactattacggttccgtaccccgttattaccgttttcgggacccgtagggggaaccctaaggtccgttaagggaaacttacggaaaaccggttaaccgtaggtacggaccgttacgaccgtaaccctacgttccttagttcctttaccgtacgttcccttcccgtacctagtttcctaggtatttaacg

SEQ ID NO: 192611 - DNA, 597 bp, Homo sapiens
  misc_feature: GYAE6OF02FTK4O.44.23.C01.1.454.CMB.1.raw
  modified_base (397)..(397): a, c, t, g, unknown or other
  misc_feature (397)..(397): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggagaggcccctaaggtcctcgtctctcgtgaaaccagactggaaggtagacgtcccgtcaggttcagtgccagtccaggtggtgggccggagtccactctcacattacgcgacctgcggcctgaagnttctgctaacttatttctgtcagctagtatcatagtcgtccccgttctacgttttcggaccgtacggggacctaaggtcgtacggaaactccgaaaacgtacgtaggtacggctacgaccaaccgtattaccgttcggttaccctttaccgtacgtttccccgtttccccgacccttacgttccttacggtaactttaac

SEQ ID NO: 192612 - DNA, 603 bp, Homo sapiens
  misc_feature: GYAE6OF02H0W3C.44.23.C01.1.454.CMB.1.raw
  modified_base (222)..(222): a, c, t, g, unknown or other
  misc_feature (222)..(222): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggttcgttttcggtgcttgttgccttggtttacaaacgaaaaaggggagacggccctaaggtcctcgtctctcgtagaaccagactaggaaggtagacgtcccgtcaggttcagtcgacacgtcagggtggtgggcggacgtctattccncacctagtcggcgtacctggccgctagaagtcttctagactaactttatttctgtacacgtntagtatacatacgtccgtcccgttcgtacgttttcggaccgtaacggggtaaccaaggtcgtaaggtaaacttacgaaaacgtactaggtgacgttacgacctaccgtattccgttcgtaccttctaccgttccttacccggccttaacgtcctagtacttaa

SEQ ID NO: 192613 - DNA, 533 bp, Homo sapiens
  misc_feature: GYAE6OF02FHARQ.44.23.C01.1.454.CMB.1.raw
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
  modified_base (491)..(491): a, c, t, g, unknown or other
  misc_feature (491)..(491): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttcaacgtaaaaagggggngaggcccctaaggtcctcgtctctcgtgaaaccngactggaaggtagagtcccgcaggttcagtgccagtccaggtgtgggccggagtccactctcacgattagcgacctgcggcctgaagnttcngactaacttatttctgtcagcagtatcatagtcncccgttnctttggcaggggacaagctaggaaactcgaaacgactgtcgctgcacctnttcctgttccttcacttcctcccgatactcctagtattaacg

SEQ ID NO: 192614 - DNA, 642 bp, Homo sapiens
  misc_feature: GYAE6OF02GT1FL.44.23.C01.1.454.CMB.1.raw
  modified_base (474)..(474): a, c, t, g, unknown or other
  misc_feature (474)..(474): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgtcgttgttcgccgttgggttttaccaaaacggtaaaaaagggggggagaacgggacccccttaaagggtccctcgtcctctcgtacgaaacccaggactgggaaggtacgacgtcccgtcaggttcagtcgccagtccgagggtggcgggccggagtccactctcacctattagccgtaccgtggccggctagaagtcttcgtgactaactttatttctgtcagcaagtanactagttacgtcgtaccccgtttctaccgttttcggacccgtagggaaccctaagtcgtaaggaaacttaccgaaaaccgtacgtacggtacgctcgtacctaaccgtattccttacgttccttacctaccttacccgttcccgtacctactccgttgtaacttaacg

SEQ ID NO: 192615 - DNA, 630 bp, Homo sapiens
  misc_feature: GYAE6OF02GMV0O.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggttcaaacgaaaagggggnaggcccctaaggtcctcgtctctcgtagaaaccagactggaagtagagtcccgtcaggttcagtgccagtccaggtggtgggccgagtccactctcaccattagcgacctgccggcctgaacgtattctgctaacttatttctgtcagcagtatcatacgtcgtccccgttctaccgttttcgggacccgtaagggggaccctaaagggtccgttaagggtaaaacttaccgaaaaaccggtaacttagggttacgggaccttacggaccctaacccgtaattccgttcggtttacctttaccgaaccgttttccccgttaccccggtcccttaacgttcccgttacggtaattaaccg

SEQ ID NO: 192616 - DNA, 601 bp, Homo sapiens
  misc_feature: GYAE6OF02GPE13.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggttacaacgaaaagggggnacggcccctaaggtcctcgtctctcgtagaaaccngactggaaggtagacgtcccgtcaggttcagtcgccagtccagggtggtcggggccggagtccactctccaccagttacggcgtaaccgtggccggcctaggaaacgtatttcgtgacctaactttatttctgtcagtcagtatctaatgtcgtccccgttactacgttttcgggccgtaaggggaccaacggtcgtaggtaaactacgaaaacgtaactggtcggacttcgaccaccgtaattccgttacgttccttacgtacttcccttcccgactacgttctacgtattaacg

SEQ ID NO: 192617 - DNA, 724 bp, Homo sapiens
  misc_feature: GYAE6OF02IO12X.44.23.C01.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggtcgttttcggngctgtgccttggtttacaaaacggaaaaagggggngacggacccctaaggtcctcgtctctcgtagaaaaccagacgtagggaaggtagacgtcccggtcaagggtttcaggttcgacctacgtccgtaagggtggtcggggacccggtaggtcccaacttccgtaccaaccgtaagtttacgccgtaacctggaccgggtaccttaggaaacgtatttccgtgtaccgttaaactttaacgttttcctaggttaccaaggctaacggtacttactaagttaacgttccggtacccccgtttacttaccgtttttacgggacccgtaaaggggaaccctaaacgccgttaagggtaaaacttaccgaaaaacgtaaaccgttgggtacggtacttacggacgtaaccctacgtaccgtttcgttacccgtttactaccgtttaccccgtttaccccgacccttaagttccgttagttaattaac

SEQ ID NO: 192618 - DNA, 639 bp, Homo sapiens
  misc_feature: GYAE6OF02IJL2Y.44.23.C01.1.454.CMB.1.raw
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttcgtcctggttttacaaacgaaaaagggggagacggtaccccgtaaaggtccctcggttcctcgtcgtacgaaaaccaggaaccttaggggaaaggttagacgtccccggtaccaggttcagtcgccagtccagggttggtcgggccggtagtccacgtctcaaccagttacgcgacctgcggacctaggaagtcttctgtacctaactttatttctgtcgagctaagtatactaagtacgtcgttcccgttctaccgttttcggccgtaaggggacctaaggtctaggaaactaccgaaaacgtactaggtcgtaccgtcgactaaccgtattaccgtgttacttccgaacttcccgttccccggacctaacttacgttagtaattaacg

SEQ ID NO: 192619 - DNA, 567 bp, Homo sapiens
  misc_feature: GYAE6OF02GQRNV.44.23.C01.1.454.CMB.1.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (434)..(434): a, c, t, g, unknown or other
  misc_feature (434)..(434): n is a, c, g, or t
tcagacagtatatacacgaccggtgctcgatttagtacacgtgattagggattgggggagtcagaccctgtcaggggacagcatggacatgagggtccccgctcagctcctggggctcctgctactctggctccgaggtgccagatgtgacatccagatgacccagtctccttcctccctgtctgctttctataggagacagagtcgccatcacttgccgggcaagtcagaccattaacagctatttaaatggtatcagcagagaccgaagggaaacgcccctagaactcctagatctcngctgcctcactctgcaaggtgagtctctacgaaggtcagtggacaggtgatcgtggacagtattcactctacacctntcctcctagtctcgacctaaccgtgaacgttatttcgacttaaactttaactacgtntaccaacgttcgtaagtttacgtacttccgtcccgtttataccggttttacgggaccggggaacctaggtactagggaatcgtaacgtaacggtaacttggtagtccgtaggacctacgtattcctgttaccc

SEQ ID NO: 192620 - DNA, 610 bp, Homo sapiens
  misc_feature: GYAE6OF02F3M3Y.44.23.C01.1.454.CMB.1.raw
  modified_base (241)..(241): a, c, t, g, unknown or other
  misc_feature (241)..(241): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctcctcccttcctgtcttcttctgttggagcagcgtcaccatcacttgccgggcgagtcaggttcgttttcggngctgttgccttggtttcaaacgaaaagggggagaggcccctaaggtcctcgtctctcgtagaaccagactggaagtagacgtcccgtcaggttcagtcgccagtccaggtggtgggccggagtccactctcacctattacgccgacgtgccggcctgggagtattcgtgacctaactttatttcgtgttcagtacagtactcaatacgttcgtccccgttataccgttttcggaccgacgggtaccaaggtctagggaaactacgaaacgtaacgtaggtcgacgtgaccgacctacgttaccttcggttacctttacgtaaccgtttcccgttacccccgtaccctacgtttaccgtagtagtttaac

SEQ ID NO: 192621 - DNA, 586 bp, Homo sapiens
  misc_feature: GYAE6OF02IUJDO.44.23.C01.1.454.CMB.1.raw
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggtgcttgttcgccttggtttacaaacgaaaagggggngacggcccctaaggtcctcgtctcgtcgtagaaaccngactaggaaggtagacgtcccgtcgaggttcagtcgccngtccgagggtggtgggccggagtccactctcactagttacgcgacctggccggctagaacgtcttcgtcgtactaactttatttctgtcacgctagtatctagtagtcgtccccgttctacttttcggaccgtacgggtaccagacgtaggaaactacgaaacgacgtgtacgctacgacacctacgtcgtcgttcttactaccgttccttcccgtacctactctagtattaac

SEQ ID NO: 192622 - DNA, 586 bp, Homo sapiens
  misc_feature: GYAE6OF02FVZGT.44.23.C01.1.454.CMB.1.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggtcgttttcggngctgttgccttggttacaacgaaaaggggngaggcccctaaggtcctcgtctctcgtgaaaccagactaggaagtagacgtcccgtcaggttcagtgccagtccgaggttggcgggccggtagtccactcgtcaccagttacgcgacgtgcggcctagaacgtattcagactaactttatttctgtcagtcagtactnaattagtcgtccccgttntaccgttttcggaccgtagggacctaagtcgtaggaaacttaccgaaacgtacgtggtacggctacgactaccgtagtcctcgttaccttcctagttcccttacccgacctactcgtacgtattaacg

SEQ ID NO: 192623 - DNA, 643 bp, Homo sapiens
  misc_feature: GYAE6OF02JBH99.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcagggttccgttttcggtgcttgttgcctggtttcaaacgaaaagggggagacggcccctaaggtcctcgtctctcgtgaaaccagactggaaggtagacgtcccgtccaggttcagtgccagtccgaggtcggtgggccggagttcccactcctcaccagttacgccgactgccggcctgaagtcttctgcctaactttatttccgtagtcaggctaagttatactagtacgtcgtcccccgttactacgttttccgggaccgtacgggggaacctaacggacgttaacgggaaacttaccgaaaaccgtaacgttcgggtacgggtactaccggacctaccgtaacgtcgttacggttacctttcgtaaccttccctttaccccggacccttacgttcccgtagtaactttaaccg

SEQ ID NO: 192624 - DNA, 649 bp, Homo sapiens
  misc_feature: GYAE6OF02I38KE.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgtgcctggtttcaacgaaaaagggggcacggcccctaaggtcctcgtctctcgtagaaaccagactggaaggtagagtcccgtcaggttcagtcgccagtccagggtggtcgggccggagtccactctcacccattacgcgactgcggcctgacgattctgctaacttattctgtcagctagtatctaagtacgtcgtccccgtttactacgtttttcgggacccgtacgggggtaacccaacggtcgtaacgggtaaaacttaccgaaaaaccgggtaaccttagggtaccgggtacgttaccgggaccctaacccgtaacgtttaccgtttacggtttacctttacccgtaccgtttcccgtttcccccggtaccttactttcccgttaagtacgtttaaccg

SEQ ID NO: 192625 - DNA, 578 bp, Homo sapiens
  misc_feature: GYAE6OF02IOMU7.44.23.C01.1.454.CMB.1.raw
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaagggggnaggcccctaaggtcctcgtctctcgtgaaaccagactggaggtagagtcccgtcaggttcagtcgccagtccaggtggtcgggccggagtccactcctcacctagttagccgaccgtcgcggccctaggaagtactttccgtgtacctaactttactttcgtcgtacagtctagtatctagttacgtcgtccccgttctacgttttcggaccgtacggggaccaacgtcgtaggacgtactacgaaacgtaacgtgtcggctacgcaccgtatctcgtcttctacttccttcccgctactctatac

SEQ ID NO: 192626 - DNA, 226 bp, Homo sapiens
  misc_feature: GYAE6OF02JBCFJ.44.23.C01.1.454.CMB.1.raw
  modified_base (219)..(226): a, c, t, g, unknown or other
  misc_feature (219)..(226): n is a, c, g, or t
tcagacagtatatacacgaccggtgctcgatttagtacacgtgattagggattgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnnnn

SEQ ID NO: 192627 - DNA, 554 bp, Homo sapiens
  misc_feature: GYAE6OF02I9RVS.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggttcaacgaaaaagggggngacggcccctaaggtcctcgtctctcgtagaaaccagactggaaggtagacgtcccgtccaggttcagtcgccagtccagggtggtgggccggagtccactctcaccattagcgacctgccggcctggaagtctctgtctaactttatttctgttcagtcagtatctatacgtcgtccccgttctacgttttcggccgacgggaccaagcgtaggaatacaaacgactgcgctgccacgattctcgttcttctacttccttcccgtcctatcctagtactaag

SEQ ID NO: 192628 - DNA, 549 bp, Homo sapiens
  misc_feature: GYAE6OF02GE2MK.44.23.C01.1.454.CMB.1.raw
  modified_base (239)..(239): a, c, t, g, unknown or other
  misc_feature (239)..(239): n is a, c, g, or t
  modified_base (351)..(351): a, c, t, g, unknown or other
  misc_feature (351)..(351): n is a, c, g, or t
  modified_base (409)..(409): a, c, t, g, unknown or other
  misc_feature (409)..(409): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttcctgtcttcttctgttggaggcagcgtcaccatcacttgccgggcagtcaggtcgttttcggngctgttgccttggtttacaaacgaaaagggggcacggcccctaaggtcctcgtctctcgtagaaaccagactggaagtagagtcccgtcaggttcagtgccagtcaggtggngggccggatccactctcacattagcgacctgccggctgaatattcgtagactaacttntttctgtcagacagtatcagttacgtcgtacccgttctactttggaccaggggaccaagtctaaggaactacaaacgactgtcgctcgcctactatcttcgtacttcgtactccttcccggcctacgtctacgtattacg

SEQ ID NO: 192629 - DNA, 537 bp, Homo sapiens
  misc_feature: GYAE6OF02IWCX8.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggatggagtggattggtgacatccattatacgtggggcgacgtactactctccgtcctcaagagtcgtctcaccatttcgagggacacgtccatgaaccgcttctccctgaaactgacctccgtgacccgccgcgggacacggtccgtttatttctgtgcgaggcgagactgttcttcaatctagtcggggccgtggcacccgtggtccacgttgtcctcctcacgccttcccaccgaacgggcccagttcccgg

SEQ ID NO: 192630 - DNA, 527 bp, Homo sapiens
  misc_feature: GYAE6OF02FPFHZ.44.23.C01.1.454.CMB.1.raw
  modified_base (270)..(270): a, c, t, g, unknown or other
  misc_feature (270)..(270): n is a, c, g, or t
  modified_base (396)..(396): a, c, t, g, unknown or other
  misc_feature (396)..(396): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggngaggcccctaaggtcctcgtctctcgtgaaacccagactggaaggtagagtcccgtcaggttcagtgccagtccaggtggtgggccggagtccactctcaccattagcgacctgcggcctgaacgnttctgcaacttatttctgttcagtcagtatcatagtgccccgttcacttttggccaggggacccaaggcctaggaactacaaacgactgtgctgcaccatctgtcttcatccttccgaccatctagataac

SEQ ID NO: 192631 - DNA, 592 bp, Homo sapiens
  misc_feature: GYAE6OF02FGZDJ.44.23.C01.1.454.CMB.1.raw
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggttcaacgaaaagggggnaggcccctaaggtcctcgtctctcatgaaaccagactggaaggtagacgtcccgtcaggttcagtgccagtccagggtggtcgggccggtagtccactctcaccgtattagccgaacctgccggtcctagaagtattcngtcaactttatttcgtgtcagcagtatcattacgtccgtccccgtttactaccgtttttcggcccgtaagggggtaaccctaaaggtccgttaagggtaaaactaccgaaaaacgtaacgtggttaggcctagccaaccatctcgttcttacacttccttaccccgcctactcgtagtaac

SEQ ID NO: 192632 - DNA, 579 bp, Homo sapiens
  misc_feature: GYAE6OF02I0YG6.44.23.C01.1.454.CMB.1.raw
  modified_base (275)..(275): a, c, t, g, unknown or other
  misc_feature (275)..(275): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggtgctgttgccttggtttacaaacgaaaaagggggnacggcccctaaggtcctcggtctcgtcgtagaaaccagacgtggaaggtagacgtcccgtacaggttcagtgccagtccgagggtggtgggccggtagtccactctacacctattacgcgtacctgcggacctaggaagtcttctacgactaactttatttctgtacacgctaagtactactatacgtcgtcccgttactacgtttcggaccgtagggacctagcgtaggaaactacgaaacgactagtacgctcgacaccgtattctcgtcttacacttccgttccgcctatctagtattacg

SEQ ID NO: 192633 - DNA, 546 bp, Homo sapiens
  misc_feature: GYAE6OF02FOPOS.44.23.C01.1.454.CMB.1.raw
  modified_base (272)..(272): a, c, t, g, unknown or other
  misc_feature (272)..(272): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggttcaacgaaaaagggggngaggcccctaaggtcctcgtctctcgtgaaaccagactggaaggtagagtcccgtccaggttcagtgccagtccaggtggtgggccggagtccactctcaccattacgcgacctgcggcctgaagattctgctaacttatttctgtcagcagtatnatagtcgccccgttntacgttttcggccgtaggggaccaagccgtaggaaactacaaaacgtactgtcgctgacaccgatctgtcttctacttccttcccgacctactctagtattac

SEQ ID NO: 192634 - DNA, 561 bp, Homo sapiens
  misc_feature: GYAE6OF02GDL0V.44.23.C01.1.454.CMB.1.raw
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (428)..(428): a, c, t, g, unknown or other
  misc_feature (428)..(428): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (557)..(557): a, c, t, g, unknown or other
  misc_feature (557)..(557): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaaacgaaaagggggngacggcccctaaggtcctcgtctctcgtagaaaccagactggaaggtacgaggtcccgtcgaggttcaaggttcgccagtcccgaggggttgggtcggggccggagtcccaacgtcctcacctagttacgccgacctggccggcctaggaaagtnttcgtagctaactttatttcgtgtcagctagtatctatacgtcgtcccgttctacgttttcggccgagggaccagctaggaactacaaacgactgtgctgcacntctntcttnatcctccgctactctnatac

SEQ ID NO: 192635 - DNA, 430 bp, Homo sapiens
  misc_feature: GYAE6OF02HIW3Q.44.23.C01.1.454.CMB.1.raw
  modified_base (424)..(430): a, c, t, g, unknown or other
  misc_feature (424)..(430): n is a, c, g, or t
tcagacagtatatacacgaccggtgctcgatttagtacacgtgattagggattggggaagtcagccataatggaagcaccagctataaccccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccaggggaccgcggtcaccgtctcctcagcctccaccaagggccccatcggtccttccccctggccacccctcctccaagacgccacctctgggggcacagccggccctggctgcctggtcaaggctacttcctatatactgtctgagcgggctggcaaggcgcatagnnnnnnn

SEQ ID NO: 192636 - DNA, 434 bp, Homo sapiens
  misc_feature: GYAE6OF02I5G2P.44.23.C01.1.454.CMB.1.raw
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (421)..(434): a, c, t, g, unknown or other
  misc_feature (421)..(434): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccagggggaccncggtcaccgtctccccagctccacccaggccgactcgtcgtcccctcgcnccctcctccanacgcncctctggggcgacagcgcccgtcggcgtcgccgtggtcgaagacttactccttatatactgtctgagcgggctggcaaggcgcatagcnnnnnnnnnnnnnn

SEQ ID NO: 192637 - DNA, 567 bp, Homo sapiens
  misc_feature: GYAE6OF02FF118.44.23.C01.1.454.CMB.1.raw
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
tcagacagtatatacacgaccggtgctcgatttagtacacgtgattagggattggggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggtgctgttgccttggttcaaacgaaaaaggggggngaggcccctaaggtcctcgtctctcgtgaaccngactggaaggtagacgtcccgtcgaggttcagtgccagtccaggtgggtcggccggagtccactctcaccgattacgccgactggccgtcctagaagtnttctgactaacttatttctgtcagcagtatcatacgtcgtccccgttntacgttttcgggccgacggggaccaacggtacgtaggtaaactaaccgaaacgtaacgtcgtggctcgcacctatctcgttcttctactccttcccgctactctagtatac

SEQ ID NO: 192638 - DNA, 560 bp, Homo sapiens
  misc_feature: GYAE6OF02GDTSN.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (529)..(529): a, c, t, g, unknown or other
  misc_feature (529)..(529): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggtttcaacgaaaagggggngaggcccctaaggtcctcgtctctcgtgaaccagactggaaggtagacgtcccgtcaggttcagtcgccagtccaggtggtgggccggagtcccactcctcaccattacgccgtacctggccgggccctaggaaacgtctttctagacctaactttactttctgtcagctagtactctagtacgtcgtccccgttctacgttttcggccgtacggggaccagtcgtaggaactacaaacgactgtcgctcgcaccgtntctgtccttcatcctccgcctatctatatac

SEQ ID NO: 192639 - DNA, 640 bp, Homo sapiens
  misc_feature: GYAE6OF02HBLP6.44.23.C01.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (412)..(412): a, c, t, g, unknown or other
  misc_feature (412)..(412): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcctctgtcttcttctgttggaggcagcgtcaccatcacttggccgggnagtcaggttcgttttcggngcttgttcgcctggtttcaacgaaaaagggggngacggccctaaggtcctcgtctctcgtagaaaccagacgtggaaggtagacgtcccgtccaggttcagtgccagtccgaggttggcgggccggagtcccatcctcacagttagcgacctgcggcctgaagtacttcgtnacgtaactttatttcgtgtacagtactaagtactatagttacggttccgtaccccgtttcgtaacgtttttcgggacccgtaagggggtaacccaagggtccgtaagggtaaacctaccgtaaaaacggaccgttcggtacgggcctacgaccgtaccgtatccgttacggttctttaccgactttcccgttccccggacccttacgttccgttacgtaactttaacg

SEQ ID NO: 192640 - DNA, 988 bp, Homo sapiens
  misc_feature: GYAE6OF02H72CP.44.23.C01.1.454.CMB.1.raw
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttcggccgggcgacgtcgtacggttccggtttttcgggtcgtcgttggtttcgtccgtttgggttttaccgaaaacggtaaaaaaagggggggcgtaaccgggtacccccgttaaacgggttccccgttacggttccgttccgttaccgggttaacgaaaaacccgtaggtaaccgttaggggaaacggggttaacggaccggttacccccggttaccggtaacgggtttccaacggttcgacccgtaacgggttcccggaagggggttcggggttccggggggacccgggtacgttaccccgtaaccgttccttacccgaaaccccgttaagtttaaccgggcccgtaaaccccgtttcggggacccggggtacccttaagggaaaaccggtttaaccgtttccgttacggtaaccccgtttaaaaccgtttttttacgttttacccgttacggttaaccgtaacggttaccgttaaacgggtttaacgttaccgttaaacgttttaaccgggttacccggtttacccccccgggtttttaacgtttaacccgggttttttcccggggaaaccccggggttaaacccggggggtaaaacccctaaccggttaacccggttaaaggggtaaaaaccttaacccggtaaaaacggtaaccgtttacggtacgggtaccgttaccggaccctaacccggtacttaccgtttcgttcccttaccgtaccgtttaccccttaccccggtacctttaacgtaccgttacgtaactttaacg

SEQ ID NO: 192641 - DNA, 553 bp, Homo sapiens
  misc_feature: GYAE6OF02GAFNB.44.23.C01.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgtttcgngctgttnctggttacaaaaaaggggnaggccctaagtcctcgtctctcgtgaaacagactggaaggtagacgtcccgtcagttcagtgcagtccaggtggtgggccgagtccactcacacattagcgtactggcggcctgaagtnttctgtactaactttattcgtgtcacgactagtactctatacgtcgtcccgtttntacgttttcggccgtaagggaccaagtctacggaaatacgaaaacgtactaggtcggactcgaccacgtagtctagttccttacacttcccttacccgctattctgtactatacg

SEQ ID NO: 192642 - DNA, 710 bp, Homo sapiens
  misc_feature: GYAE6OF02ICOL8.44.23.C01.1.454.CMB.1.raw
  modified_base (699)..(699): a, c, t, g, unknown or other
  misc_feature (699)..(699): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccagttcgagatgtgacatcgagatgacccagtctccttccttcctgtcttcttctgttggaggcagcgtcacatcacttgccggcgagtcaggttcgtttcggtgctgttgcctggtttacaaacgaaaaaggggcgacggtccctaaggtcctcgtctctcgtacgaaaccacgacgtaggtaaggtacgacggtcccgtacgtaggttcagtcgacctagtcccggagggttgggtcggggccggacgtccctacgtctacctaaccgtattacggccgaccgtgggccggcctaggaacgtacttttcgtacggtaccttaaaccgttttaagtttcttcgtaccgtaaggtaccgtaagttactcgtaaatttcggtaccgttcccccgtttactaccggtttttcgggacccggtaaccgggggtaacccaacgggttaccgttaaagggtaaacctaaaccgtaaacggtaccgttagggtcggtacctacggacctacttaacgttccgttccgttaccgttacctaccgttcccgttccccgaaccttcgtaccgtntaacttaaccg

SEQ ID NO: 192643 - DNA, 601 bp, Homo sapiens
  misc_feature: GYAE6OF02H1TCF.44.23.C01.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
  modified_base (460)..(460): a, c, t, g, unknown or other
  misc_feature (460)..(460): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctcccaggttcgagatgtgacatcgagatgacccagtcctccttccttcctgtcttcttctgttggagcagcgtcaccatcacgttggccgggnagtcgaggttcgttttcggngcttggtgccttggtttacaaacggaaaaagggggnacggaccctaaggtcctcgtctcgtacggtacgaaaccagacgtaggtaaggtanacgtccctcgagttcagtcgccagtccagggtggtcggaccggagtccacgtcacgaaccattaacgcgactggccgcctagaagtactctgactaactttacttctgtcagtctaagtactanaagtacgtcgcccgtttatacgttttcggaccgtacggggtaaccaacggtctaaggaactaacgaaaaccgtagtaacgtcgtcgtacgcgacctattcctagtcttacacgtttccgtacccatactctagaattaacg

SEQ ID NO: 192644 - DNA, 560 bp, Homo sapiens
  misc_feature: GYAE6OF02IVM46.44.23.C01.1.454.CMB.1.raw
  modified_base (273)..(273): a, c, t, g, unknown or other
  misc_feature (273)..(273): n is a, c, g, or t
  modified_base (544)..(544): a, c, t, g, unknown or other
  misc_feature (544)..(544): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttcaaacgaaaagggggngaggcccctaaggtcctcgtctctcgtgaaaccagactggaagtagacgtcccgtcaggttcagtcgccagtccgaggttggtcgggccggagtcccactctccaacctagttacgccgacctggccggcctggaagtcttcgtgtacctaactttatttctgtcacgtctagtatacatagtcgtcccgttctactttcggccgagggaccagcgtaggtaatacctaaagacttggtcgctcgacacgatctgtcttcattccttcccnctactctagtataacg

SEQ ID NO: 192645 - DNA, 765 bp, Homo sapiens
  misc_feature: GYAE6OF02J2WJZ.44.23.C01.1.454.CMB.1.raw
  modified_base (244)..(244): a, c, t, g, unknown or other
  misc_feature (244)..(244): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttctctgttggagcagcgtcaccatcacttcgccgggcgagtcgtaggttccgtttttcggngtccgttggttcgtccgtttgggttttaaccaaaacggtaaaaagggggggtcaccgggtacccccgtaaagggttccccttcggttccttccgtacggtacgaaaacccgtaggtacgtacgggaaacggttagaccggttaccccggtccgtaagggttccaaggttcgcccgtaaggtcccgagggtcggggttacggggccggtacgtacccgtagtccctacgtaaccccgtagtttaacgcccggtaaccgttcggacccggtacccgtagtaacggtacgtttcgtacgaccgtttaaactttacgtttccgttacggtactacgtcgtaacgtataccgttaacgttacggtccgttaccccgttacgtacggttttccggaccgtaacgggtaccaacggtcgtaacggtaaactaccgaaacgtacgtcgtacgtactcgacctaccgtaacgttcttacgtccctttaccacgtttcccgttaccgccttacgttcgtactatttaaccg

SEQ ID NO: 192646 - DNA, 457 bp, Homo sapiens
  misc_feature: GYAE6OF02I3MAR.44.23.C01.1.454.CMB.1.raw
  modified_base (192)..(192): a, c, t, g, unknown or other
  misc_feature (192)..(192): n is a, c, g, or t
  modified_base (421)..(421): a, c, t, g, unknown or other
  misc_feature (421)..(421): n is a, c, g, or t
  modified_base (426)..(429): a, c, t, g, unknown or other
  misc_feature (426)..(429): n is a, c, g, or t
  modified_base (432)..(457): a, c, t, g, unknown or other
  misc_feature (432)..(457): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttcngtgcgagaggccctggtaccagcgagtggtacctctactactactctctggacgtcgtggggccaggggaccgcggtcaccgtctcctcagcctccaccaagggcccatcggtcttcccccgtggccacccctcctccaaagacgccacctcgtggggcacagccggcccgtggctgcctggtcaaggactacttcctatatactgtctgagcggcgtggcaaggcganatagnnnngtnnnnnnnnnnnnnnnnnnnnnnnnnn

SEQ ID NO: 192647 - DNA, 651 bp, Homo sapiens
  misc_feature: GYAE6OF02H78L9.44.23.C01.1.454.CMB.1.raw
  modified_base (496)..(496): a, c, t, g, unknown or other
  misc_feature (496)..(496): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctcccaggttcgagatgtgacatcgagatgaccaagtcctccttccttcctgtcttcttctgttggaggcagcgtcaccatctacttcggccgggcgagtctagggttcgtttttcggtgtcttgttgtccgttggtttaccaaaacggtaaaaagggggagaacggtaccccgtaaggtcctacgtcttccgtacggtacgaaaccgagaacgtaggaaggtacgacgtcccgtcgaggttacgagtcgaccagtccgagggtcggtcggccggtagtccactctacaactagtacgcgacctcggccggtcctaggaacgtacttcgtgaccttaacttttagttctagtcagctagtactanaattcggtcgtccccgtttagtacgtttacggccgtaacggggaaccaacgtcgtaagtaaacctacgtaaacgaacgtgtacggctacgcctaaccgtaatccgttacggtcctttacacgttcccgttcccgacttacttcgttagattaacg

SEQ ID NO: 192648 - DNA, 708 bp, Homo sapiens
  misc_feature: GYAE6OF02G34TO.44.23.C01.1.454.CMB.1.raw
  modified_base (276)..(276): a, c, t, g, unknown or other
  misc_feature (276)..(276): n is a, c, g, or t
  modified_base (423)..(423): a, c, t, g, unknown or other
  misc_feature (423)..(423): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgccttggtttacaaacgaaaaagggggnacggcccctaaggtcctcgtctctcgtagaaaccagactggaaggtagacgtcccgtcaggttcagtcgccagtccagggtggtcgggccggagtccacgtctaccgacctagttacgccgtaccgtggccggtcctaggaaacgtntttacgtcgtacctaaacttttatttctgtacacggtctaaggttactaccgtaagttacgttcgtcccccgtttacttaccgtttttcgggacccgtaacgggggtaaccctaacggtccgttaacggtaaaacttaccgaaaaaccggtaacgtttacggtacgggtaccgttacggacccgtaacccgttaacgttccctttacggtttaccctttacccgttaacgtttcccccgtttccccggacccttaacgtttacccgttaggttaacctttaaccg

SEQ ID NO: 192649 - DNA, 761 bp, Homo sapiens
  misc_feature: GYAE6OF02HDE18.44.23.C01.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcagtcaggttcgttttcgngctgttgccgttggtttacaaacgaaaagggggnaggtcccctaaggtcctcgtactcgtacgtagaaaccngacgtaggaaggtagacgtcccgtcgaggtttcagtcgacctagtccagggtggcgggccgagtccactctcacctattacggacctaaccgtggaccggtccgtaggaaacgttcgtttaccgtacgtaaccgttaacgttttacttttaccgttacggttaccgaacggtacgttaacggttacgttaccgtaaacgtttacggttacccgtccccgttttacgttaacccggtttttccgggaacccggttaacgggggtaacccttaaacggtaccgttaaaccgggtaaaacgttacccgtaaaaaccggtaccgttacgggtacggttaccgttacgacccgttaacccggtactttaccgttaccggttcctttaacccgttaccgtttccccgtttacccccggacgtttaaccgttccgttaacggtacttttaaaccgg

SEQ ID NO: 192650 - DNA, 554 bp, Homo sapiens
  misc_feature: GYAE6OF02FR8ZL.44.23.C01.1.454.CMB.1.raw
  modified_base (268)..(268): a, c, t, g, unknown or other
  misc_feature (268)..(268): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggttcaacaaaaggggngaggcccctaaggtcctcgtctctcgtgaaaccagactggaaggtagacgtcccgtcaggttcagtcgccagtccaggtggtcgggccggagtccactctcaccattacgcgactgcggcctgaagnttctgctaacttnttctgtcagcagtatcatagtcgccccgttntacgttttcggcctaggggaccaaggtcgtaggtaaaactacaaaacgacttgtggtctgacctaccgtactcctcggttcttctacttccttcccgacctactctacgattaag

SEQ ID NO: 192651 - DNA, 551 bp, Homo sapiens
  misc_feature: GYAE6OF02GQAWN.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggngaggcccctaaggtcctcgtctctcgtgaaaccagactggaaggtagacgtcccgtcaggttcagtcgccagtccaggtggtgggccggagtccactcncacatacgcgacctgcgcctgaagntctgctaacttatttctgtcagcagtatctatagtcgtccccgttctacgttttcggccgtacggggaccaaggctaggtaactacgaaacgtaacgtgtgctcgacacctattctcgtcttctacttccgttacccgcctactcctagtattaac

SEQ ID NO: 192652 - DNA, 629 bp, Homo sapiens
  misc_feature: GYAE6OF02IWQ73.44.23.C01.1.454.CMB.1.raw
  modified_base (427)..(427): a, c, t, g, unknown or other
  misc_feature (427)..(427): n is a, c, g, or t
  modified_base (479)..(479): a, c, t, g, unknown or other
  misc_feature (479)..(479): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggtgctgttgccttggtttacaaacgtaaaaaggggggagacggccccctaaaggtcctcgtcctcgtcgtagaaaccaggactgggaagggtagacggtcccgtactagggttcaggtgcccaggtccagggtggtgggccgagtccactctacacctattagccgacctggccgcctgaagtattcngactaacttatttctgtcagtactagtatcgtaattacgtcgtccccgtttntacgttttcgggaccgtaggggaacccaaggtcgtaacggaaactacgaaaacgtacgttggtcggtctacgtaccgaacctacgttccttaggttcccttacgtaccgtttacccttaccccggtccttaacgtccttagaatttaacg

SEQ ID NO: 192653 - DNA, 615 bp, Homo sapiens
  misc_feature: GYAE6OF02GQCR0.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (412)..(412): a, c, t, g, unknown or other
  misc_feature (412)..(412): n is a, c, g, or t
tcagacagtatatacacgaccggtgctcgatttagtacacgtgattagggattgggggagtcagaccctgtcaggggacagcatggacatgagggtccccactcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggttacaacgaaaagggggnacggcccctaaggtcctcgtctctcgtgaaaccngacgtggaaggtagcgtcccgtcaggttcagtcgcacgtccgagggtggcgggccggagtcccacgtctacacctagttcgcgtaacctggccggccttagaacgtnttcgcgactaactttctttacgtgtcagcctagtatcgtaatagttccgtccccgttagtccgttttacgggccgtaacgggggaccaacgggtcgtaagaacgtacgaaaccgtagttcggacgtacgtcgacctacgtacttacgtacgttcctttacctacgttcccgttacccgtacctactccgttagtactttaacg

SEQ ID NO: 192654 - DNA, 636 bp, Homo sapiens
  misc_feature: GYAE6OF02IBPQP.44.23.C01.1.454.CMB.1.raw
  modified_base (278)..(278): a, c, t, g, unknown or other
  misc_feature (278)..(278): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacttgccgggcgagtcgaggttcgttttcggtgcttgttgtccttggtttcaaacgaaaaagggggngacggcccctaaggtcctcgtctctcgtagaaaccagactggaaggtagagtcccgtcaggttcagtcgccagtccgaggtggtcgggccggagtccactctacacctagttacgccgacctggccggtcctggaacgtatttcgtgtacctaaacttttatttctgttcagactagttatacagttacgtcggtccccgtttctaccgtttttcgggccgtaacgggggtaacccaaggtccgttaagggaaactaccgaaaaccggtaacgttggttacggcctaggccctacgtaacttcgttacgtcctttaccacgtttcccttcccggaccttactccttaggtacttaacg

SEQ ID NO: 192655 - DNA, 645 bp, Homo sapiens
  misc_feature: GYAE6OF02FFAD4.44.23.C01.1.454.CMB.1.raw
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
tcagacagtatatacacgaccggtgctcgatttagtacacgtgattagggagttggggagtcagaccctgtcagggacagcatggacatgagggtccccgctcagctccgtggggctcctgctgctctggcctcccaggttcgagatgtgacatcgagatgacccagtctccttccttcctgtcttcttctgttggaggcagcgtcaccatccacttggccgggcgtagtcaggttcgttttcggngtccttggtttcgccgttggtttacaaacgtaaaagggggagacggccccgttaaggtccctgtcctcgtccggtanaacccgagacgtaggaaggtagacgtcccgtcaggttccaaggtcgacctaggtccgaggtgggtcgggcccggtagtcccactcctccaaccgtagttacgcgtacccgtgggcccggtccgttagaagtactttctggactaacgttactttctggtacacgtgagtacgtctataggttcgtccccgttcttacgttttcggaccgtacgggaccaggactaggaactacgaaacgacgtgtacggactcgaccgtaccgaacttcgtacgttaccttacctacgttccctcccgtacctacgttccgtagtattaacg

SEQ ID NO: 192656 - DNA, 647 bp, Homo sapiens
  misc_feature: GYAE6OF02IH3TK.44.23.C01.1.454.CMB.1.raw
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (453)..(453): a, c, t, g, unknown or other
  misc_feature (453)..(453): n is a, c, g, or t
  modified_base (588)..(588): a, c, t, g, unknown or other
  misc_feature (588)..(588): n is a, c, g, or t
tcagacagtatatacacgaccggtgctcgatttagtacacgtgattagggattgggggagtcaggaccctgtcaggggacagcatggacatgagggtccccgctcagctcctggggctcctgctgctctggctccaggttcgagatgtgacatcgagtatgacccagtcttccttccttcctgtcttcttctgttggaggcagcgtcaccgatcacttcgccgggcgtagtcacggttcgtttcggcgtctgttcgccgttggtttacaaacggaaaagggggnacggacccctaaggtcctcgtctctcgtgaaaccngactggaagtagacgtcccgcaggttcagtcgcctagtccgagggtcggtgggccggtagtccacgtcctacaacctagttacgccgtaacctggcccggtcctaggaacgtacttcgtcgtactaaacgtttntttactgttacagtctaagttactacttaagtacgtaccgttccccgtttactacgttttcgggaccgtaacggggtaaccaggtacgtaaggaaacttacgaaaacgtagttcgtagtcctacgacctaccgtnttaccttgttaccttcgtaactttcccgtacccgtacctacgttccgttagacttaacg

SEQ ID NO: 192657 - DNA, 538 bp, Homo sapiens
  misc_feature: GYAE6OF02FNBJL.44.23.C01.1.454.CMB.1.raw
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaagggggnaggcccctaaggtcctcgtctctcgtgaaaccagactggaaggtagacgtcccgtcaggttcagtgccagtccaggtggtgggccggagtccactctcaccattacgcgacctgcggcctgaagnttcngctaacttntttctgtcagcagtatcatagtcncccgttntacttttggccgtaggggaccaacgcgtaggaaactacgaaaacgtactgtagctgcacatcttcgtcttcattcccttcccgcctactctagtataac

SEQ ID NO: 192658 - DNA, 594 bp, Homo sapiens
  misc_feature: GYAE6OF02FN6FO.44.23.C01.1.454.CMB.1.raw
  modified_base (273)..(273): a, c, t, g, unknown or other
  misc_feature (273)..(273): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggttcaaacgaaaagggggnacggacccctaaggtcctcgtctcgtcgtagaaaccagacgtggaaggtagacgtcccgtcaggttcagtcgccagtccgaggtggtcgggccggtagtccactctacacctattacgaccgtacctggcgcctagaagtcttcagactaacttatttctgtcagtcagtactntatacgtcgtccccgttntacgttttcggaccgtacgggaccaggtcgtacggaaactaccgaaacgtacgttaggtcgctacgacacctcttcgttacgttcttaccgtacttcccgttacccgacctacttccgtagtattaacg

SEQ ID NO: 192659 - DNA, 595 bp, Homo sapiens
  misc_feature: GYAE6OF02FI4N0.44.23.C01.1.454.CMB.1.raw
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgccttggtttcaacaaaagggggngaggcccctaaggtcctcgtctctcgtgaaccagactggaaggtagagtcccgtcaggttcagtgccagtccaggtggtgggccggagtccactctcacccattacgcgacctgccggcctgaanacttctgcgtaacttntttctgtcagcagtatcatacgttcgtccccgttctacgtttttggacccgtacggggaccaagccgtaggaaacttaccgaaacgtaacgttacggtacggcgttacgacctaccgtacgttacttacgttacctttcctacttacccgtttccccgacccgtactccgttacgtatttaac

SEQ ID NO: 192660 - DNA, 660 bp, Homo sapiens
  misc_feature: GYAE6OF02H4F5U.44.23.C01.1.454.CMB.1.raw
  modified_base (163)..(163): a, c, t, g, unknown or other
  misc_feature (163)..(163): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (236)..(236): a, c, t, g, unknown or other
  misc_feature (236)..(236): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgaccngtctccttcctcctgtctctctgtgngcngctcaccatcacttcggccgggcgagtcgaggttcgttttcggngtctggttgccgtttggttacaaaacgaaaaaggggggcacgggacccctaaggtcctcgtcttcgtcgacgaaacccagacgttgggaaaggtcgaacggtccccgtcgtaggttcagtggacccaggttccgagggtcgggtcggggcccggtatccgtactcctcaacctagtacgtccgacgtcgccgggtcctagggaactattcgtcgacttaacttacttcttgtcagtcgtagtatcgtaagtacgtccgtaccgtttcttacgtttcggaccgaacggggtaccaaggacttacggaaattaaccaaaacgtaacggttaggtcgtacgtacgacccgttactaacttcccgttggttacctttactaccgttcccgttaccccgtacgttaccttaccgttaggttaattaacg

SEQ ID NO: 192661 - DNA, 599 bp, Homo sapiens
  misc_feature: GYAE6OF02FXIZ3.44.23.C01.1.454.CMB.1.raw
  modified_base (272)..(272): a, c, t, g, unknown or other
  misc_feature (272)..(272): n is a, c, g, or t
  modified_base (399)..(399): a, c, t, g, unknown or other
  misc_feature (399)..(399): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggagcagcgtcaccatcacttgccgggcgagtcaggttcgttttcggtgctgttgccttggtttcaacaaaaagggggngaggcccctaaggtcctcgtctctcgtagaaaccagactggaaggtagagtcccgtcaggttcagtgccagtccaggtggtggccggagtccactctacaccattacgcgacctgccggctgaagtnttcgtgcaactttatttctgtcagctagtatacatacgtcgtcccgttctactttttcggccgtaacggggaaccgaacgtacgtacggaaacttaccgaaaaccgtaaacgtcggtacggtcgtacgaccaccgtaacttcgtacgttccttacgtacgttccgttaccccgtaccctacgtccgttacgtatttaacg

SEQ ID NO: 192662 - DNA, 787 bp, Homo sapiens
  misc_feature: GYAE6OF02FFTV5.44.23.C01.1.454.CMB.1.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttcctcctgtcttcttctgttggagcagcgtcaccatcacttggccgggcagtcaggttcgttttcgggtctgttcgccttggttcaaacgaaaggggnacggccctaaggtcctcgtctctcgtanaaccngactggaagtagacgtcccgtcgtagggttcaggtcgccgagtcccgagggtcgggtcgggaccggtatcccgacttcctaccgaaccctaagttacggacccgtaacccgtcggaccgggtacctaggaacgtactttccgtagtaaccgttaaactttacgtttaccgttacggtaccgtaacggtacctaacggttaacttaccgttaaacgttaccggtttacccggttaccccccggttttaccgttaaccggttttttaccggggaacccggtaaccgggggtaacccgtaaacgggtacccgttaaacgggtaaaacgttaacccgtaaaaaccggtaacgttacgggtaccgggtaccgttaccggaccctaacccgtaaaccgttccgttaaccggttaccctttaccgttaacccggtttaccccgtttacccccggtaaccctaccgtttaccgttacgtaacgtttaaaccg

SEQ ID NO: 192663 - DNA, 587 bp, Homo sapiens
  misc_feature: GYAE6OF02IB8OP.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagacagtatatacacgaccggtgctcgatttagtacacgtgattagggattggggtagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaaacaaaaagggggnaggcccctaaggtcctcgtctctcgtagaaaccngactggaaggtagagtcccgtcaggttcagtgccagtccagggtggtgggccggagtccactctcaccattagcgacctgcggcctgaanttctgctaacttatttctntcagcagtatcaatagtcgtccccgttctacgttttcggcgtaacggggaccaaggtccgttaggaaacttaccaaaacgtaacgttcggtacggccttacgaccgaccgtaacttccgttacgttcctttacacttccgtttccccgtacctactccttaggtacttaaac

SEQ ID NO: 192664 - DNA, 577 bp, Homo sapiens
  misc_feature: GYAE6OF02FO2TY.44.23.C01.1.454.CMB.1.raw
  modified_base (271)..(271): a, c, t, g, unknown or other
  misc_feature (271)..(271): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtcaggttcagtgccagtccaggtggtgggccggagtccactcncaccattacgcgacctgcgctgaagtnttctgctaacttatttctgtcagctagtatctatacgtcgtccccgttctaccgttttcgggccgtaacggggacccaaagtccgtaggaaacttaccgaaaacgtaacgtggtcggactgactaccgtacttccttcgttccttactacgttcccttcccgtacctatccgtagtattaacg

SEQ ID NO: 192665 - DNA, 427 bp, Homo sapiens
  misc_feature: GYAE6OF02HNEPU.44.23.C01.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (406)..(427): a, c, t, g, unknown or other
  misc_feature (406)..(427): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggngagtcaggtcgttttcggtgctgttgcccttggttttacaaacgtaaaaaaggggggngacgggacccccttaaagggtcccttcggtctcctcgtacgaaaaccagactaggaaggtagacggtccccgtcgtaaggttcaagtcgtccagttccgaaggggttcggtaggggccggtaacgnnnnnnnnnnnnnnnnnnnnnn

SEQ ID NO: 192666 - DNA, 708 bp, Homo sapiens
  misc_feature: GYAE6OF02JNB20.44.23.C01.1.454.CMB.1.raw
  modified_base (239)..(239): a, c, t, g, unknown or other
  misc_feature (239)..(239): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtctccttcctctgtcttcttctgttggaggcagcgtcaccatcacttggccgggcagtcaggttcgttttcggngtcttgttcgccttggtttaccaaacggaaaaaggggggtcaacgggtaccccgttaaggtcccgtcgtaccgtcgtcggtacgaaaccacggtacgtaggaaggtacgacggttccccgtacgagggttcaggtcgcctaggtaccgtagggtcgggtcggggaccggtaagtcccacgtaccgtaccaaccgtagttacggccgtaccgtggccggcctaggaacgtactttcgacgtacctaacttttgtttcctagtcaacgtctaagtactctaacgtttacgtcccgttaccccgtttagttaccgttttcgggacccggtaacggggtacctacggtaccgtagggtaaaaccttacgaaaaccgtacgttcggtcgacgttacgacctaaccgtagttaccgttacgttccttactaccgtttcccgtcccggtaccttagttcccgttagtaccttaacg

SEQ ID NO: 192667 - DNA, 718 bp, Homo sapiens
  misc_feature: GYAE6OF02F0R9V.44.23.C01.1.454.CMB.1.raw
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgtttcggtgctgttgccttggttacaacgaaaagggggnacggcccctaaggtcctcgtctctcgtgaaaccagacgtggaaggtgacgtcccgtcaggttcagtgcctagtcccgaggtgggtcgggccggtagtccacgtctccacctattacgccgtacctggccggtcctaggaagtctttcgtcgacttaactttattttccgtgttcacgtcgtaacgttactcgtaactacggttccgtacccccgttttactaccggtttttccgggaccccggttaacggggggaaccctaaacgggtaccgttaaacggggtaaaaccttaacccggtaaaaaccgtaaaccggtttcgggttaacggggtaccctttacggaccctaacccgtacgtttaccgttacggtttaccccttttcgaaccgtttccccgtttacccccggtacccgttaacgtttcccgttagttaacctttaaacg

SEQ ID NO: 192668 - DNA, 619 bp, Homo sapiens
  misc_feature: GYAE6OF02GOP30.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaacgaaaaaggggganaggcccctaaggtcctcgtctctcgtnaaccagactggaagtgacgtcccgtcaggttcagtgcctagtccagggtggtgggccggtagtccactctcacagttcgcgacctgccggctcgaagtnttctgcaactttatttctgtcagtcagtatacatacgtcgtccccgttacgtacgttttcggaccgtaacgggaaccgtaagtccgttagggaaacttacgaaaaccgtaacgttcggttacgggccttacggaccctaccgtaacgttcctttacggttaccctttactaaccgtttcccgtttaccccgaccgttacttaccgtcgtaaatttaacg

SEQ ID NO: 192669 - DNA, 577 bp, Homo sapiens
  misc_feature: GYAE6OF02GANCY.44.23.C01.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
  modified_base (399)..(399): a, c, t, g, unknown or other
  misc_feature (399)..(399): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggnagtcaggtcgttttcgngctgttgcctggttacaaaaaaggggnacggacccctaaggtcctcgtctctcgtagaaaccagacgtaggaaggtagacgtcccgtacgaggttcagtgaccagtccaggtggtgggccggagtccactctcacattagcgactgcgcctgaagtattcngactaactttattcgtgtcagtctagtatcattagtcgtccccgttctaccgttttcggaccgtacggggacctaagtacgtaggaaactacgaaaacgtacgtagtagctgaccaccgtatcgtacgtttctccttacttcccgttcccgactacgttccgtagtacttattaaccg

SEQ ID NO: 192670 - DNA, 529 bp, Homo sapiens
  misc_feature: GYAE6OF02GO7SD.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacaaaaagggggnaggcccctaaggtcctcgtctctcgtgaaaccagactggaaggtagagtcccgtcaggttcagtgccagtccaggtggtgggccggagtccactctcaccattacgcgacctgcggcctgaacgnttcngctaacttatttctgtcagcagtactcatacgtcgccccgttctacttttggccgtacggggacccaagcctaggaactcgaaacgactgtacgctgcaccatctgtcttcatcctccgccatctgatac

SEQ ID NO: 192671 - DNA, 742 bp, Homo sapiens
  misc_feature: GYAE6OF02JR8JT.44.23.C01.1.454.CMB.1.raw
  modified_base (147)..(147): a, c, t, g, unknown or other
  misc_feature (147)..(147): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagacagtatatacacgaccggtgctcgatttagtacacgtgattagggattgggggagtcagaccctgtcaggggacagcatggacatgagggtccccgctcagctcctggggctcctgctgctcgtggcctccgaggttcgagntgtgacatcgagatcgacccagtcctccttccttctgttcttcttctggtggagcagcgtcacatctacgtcggccggngtagtcgtaggtttcgtttcggngtcgttgttcgtccgttaggttacgaaaacggaaagggggcgaccggtaccccgttaaggtcctacgtctcgtacgtacgaaccagcgtaggaacggtagccggtcccgtcgtaggttcagtcgaccgtacggtcggaggggttcgggtcgggaccggtacgtcccgacttccgtactaaccgtagttacggaccgtaccgtcggggccgtaccgttaaggaacgttctttaccgtacggtaacctttaacgttttagtttccgtagtaccgtacgtactacggttactcgtacggttacgttcccggtcccgtttagttacccggtttccgggaacccggtaacggggtaacccaacgggttacggaacggttaaaccgtaaaccgtaaacggtacggttcgaccgtacgtacgacccgtaccgtagttccgttacgtttcctaacttcccgttacccgttacccgtactacgttaccggtattacgttaac

SEQ ID NO: 192672 - DNA, 535 bp, Homo sapiens
  misc_feature: GYAE6OF02FM11K.44.23.C01.1.454.CMB.1.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
  modified_base (505)..(505): a, c, t, g, unknown or other
  misc_feature (505)..(505): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatccacttgccgggcgagtcaggtcgttttcggngctgttgcctggttcaacgaaaagggggnacggcccctaaggtcctcgtctctcgtagaaaccngactggaagtagacgtcccgtcaggttcagtgccagtccgaggtggtcgggccggagtccactctcacattacgcgacctgccggtcctgaacgtnttctgactaacttactttctgtcagcagtatcatagtcgtcccgttctactttcggaccgagggaccagcgtagaactacaaacgactgtacgctcgcacgtntctgtcttcattcctccgctatctntatac

SEQ ID NO: 192673 - DNA, 537 bp, Homo sapiens
  misc_feature: GYAE6OF02GTBZL.44.23.C01.1.454.CMB.1.raw
  modified_base (251)..(251): a, c, t, g, unknown or other
  misc_feature (251)..(251): n is a, c, g, or t
  modified_base (500)..(500): a, c, t, g, unknown or other
  misc_feature (500)..(500): n is a, c, g, or t
  modified_base (503)..(537): a, c, t, g, unknown or other
  misc_feature (503)..(537): n is a, c, g, or t
tcagacagtatatacacgaccggtgctcgatttagtacacgtgattagggagttggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgnggggccaggggaccgcggtccaccgtctcctcagcctccaccgaagggccccagtccggtccttccccccgtggcccacccctccctaccgaagacgccacccgttcggtgggggccaacgacgccgggcccgttgggcctggtccgtcggtacgaacggtacttaccgttaccttaactagttacctagttccgtaggtacgggtccgggtccgtacgggtacgtaaacggggccgactaagtacggntgnnnnnnnnnnnnnnnnnnnnnnnnnnnnnnnnnnn

SEQ ID NO: 192674 - DNA, 521 bp, Homo sapiens
  misc_feature: GYAE6OF02GN4EE.44.23.C01.1.454.CMB.1.raw
  modified_base (487)..(487): a, c, t, g, unknown or other
  misc_feature (487)..(487): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgccccctaaagtcccctgacttcttttactggactccacttttgaagagtggagtcccagccaggttcaggcggcagtcggttctggggactactatttcactctcaaccatcagcagcctgcagcctggagtattcgcgtacttatactgccaactatattcttttatccgtatgtttgaccgagggacagcgtgagatacaaggatgnggctagcacatctgtcttcactccttcccgctac

SEQ ID NO: 192675 - DNA, 591 bp, Homo sapiens
  misc_feature: GYAE6OF02GJLSD.44.23.C01.1.454.CMB.1.raw
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (411)..(411): a, c, t, g, unknown or other
  misc_feature (411)..(411): n is a, c, g, or t
tcagacagtatatacacgaccggtgctcgatttagtacacgtgattagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaacgaaaaggggagacggcccctaaggtcctcgtctctcgtagaaaccngactggaaggtagacgtcccgtacaggttcagtcgccagtccgaggtggtcgggccggagtccactctcactattagccgacctcggcggcctgaacgtnttcgtgactaacttatttctgtcagtctagtatcagtacgtcgtccccgttctacgtttcggccgtaggggacctaaggtcgtaaggaaactaccgaaacgtacgttgtacggccgtacgacctaacctagttccgttagttaccttactaccgttcccgttccccgacctacgttaccg

SEQ ID NO: 192676 - DNA, 832 bp, Homo sapiens
  misc_feature: GYAE6OF02HJWWX.44.23.C01.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgcgacatcgagatgacccagtctccttccttcctgtcttcttctgttggaggcagcgtcaccatcattgccggnagtcaggtcgtttcgngctgttgctgttcaagaaaaggggnacggcccctaaggtcctcgtctcgtcgtagaaaccagacgtagggaaggtagacgtcccgtccgtaggttccgaggtcgcctagttcccgaagggttcgggtcggggacccggtaacggtccctaacgtcctaccgaaccgtaagtttacggccgaacccgttcggacccgggtcccgtaggtaaacggtactttccgttacggtaccgttaaaccgttttacttttaccgtaggttaccgtaacggtaccgtaaggttaacttaccgttaagttacggttaccggttacccccggttttacttaaccgtttttttccggggaaccccggtaaaccgggggggttaaaccctaaacgggttaacccggttaaggggtaaaaaaccgttacccggtaaaaaaacccggttaaaccggtttacgggttaaccggggtacccgtttaccggggaaccctaaaccccggtaacgttttacccgtttacggtttaccccgttttaccgtaacccggtttccccgttacccccggtaacccgtaacccttttaccggttaccggttaaactttaaccg

SEQ ID NO: 192677 - DNA, 666 bp, Homo sapiens
  misc_feature: GYAE6OF02GRLBX.44.23.C01.1.454.CMB.1.raw
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggtcgttttcggngcttgttgccttggtttacaaacgaaaaaggggggtnacggtacccctaaggtcctcgtctctcgtagaaccagactggaaggtagacgtccgtcaggttcagtcgccagtccgagggtgggtcggggccggagtccgactccaccgaacctattacggcgtaaccctcggacgggtccctaggaacgtcttccgtagaccttaaacttttatttctgtcagtctaagttcactatacggtccgtcccgtttactaccgttttgggacccggaacggggtaacctaacgggtacgtaacggtaaaacgtaccgtaaaaccgtaacgttcgtcggtacgtccgaacctaacccgtagttccgttcgttacctttacgtaccgtttccccttaccccggtacttaacgtccttagtaaatttaacg

SEQ ID NO: 192678 - DNA, 656 bp, Homo sapiens
  misc_feature: GYAE6OF02G2BPU.44.23.C01.1.454.CMB.1.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgccttggttcaacgaaaagggggngacggcccctaaggtcctcgtctctcgtagaaaccngacgaggaaggtagacgtcccgtcaggtcagtcgccagtccgagggtcggtgggccggagtcccaactcctcgaacctattacgaccgtacctggaccggaccgtgaacgtacttccgtagtctaaacttttatttaccgtgtacgacgtctaacgtatacctaataggttccgtccccgtttcgtaccgtttttccgggaccggtaaccggggtacccaaggtccgtaacggtaaacttaaccgaaaacggtaaccgtgtacggtaccgttcgacctaccgtaagtccttcggttacctttaccgtcttacccgttaccccgtacctactttccgttagtattaacg

SEQ ID NO: 192679 - DNA, 591 bp, Homo sapiens
  misc_feature: GYAE6OF02IW8AB.44.23.C01.1.454.CMB.1.raw
  modified_base (273)..(273): a, c, t, g, unknown or other
  misc_feature (273)..(273): n is a, c, g, or t
  modified_base (478)..(478): a, c, t, g, unknown or other
  misc_feature (478)..(478): n is a, c, g, or t
  modified_base (549)..(549): a, c, t, g, unknown or other
  misc_feature (549)..(549): n is a, c, g, or t
  modified_base (582)..(582): a, c, t, g, unknown or other
  misc_feature (582)..(582): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaacgaaaaagggggngaggcccctaaggtccctcgtctctcgtagaaaccagactggaaggtagacgtcccgtacaggttcagtcgaccgagtccaggtggtcgggccggagtccaactctacacctattacgcgacctggccggtacctgaacgtacttcgtacgacctaactttatttctcgttacagactagtactcgaactagtccgtcccgtttntaccgttttcggaccgtaaggggacctagtacgtaggaaactaccaaaacgtactagtcggctgacctacnctacgttcgtacttcagttccttcccgactacnctagataac

SEQ ID NO: 192680 - DNA, 629 bp, Homo sapiens
  misc_feature: GYAE6OF02HML4H.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggtttcagcgtcaccatcacttcgcccgggcgagtcaggtcgttttcggtgctgttgcctggtttcaacgaaaaagggggagacggtcccctaagggtcccccgtctctcgtcgaaaccagactaggaaggtagagtacccgtccaggttcgagtcgccacgtccgaggtggtgggcggacgtccactctcaccattagcgactcgcggcctagaagattctgctaaactttatttctcgtcagtcagttactacattagtcgccccgttactacgttttacggccgtaacggggacctaacggcgttacgggaaataccgaaaaccgtaaccgttacggtacggtaccgtacgccaacctacgtaccttcgttctttaaccgtacgttcccgttttcccgacctactttcctacggtttataactttaaccg

SEQ ID NO: 192681 - DNA, 576 bp, Homo sapiens
  misc_feature: GYAE6OF02HW4I9.44.23.C01.1.454.CMB.1.raw
  modified_base (241)..(241): a, c, t, g, unknown or other
  misc_feature (241)..(241): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngtctgttgccttggtttacaacgaaaaaggggagacggcccctaaggtcctcgtctctcgtgaaaccagactggaaggtagacggtcccgtcaggttcagtgccagtccagggtggtgggccggagtccactctcacattagcgacctgcggcctagagtatctgactaacttatttctgtcagcagtatactatagttcgtcccgttacgtacttttggaccgtaggggacccaaggtactacggaaactacgaaacgtacgtagtcgcgtcgcaaccgattcctagttccttacgtacttcccttcccggacctatcccgttagtacttaacg

SEQ ID NO: 192682 - DNA, 629 bp, Homo sapiens
  misc_feature: GYAE6OF02H74V6.44.23.C01.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
  modified_base (403)..(403): a, c, t, g, unknown or other
  misc_feature (403)..(403): n is a, c, g, or t
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
  modified_base (578)..(578): a, c, t, g, unknown or other
  misc_feature (578)..(578): n is a, c, g, or t
  modified_base (612)..(612): a, c, t, g, unknown or other
  misc_feature (612)..(612): n is a, c, g, or t
tcagacagtatatacacgaccggtgctcgatttagtacacgtgattagggagttggggagtcagaccctgtcaggggacagcatggacatgagggtcccgctcagctccgtggggctcctgctgctctggctcccaggttcgagatgtgacatcgagatgaccagtctccttcttcctgtctctctgtggagcagcgtcacatcagttgccgggcagtcgaggttcgttttcggngcttgtgccgttggtttacaaaacgaaaaagggggnacggtccctaaaggtccttcggtctacgtcgtacggaaaaccnggactaggtaaaggtaacgacgttcccgtacctagggtttaccaggtcgccctaagtccgaaggtcgggtggccggaacgtccacttcnccacgtacttaagcgacctcggcgtccgtagaacgtatttcgngtactaacttttatttcgattaccgagtacagttactcaagttgtccgacccctttntacgtttcggcgtaaacggggacctagtccaaaggtaaactaacgtaaaaccgtactgggtacgtacgcgtaacncctaagtccctagtcctacgtccttcctcccgtntaacgtctagattaacc

SEQ ID NO: 192683 - DNA, 718 bp, Homo sapiens
  misc_feature: GYAE6OF02JDKWC.44.23.C01.1.454.CMB.1.raw
  modified_base (365)..(365): a, c, t, g, unknown or other
  misc_feature (365)..(365): n is a, c, g, or t
  modified_base (656)..(656): a, c, t, g, unknown or other
  misc_feature (656)..(656): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatcgaccctagtcctccttccttcctgttcttcttctgttggaggcagcgtcaccatcacttgccggcgagtctaggttcgttttcggtgcttgttcgtccgttggtttacaaaacgaaaaagggggtcacggtccccgtaacggttcctcgtctacgtcgtagaaacctagtactggaaggtacgcgtcccgtcgtaggttcaggtcnccgagtccgtagggtcggtcgggccggtacgtccactcgtcacgtagttacgacgtacctcggcgtacccgtaggaacgtacttcgtacggtaccttaaacttttactttccgtagtactaacgggtactaacggtttaactattaacgtttacgggttacccgtcccggttttaccttaacggttttccgggacccgtaaaccgggggtacctaaagggttccctaaagggtaaaacccttacgtaaaaccggtaaacttcgggttacgtaccgtcgaacgtaacccgtntaccggtttgtaacccttacgtacctttcccttaccccggacttacgttcctagttactaac

SEQ ID NO: 192684 - DNA, 593 bp, Homo sapiens
  misc_feature: GYAE6OF02GHB5W.44.23.C01.1.454.CMB.1.raw
  modified_base (274)..(274): a, c, t, g, unknown or other
  misc_feature (274)..(274): n is a, c, g, or t
  modified_base (456)..(456): a, c, t, g, unknown or other
  misc_feature (456)..(456): n is a, c, g, or t
  modified_base (535)..(535): a, c, t, g, unknown or other
  misc_feature (535)..(535): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggtgctgttcgcctggtttcaacgaaaaagggggngaggcccctaaggtcctcgtctcgtcgtcgaaaccagactggaaggtagagtcccgtcaggttcagtgccagtccgaggtggtgggccggagtccactctcaccattacgcgacctggcggcctgaagtcttctgactaactttatttctgtcagtcagtatactatacgtcgtccccgttntaccgttttcggccgtacgggaccaaggtctacggtaaataccgaaaacgtacgttacggtacgcgtacgcctaaccgnttccgttaggttccttacgtacttcccgttccccgcctaccttccgttagtattaacg

SEQ ID NO: 192685 - DNA, 699 bp, Homo sapiens
  misc_feature: GYAE6OF02IPE7Z.44.23.C01.1.454.CMB.1.raw
  modified_base (143)..(143): a, c, t, g, unknown or other
  misc_feature (143)..(143): n is a, c, g, or t
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcganatgtgacatcgagatcgaccagtctccttcttcctgtcttcttctgttggngcagcgtcaccatcacgttgccgggcgacgtctacgggttcgttttcggtgtcgtgttgcccgttggtttcaaaacggaaaaagggggngtaacggcccccgttaaaggttcctttcgtccttcgtacgtacgaaaacccagacgtagggtaaggttacgacggtcccgtccgacggtttcgaggttcgccgtacgtccggagggtgggtcgggggcccggtagtacccaccgttcctacgaacccttagttacgccggtaaccctggcccggtctcggaagttacttccgttagacctaactttctttcgtagtcaggctaggttacacgtacgttacgtccgttccccgtttcgtttaccgtttgggacccgtaacggggtacccaaagtaccggttaaggaaaccttaaccaaaaccggtacgttacgtcggtactcgactaaccgtacgttcctcgttaccttacttacctcccttcccgactacttctacgtaacttacg

SEQ ID NO: 192686 - DNA, 547 bp, Homo sapiens
  misc_feature: GYAE6OF02FPUVS.44.23.C01.1.454.CMB.1.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
  modified_base (450)..(450): a, c, t, g, unknown or other
  misc_feature (450)..(450): n is a, c, g, or t
  modified_base (509)..(509): a, c, t, g, unknown or other
  misc_feature (509)..(509): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaacgtaaaaagggggnaggcccctaaggtcctcgtctctcgtnaaaccngactggaagtagacgtcccgtcaggttcagtgccagtccaggtggtgggccggagtccactctcacctattacgcgacctgccggcctagaacgnttctgactaacttatttctgtcagcagtatctatagtcgtcccgttntacgttttcggccgtaggggaccaaggtctaggaaactcaaacgactgtagctgcacgntctgtccttcacgttccttcccgcctactctagtatac

SEQ ID NO: 192687 - DNA, 559 bp, Homo sapiens
  misc_feature: GYAE6OF02G48BM.44.23.C01.1.454.CMB.1.raw
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggngctgttgccttggtttcaaacgaaaagggggnaggcccctaaggtcctcgtctctcgtagaaaccagacgtggaaggtacgacggtcccgtccgtaggttcagtcgccagtccgagggtggtcgggccggtatccactcacacattagcgtaaccgtgcggcctggaacgtattctgacctaaactttntttctcgttnaagtcagtntacatcggtcgtcccgttntacgtttcggaccaggggtacccaggctaggaatcaaagactgngctgcacctgtcttcgtcttcacgttctcccgctactcgtnatacg

SEQ ID NO: 192688 - DNA, 225 bp, Homo sapiens
  misc_feature: GYAE6OF02FZNDR.44.23.C01.1.454.CMB.1.raw
  modified_base (220)..(225): a, c, t, g, unknown or other
  misc_feature (220)..(225): n is a, c, g, or t
tcagacagtatatacacgaccggtgctcgatttagtacacgtgattagggattggggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnn

SEQ ID NO: 192689 - DNA, 650 bp, Homo sapiens
  misc_feature: GYAE6OF02HFNEE.44.23.C01.1.454.CMB.1.raw
  modified_base (276)..(276): a, c, t, g, unknown or other
  misc_feature (276)..(276): n is a, c, g, or t
  modified_base (467)..(467): a, c, t, g, unknown or other
  misc_feature (467)..(467): n is a, c, g, or t
  modified_base (501)..(501): a, c, t, g, unknown or other
  misc_feature (501)..(501): n is a, c, g, or t
  modified_base (616)..(616): a, c, t, g, unknown or other
  misc_feature (616)..(616): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttctctgttggaggcagcgtcaccatcacttgccgggcgagtcgaggttcgttttcggtgctgttgccgtggttttcaaacgtaaaaagggggngacggaccccgtaaggtccctcgtctctccggtagaaaccaggacctgggaacggtagacgtcccgtaccaggttcagttcgaccgtcgtacccgtagggtggtcggggccggtagtccgactctcaccacgttacgccgtacccgtgccggcctggaagtactttcgtgacctaacttttctttctcgtnacgcagttatcctaagtacgtccgtccccgtttntacgttttcggccgtaacggggaccctaagtcgtagggaacgttaatacccgtaaaacggtaaccgttgttcggacgttcggacctaaccgtagtcccttcgttccgttttaccncgtttaccctccccggactagttcccgtataacg

SEQ ID NO: 192690 - DNA, 644 bp, Homo sapiens
  misc_feature: GYAE6OF02GUB7J.44.23.C01.1.454.CMB.1.raw
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (412)..(412): a, c, t, g, unknown or other
  misc_feature (412)..(412): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttgccttggtttacaaacgaaaagggggngacggcccctaaggtcctcgtctctcgtagaaaccagacgtggaaggtagacgtcccgtctaggttcaatcgccagtccgagggtggtcgggccggagtccactctcacctattacgcgacctggccgctgaagtnttctgtcctaactttatttcgtgtcagtctagtatctaagtacgttccgtccccgtttacttaccgttttcgggacccgtaaggggggtaaccctaaaggtccgttaaacgggaaacttaccgtaaaacggtaaccgttgggtacggcttacgacctaccgtaacttccgttcgttacctttaccgtaactttccccgttaccccgaccttagttaccgttagtaccttaag

SEQ ID NO: 192691 - DNA, 640 bp, Homo sapiens
  misc_feature: GYAE6OF02FOF7Z.44.23.C01.1.454.CMB.1.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggngctgttgcctggttcaacgaaaagggggngaggcccctaaggtcctcgtctctcgtgaaaccagactaggaaggtagacgtcccgtcaggttcagtcgccagtccgaggtggtgggccggagtccactctcactattacgcgacctgcggtcctgacgtnttctgactaaactttntttacctgtactacgctaagttatctaagtacgtcgtacccccgttacgtaccgttttcgggacccgtaacgggggtaccctaagggtaccgttaagggtaaacttaccgtaaaaacgtaccgtagggttcggtaccgttcgacctaaccccgtaattccgtacgttcctttacaacctttcccgttaccccgtaccgttacttaccgtacgtaacttaacg

SEQ ID NO: 192692 - DNA, 711 bp, Homo sapiens
  misc_feature: GYAE6OF02IY6HT.44.23.C01.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (452)..(452): a, c, t, g, unknown or other
  misc_feature (452)..(452): n is a, c, g, or t
  modified_base (488)..(488): a, c, t, g, unknown or other
  misc_feature (488)..(488): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggcctccgaggttcgagatgtgacatcgagatcgacccagtcctccttccttcctgtcttctctgtggagctagcgtcacntcatcgccggngagtcgagttcgtttgnctgtgcttggttacgaaagaaaaggggngacggccgtaaggtcctacgtctcgtcgtacgaaaccagtacgtaggaacggtaacgaccgttcccgtaccgtaggtttcgaagtcggaccctaaacggtcccgtaaggggttcgggtgggggaacccgtacggtacccagttccgtacacccgttaagttaacggcgaccttaggcccggtacgtanaaacggtcttacgtagtacgtaaacctttattttcngttaccgagtactaagtatccgaattaacggtccgttacccgttacgtacttttacgggaacccgtaacggggtaaccaaaccggtagtaaccggttaaagtaaacgaaaaccgtaacgttaggtaccgtcgttaaccgactaacccgtacgttaccgttacgtttcgttaccttaacgttacccgtttccgaccgtaaccgtttacgtaccgtaatttaacg

SEQ ID NO: 192693 - DNA, 526 bp, Homo sapiens
  misc_feature: GYAE6OF02GA7IP.44.23.C01.1.454.CMB.1.raw
  modified_base (103)..(103): a, c, t, g, unknown or other
  misc_feature (103)..(103): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (333)..(333): a, c, t, g, unknown or other
  misc_feature (333)..(333): n is a, c, g, or t
tcagacagtatatacacgaccggtgctcgatttagtacacgtgattagggagttgggggagtcagaccctgtcaggggacagcatggacatgagggtccccgntcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggttcaacaaaaaggggnaggcccctaaggtcctcgtctctcgtgaaaccagactggaaggtagagtccgtcaggttcagtnccagtccaggtggtggccgagtccacgtctcaccattagcgtactgcggctggaagtattctgtcaaacttatttctgttcagcagtatcatagtcgcccgttctacttttggccaggggaccaagctaggaatcgaaacgactagtgctgcacgactcgtgtcttacactcttcccgacactctagataacg

SEQ ID NO: 192694 - DNA, 752 bp, Homo sapiens
  misc_feature: GYAE6OF02FLC4O.44.23.C01.1.454.CMB.1.raw
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
tcagacagtatatacacgaccggtgctcgatttagtacacgtgattaaggggagttgggggagtcagaccctgtcaggggacagcatggacatgagggtccccgctcagctccgtgggctcctgctgcctctggcctcccaggttcgagatgtgacatcgagatcgacccagtcctccttccttcctgtcttcttctgttggaggcaggcgtcaccatccacgttcggccggcgagtcgaggttcgttttcggntctgttgccttggtttacaaacgtaaaagggggnacggccccttaaggtcctcgtactcgtcgtacgaaccagacgtaggaaggttagacgttcccggtacgaggtttccagttcgacctgtaccgagggttgggtcgggccggtagtcccaacgtccgtaccaaccgtagttacggccgtaaaccgttcggtacccgggtacccttagggaaacgtcgtttaccgttacggaccgtttaaaccgttttatttttaccgttacgttacctaacggtaccttaagttaacgttaccgttaaagtaccggtttcccggtacccccggtttagtttaacccggtttttacgggacccgttaacggggggtaacccctaacgggtcgttaacgggtaaaaccttaccgaaaaacccggttctaacgggttacggacttacggacctaaccgtacttccgttacgtccttcaccgttcctccgacctacgtcgtacattaacg

SEQ ID NO: 192695 - DNA, 918 bp, Homo sapiens
  misc_feature: GYAE6OF02ILUH5.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgaggttcgttttcggtgcgttgttcggccttgggttttaccaaaacggtaaaaaagggggggagtaacgggtacccccttaaaggggttccccttacggtccttccgttaccggttacggaaaacccgaggtaaccgttaggggaaaacggggttacggaaccggttcccccggttaccgaacgggtttaccaacggttcggaccccgtaacgggttccccgtaaaggggggttcggggttacggggggccccggggtaacggttccccgaaccgttacccgttacccgtaaaccccgtaacgttttaaccgggcccgtaaacccgttcgggacccgggtcccttaagggaaacgttacttttacccgtacggtacccttaaaacctttttacgttttaccgttacggttcgtaaacggtaccgtaacgtttaagtccgttaaagtttacggttacccgtacccccggtttacgttaacgtttttccggggacccgtaaccgggggtaaccctaaacggtccgttaaacgggtaaaaccgttaaccgaaaaaccggttaaacgttcgggtaacggttacgtaccggtaacccgtaacccgtaacgttcccggttacggtttacccttttaccgtaaccgttttcccccgtttacccggcccttaaccgtttcgttacggtaacctttaacg

SEQ ID NO: 192696 - DNA, 670 bp, Homo sapiens
  misc_feature: GYAE6OF02FW3LQ.44.23.C01.1.454.CMB.1.raw
  modified_base (239)..(239): a, c, t, g, unknown or other
  misc_feature (239)..(239): n is a, c, g, or t
  modified_base (304)..(304): a, c, t, g, unknown or other
  misc_feature (304)..(304): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctcccttccttcctgtcttcttctgtggagcagcgtcacatcacttgccggacagtccaggttcgtttcggnctgtcgccttgttacaaacgaaaaggggcacggacccttaaggtcctacgtctcgtcgtacaacngactggagtagacgtcccgtccgaggttcagtgccctagtccgaggttggcgggaccgtaggtcccacgtctaccactacgttacgacgtacctcggcccggtacttaggaatacgtttccacggtaccttaacttttcgtttactggtaccgagtactaacggtcttacgagtaccgttaccggtccccttagttaccgtttcggacccggtacgggaaccctacggtacgtaacgtaacgtaaccgtaaaacgtccgttgggtacgtaccgtaggacccttaacccgtagtaccgtttacgttccctttaccgtaaccgttcccccttacccgttacgtaaccgtcggttataacctttaaccg

SEQ ID NO: 192697 - DNA, 753 bp, Homo sapiens
  misc_feature: GYAE6OF02FHHBZ.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngtctgttgccttggttcaaacaaaagggggngagggaccccttaagggtcccttcggtactcgtcgtagaaaacccgagaccgtggaaaggttagacgttccccgtacaaggttccaaggtgacccgagttacccgaagggtcgggttacggggacccggtaggtcccaacgttccgttaccaaccgaagtttacggaccgtaacccgttgggaccggacccttaggaaacgtctttaccgtaggacccttaaacttttaacgttttcccgtggttacctaacggtacctaaaggttacttaacgtaacgttaaccgggttccggtaccccccgttttacgttaaccgtttttccgggacccgtaaacggggtacccaaacggtcgttaaggaaacttaacgaaaaaccgtacgttggtaggtaccttcgaccaaccgtagttaccgtcgtttacccttacgtaaccgttcccgtttaccccggacctaacgttccgttaagtactttaacg

SEQ ID NO: 192698 - DNA, 578 bp, Homo sapiens
  misc_feature: GYAE6OF02FVZF5.44.23.C01.1.454.CMB.1.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (417)..(417): a, c, t, g, unknown or other
  misc_feature (417)..(417): n is a, c, g, or t
  modified_base (527)..(527): a, c, t, g, unknown or other
  misc_feature (527)..(527): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttacaacgaaaagggggnaggcccctaaggtcctgtctctcgtgaaccagactggaaggtagacgtcccgtcaggttcagtcgccagtccaggtggtggggccgagtccacgtctacacctagttacgcgacctgaccggcctagaagtcttcgtgctaacttntttctgtcagctagtatctatacgtcgtcccgttctacgttttcgggacctaacgggggaccaaggtcgtaggaaactacgaaacgtacgtgtacggctcggacaccgtntaccgttctccttacgtacgttccttcccgtacctactcctagtacttaac

SEQ ID NO: 192699 - DNA, 1011 bp, Homo sapiens
  misc_feature: GYAE6OF02F8FXQ.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatctacttcggccgggcgagtccgtagggttccggtttttcggtgccgttggttcggtcccgttgggttttaccaaaaccggaaaaaagggggggtacgaaccgggtacccccgttaaagggtcccttaccggttccttccgtccggtagaaaacccaggtaccgtagggaaagggttacgaacggttcccgtaccgtaagggtttccaaggttcgaccgacggtcccgaagggttcgggtcgggggacccgggtaagtcccctaactcctaccgaaccctaagttaacggaccggtaacccgttcgggacccgggtacccgttacgggtaaaacgttacgttttcccgtaacggtaccctttaaaaaccgttttttacgtttttacccgttagggtttaaacccgacgggttaaccctaaagggtttaactttaaccgttaaaacgggtttaaaccggggttttccccgggtttaccccccccggttttaacgtttaaccccggttttttttacccgggggaaacccccgggttaaaaccggggggggtttaaacccccttaaaaaccgggggttaccccgggtttaaaaacgggggtaaaaaacccgtttaacccggttaaaaaaaacccggttaacccggggttttaacggggttacccggggtaccgtttaaccgggaccccgttaaaaccccgtacggttttacccgtttacgggtttacccttttaccgtaacccgttttccccgtttaccccccgggaccttaaccggtttaccggttacgttaacttttaaaccgg

SEQ ID NO: 192700 - DNA, 635 bp, Homo sapiens
  misc_feature: GYAE6OF02H93HV.44.23.C01.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (428)..(428): a, c, t, g, unknown or other
  misc_feature (428)..(428): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttggccgggcgagtcaggtcgttttggngtctgttgccttggttacaagaaaaggggnacggtccctaaggtcctcgtctctcgtacgaacagtacgtggaaggtagacgtcccgtccgtaggttcagtgccgagtccgagggtggtcgggccggtagtccacgtctccactagtacgcgtacctggccgtctaggatattcgtgtactaactttntttcgtgttcacgtctacgttatactaagttacgttccgtccccgtttactacggttttcggaccggtaacgggtaacccgtagtacgtaacgggtaaacttaaccgtaaaccgtacgtcggttacgtctacgacctaccgtaacgttccttacgttccttacgttacttacccttaccccgtcttaaccttcgttagtacttaacg

SEQ ID NO: 192701 - DNA, 223 bp, Homo sapiens; identical to SEQ ID NO: 192141
  misc_feature: GYAE6OF02GKXBB.44.23.C01.1.454.CMB.1.raw
  modified_base (219)..(223): a, c, t, g, unknown or other
  misc_feature (219)..(223): n is a, c, g, or t

SEQ ID NO: 192702 - DNA, 753 bp, Homo sapiens
  misc_feature: GYAE6OF02F6HEJ.44.23.C01.1.454.CMB.1.raw
  modified_base (278)..(278): a, c, t, g, unknown or other
  misc_feature (278)..(278): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttcgccttggtttcaaacgtaaaaaggggggngacggccccttaaggtcctcgtctcgtcgtacgaaaccagtaccgtaggaaggtacgacgttccccgtccgtaggttcaagtcgcccgagtcccgaagggttcgggtcggggcccggtaagtcccaacttcctaccgaaccctagtttacggccgtaaccgttcggacccgggtaccctaggaacggttaactttccgtacgggtaacctaaaccgtttttaagttttccgttacggttacccaacggtaccttaaacggttacttacgtaacgttacggttccggtacccccgttttacgttaccgtttttacgggcccgtaacggggtaaccctaaggtccgttaagggtaaaccttaaccgaaaaccggtaacgttggtacggtccgttacgacctaacccgtacgttacgttacggttccttacgtaccgttccgtttaccccgaccgttacttccgttagtactttaacg

SEQ ID NO: 192703 - DNA, 643 bp, Homo sapiens
  misc_feature: GYAE6OF02HTGFJ.44.23.C01.1.454.CMB.1.raw
  modified_base (291)..(291): a, c, t, g, unknown or other
  misc_feature (291)..(291): n is a, c, g, or t
  modified_base (450)..(450): a, c, t, g, unknown or other
  misc_feature (450)..(450): n is a, c, g, or t
  modified_base (581)..(581): a, c, t, g, unknown or other
  misc_feature (581)..(581): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctgctccaggttcgagatgtgacatcgagatgacccagtctccttccttcctgtcttcttctgttggaggcagcgtcaccatcacttcggccgggtcgagtcgtacggttcggtttttcggtgtcgttgttcgtccgttggtttaccaaaacggaaaaagggggngacggtaccccgtaaggtcctcgtctcgtcgtagaacctagacgtaggaaggtagcgtcccgtcgtaggttcagtcgcagtccgtaggtcgggtcgggccggacgtccactcctacactagtacgccgacctggccgctagatattcgtgactaatttnttcttgtcagctaagtctacgtagttacgtccgttccccgttacgttacgttttccgggaccgtaacggggacctaaggtccgtaaggaaactaccgaaacgtacttacggtcgcttacgcctaacccgtnttccgttcgttacccttacgtacctttacccgttcccgtaccttacgttactgttaattacg

SEQ ID NO: 192704 - DNA, 713 bp, Homo sapiens
  misc_feature: GYAE6OF02JHT5O.44.23.C01.1.454.CMB.1.raw
  modified_base (383)..(383): a, c, t, g, unknown or other
  misc_feature (383)..(383): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacgttcgccgggcgtaagtccgtaggttccgttttcggtgcttgttcgtccgttggttttacaaaacggaaaaagggggcgacgggtaccccgtaacggtcccgtcgtacttaccgtcggtagaaaccgagaactagggaaggtacgacgtcccgtaccaggttcgaacgtcnccgagtccgaaggttcgggtcgggaccggagtccacgtctaccaacgtacgtacggccgtaaccgttcggacggtaccctagggaacgtactttccgtaggaccttaaacttttgtttacgtggttaccaaggtactaacgttatacctaagtttaccgtccgttaccccgtttaccttacgttttcggggacccggaaacggggtaccaacggtacgtaaacggtaaacgtaaccgaaaacggtaacttcgggagtaccgtcgacgtaaccctcgttacgttacgttctacgtaacttcccgttacccgactactcgtacgtattaacg

SEQ ID NO: 192705 - DNA, 455 bp, Homo sapiens
  misc_feature: GYAE6OF02GYXI7.44.23.C01.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (425)..(455): a, c, t, g, unknown or other
  misc_feature (425)..(455): n is a, c, g, or t
tcagacagtatatacacgaccggtgctcgatttagtacacgtgattagggattgggggaagtcagccataatggaagcaccagctataaacccgtccctcaagagtcgactcaccatctccgtcgacacgtccaagagacagatgtccctgagtctgacgtctgtgaccgccgcggacgcggctgtgtatttcngtgcgagaggcccnggtaccagcgagtggtacctctactactactctctggactctggggccaggggaccgcggtcaccgtctcctcagcctcaccaagggcccaatcggtcttccccctggcaccctcctccaagagcacctctggggggtcacaggcgccctgggctgcctggtcaaaggactacgttcctaatatactgtctgagcgggctggcaaaggcgcataagnnnnnnnnnnnnnnnnnnnnnnnnnnnnnnn

SEQ ID NO: 192706 - DNA, 813 bp, Homo sapiens
  misc_feature: GYAE6OF02I9FR5.44.23.C01.1.454.CMB.1.raw
  modified_base (255)..(255): a, c, t, g, unknown or other
  misc_feature (255)..(255): n is a, c, g, or t
  modified_base (779)..(779): a, c, t, g, unknown or other
  misc_feature (779)..(779): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctccaggttcgagatgtgacatcgagatcgacccagtcctaccttccttcctgttcctttctcttcggttggacggcagtccgtcacctatcacttgccgggctacgtcgaggttccgttttcggngtccgttggttcgccgttggttttacaaaacggtaaaaacggggggctacgggtacccccgttaaagggtcccttccggttacgttcgtacggttaacgaaaacccgtagggtaaccgttagggaacgggttaacgtaccgggttaccccgtaacggttacgggttaccaaacgggttcggaacccgtagggttacccctaaagggggttcggggtaccggggggacccgggttaaagttccccgaacggttacccgtttaacccgaaacccggttaacgtttaccgggaaaccccggtacccgtttacgggggaccccgggttacccggttaaacgggaaacggttaaccgttttccgtaacgtaccgttaaccgttttaacgtttccgttacgtacgtaccggtacttaacgtacttacgtagttaaccggtccgttacccgttagtaccgttttcggaccgtagggacctacgtcgtacgtaacgtaccaaacggtactcgtagtctacgactacgacttntactcgtactacgtcctccgacctatctatatac

SEQ ID NO: 192707 - DNA, 533 bp, Homo sapiens
  misc_feature: GYAE6OF02IIKB1.44.23.C01.1.454.CMB.1.raw
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(499): a, c, t, g, unknown or other
  misc_feature (498)..(499): n is a, c, g, or t
  modified_base (502)..(502): a, c, t, g, unknown or other
  misc_feature (502)..(502): n is a, c, g, or t
  modified_base (504)..(507): a, c, t, g, unknown or other
  misc_feature (504)..(507): n is a, c, g, or t
  modified_base (511)..(511): a, c, t, g, unknown or other
  misc_feature (511)..(511): n is a, c, g, or t
  modified_base (513)..(514): a, c, t, g, unknown or other
  misc_feature (513)..(514): n is a, c, g, or t
  modified_base (516)..(518): a, c, t, g, unknown or other
  misc_feature (516)..(518): n is a, c, g, or t
  modified_base (520)..(522): a, c, t, g, unknown or other
  misc_feature (520)..(522): n is a, c, g, or t
  modified_base (524)..(524): a, c, t, g, unknown or other
  misc_feature (524)..(524): n is a, c, g, or t
  modified_base (526)..(530): a, c, t, g, unknown or other
  misc_feature (526)..(530): n is a, c, g, or t
  modified_base (532)..(533): a, c, t, g, unknown or other
  misc_feature (532)..(533): n is a, c, g, or t
tcagacagtatatacacgaccggtgctcgatttagtacacgtgattagggattggggaagtcagccataatggaagcaccagctataaccccgtccctcaagagtcgactcaccatctccgtcgacacgtccaagagacagatgtccctgagtctgacgtctgtgacccgccgcggacgcggctgtgttatttctgtgcgagaggtccctggtaccagccgaagtcggtacctctactactactcctctggactcgtggggccgaggggaccgcggtcaccgtctcctcacgcctccaccgaaggcccagtcggtcccttccccctcgggccaccccgtcctccaacgacgccacccgtcgtggtcgggccacgacgccggccgtcgggctcgcccgttggtacaacggtacctacgtttctagttactacgtgtcctggtacgcggggtcctgggtacgaaggccgtagtaagngtacgctgcngtcagcgtncngnnacngnnnnctgngnncnnncnnncngnnnnncnn

SEQ ID NO: 192708 - DNA, 690 bp, Homo sapiens
  misc_feature: GYAE6OF02I0APM.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctcgtggtatttccatcagttctgactctattcgttggggctggacgtccggcacgcccccgagggaggggaactgggacgtgggtacgttgggtagactacgtacctaatttacgtaacgttcgggggtacgaacggttaaccttaacctccgtcccgttacccgttacaaacggtaacgttcgtcctacacctagtttacggacgggtacaccgtccacgtcgaaccgtccttacctccctacgaaacctcgacccgtccggtacgtacccgaccggccggaaccgtaccggtaccgttttacttcgttcggtcgtaccggacgggtcgtacggtacgtcgggttactttacgtaagttaccttagggtcggggtaccgtaccgggtcctaccgttcgggtaccttacgtcgtccgttccctacgtacgtccctttaccgaccgtaaccgggtcccaggttccccgg

SEQ ID NO: 192709 - DNA, 760 bp, Homo sapiens
  misc_feature: GYAE6OF02FZS7P.44.23.C01.1.454.CMB.1.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggagcagcgtcaccatcacttgccgggcagtcaggttcgttttcggngctgttgccttggttcaaacgaaaagggggnacggcccctaaggtcctcgtctctcgtagaaccaggactaggaaggtagacgtcccgtcctaggttcaggtgccagtccgaggtgggtcggggccggtagtccgactcgtcacctagttacgccgtacctcggccgggtcctagggaacgttactttccgtacgtacctaaaccttttactttttccgtcggttaccgtacggtacctaacgggttaactttaccgaagttacgggtttccggttacccccccggttttacgttacccggtttttttaccggggacccgttaaaccgggggggtaaaccctaaaccgggtaccgtttaaacgggtaaaaccgttaaccggtaaaaacccgtaaaccgtttcgggtaacgggttcccgttacggtaccctaacccggttacgtttaccgttacggttttcccttacgtaccgtttcccggttaccccgtaccgtaactttccgtacggtaactttaaccg

SEQ ID NO: 192710 - DNA, 593 bp, Homo sapiens
  misc_feature: GYAE6OF02FMFPS.44.23.C01.1.454.CMB.1.raw
  modified_base (415)..(415): a, c, t, g, unknown or other
  misc_feature (415)..(415): n is a, c, g, or t
  modified_base (475)..(475): a, c, t, g, unknown or other
  misc_feature (475)..(475): n is a, c, g, or t
  modified_base (588)..(588): a, c, t, g, unknown or other
  misc_feature (588)..(588): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttcggtgctgttgccttggtttacaaacgaaaaagggggagacggcccctaaggtcctcgtctcgtcgtagaaaccagacgtggaagtagagtcccgtcaggttcagtcgccagtccaggtggtgggccggagtccactcgtcacctattacggccgtacctggcggtccctaggaacgtnttctgcttaactttactttctgttcacgtctaagtactactaatacgtcgtccccgtttntaccgtttttgggacccgtaagggggaaccctaaggtctaacgggaaacttaccgaaaacgtactggtacgctgccacgatctcgtaccttctacgttcctcccgcctatctntataa

SEQ ID NO: 192711 - DNA, 949 bp, Homo sapiens
  misc_feature: GYAE6OF02GP8CD.44.23.C01.1.454.CMB.1.raw
tcagacagtatatacacgaccggtgctcgatttagtacacgtgattagggatgggggaggtcacgaccctcgtcgagggttacaggtcttatggtacgagtgagggtccccgctcaagcgtccgtaggggccttcctgcgtggtcgttccgtgggcctcccgtaggttcgtagttgttggtcgaacttaagttaccggagtaacgtcggtaacccgtaggttccttcccttcctttccgtcggttcgtttcgttccgttggggttaggggaggtcgtaggtccgtacctaccggtacgtcctacgttcggcccgggtcgtgtcgtacggttcggtttcggcgtgttgttcgtccgttcgttacgaaaacggaaaagggtcgtacggtccgtaacgtccgtacgtcgtcgtccgtacggaaccacgtacggtagggaacggtacggtacggtccgtaccgtaggtcaggtcgtaccggtaggtcggtacggtgggtacggggtccggtacggtacctaccgttaccgaccgtaccgttaacgttaccggcccggtaccggtacgggtacccgggtacccgtagaaaccgttacgtttccgtagtaaccgttaaaccggtttactttacccggtaacgtaccgtaaccgtaaccgttaagtaaccttagtaaacgttaaccgttaccggttaacccctttacggttaccggttttaccggggaacccggttacggggtaaacccggtaacgggtaccctaaacgggggttaacccctaacgggttaaaaccgtaacccggttttaggggtaacccgggttacccgtacggtaaccccggtacgtaaaccggttacccgttaccggtttaacccgttacggttaacccgtttaccccggttaccccgttaaccgttcggtttaacccgttaaggttacccgttttaaaccgg

SEQ ID NO: 192712 - DNA, 703 bp, Homo sapiens
  misc_feature: GYAE6OF02F7ZUU.44.23.C01.1.454.CMB.1.raw
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatccacttggccgggcgagtccaggttcgttttcggtgcttgttcgccttggtttacaaacgaaaaagggggngacggacccctaaggtccctcgtctctcgtagaaaccngacgtggaaggtagacgtcccgtcgtaggttcagtcgccgagtccgaggtcgggtcgggccggtagtcccaacgtcctaccgaaccctagtttacggaccgtaccgtcggccggtccgtaggaacgtacgtttccgtcggtaccttaacgtttacgtttccgttgtacgaacgtccgtaaggttactacgtaagttaccgttccgtaccccgtttcttaccgttttcgggacccggtaacggggtaacctaagtccgtaacggtaaacttaccgaaaacggtaccgttgggtccggtacgtcgacctaacccgtaagttccgttacggttacccttcgtaccgttcccttccccggaccttagtacccgttagtacctttaacg

SEQ ID NO: 192713 - DNA, 558 bp, Homo sapiens
  misc_feature: GYAE6OF02IOFDD.44.23.C01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (401)..(401): a, c, t, g, unknown or other
  misc_feature (401)..(401): n is a, c, g, or t
  modified_base (510)..(510): a, c, t, g, unknown or other
  misc_feature (510)..(510): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgtcgggcgagtcaggtcgttttcggngctgttgcctggtttcaaacgaaaagggggnaggcccctaaggtcctcgtctctcgtacgaaaccngactggaaggtagacgtcccgtcaggttcagtcgccagtccagggtggtgggccggagtccactctcactattacgcgactgcggcctgaacgnttctgactaacttattctgtacagcagtatcatagtcgtcccgttctacgtttcggacgacgggaccagcgtaggaataccgaaacgtacgtagtcgcgtcgacgtacncttcctcgttcttacttacgtttacccgcttactctagtacttattac

SEQ ID NO: 192714 - DNA, 925 bp, Homo sapiens
  misc_feature: GYAE6OF02JOHF6.44.23.C01.1.454.CMB.1.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
tcagacagtatatacacgaccggtgctcgatttagtacacgtgattagggattgggatgctttctgagagtcaaggacctcctgtgcaagaacatgaagcacctgtggttttcctcctgctggtgcagctccagatgggtcctgtccaggtgcagctgcaggagtcgggcccaggactggtgaggccttcgggaaccctgtctctcgatctncactgtctctggtactttccatcagttcngtactctacttcgttcggggtcttacggtcttaccgggtccgtacgccccccggtaaggggtaccgggggaacgtacggggtacgggtacgggtaaggtttcgggtagaaccgtacgttacccgtaagttttaacgttaaccggttggggggtaccgttacgggttaaccgtttaaccgttccgttacccggtttccccgttaaccgtaaacgttaccggttaccgttcgtttacccgtaacccgttaacgtttaccgggtaacgggtaacccgtacccggttaacccgtaacgttacggaacccgttcccgttaccgttaccccgttagtaaaccgttccgttaaccccgttccgtaacggtacccggtacccggtaccggtacccggtacccggttaccggttttaccttttccgggtacgttcggtaccggtaacgggtaccggtaccgtaacgggtttaccgtttacggttttacccgtaaacgttccgtttacggtaaccggggggtttacccgttcggggacccccgtttaaccggtttccgggttaaccccgggttaacgttttcccgggggtacccctttttaccccgggtaccgtttaacccgggcccttttaacccccgggaaccccggttttaacccggggacccccgtttacccggttttaaccccccgggg

SEQ ID NO: 192715 - DNA, 776 bp, Homo sapiens
  misc_feature: GYAE6OF02HAOI9.44.23.C01.1.454.CMB.1.raw
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctctggtacgtttccattcagttcctgactctatttcgttggggtctggtactccggcacgcccccgaggggacggggaatgggagtcggtagttgggtgactagtacctatttagtacggtgggggtacctaacggttactaccgttccgtcccgttccctacgaacggtacgttccgtcctccaccgtagtttcggacggggacctaccggtacccagtaccggtaacccgtctttacccgtcccgtaacggtaaaccttccggtaaccccgttccgtaccgggtaaccccggtcccgggtaccggtaccgtacccgggtttaccgtttttacgtttccgtcggttcggaccgggtacgggtccggaacgggttaccgttcgggtttctttaacgaactttcggttaacgggttccgggggtcccgttacgggacccgttacccggtcgggttacccgttaacggttccggttcccttacccgtttacgccggtttaccccgttaccccgtaacccgggaacccgggttcccctaacggtttccccccggg

SEQ ID NO: 192716 - DNA, 888 bp, Homo sapiens
  misc_feature: GYAE6OF02GIPEV.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccgtcctcactgtctgcgtctagttggggacagagtcaccatcacttgccgggcgagtcgccgactattaggtactttttggccttggtttcagtcgaggagcctggacaaagcccctaagtccctagacttcttttctggactcctacgtttgaaggtagtacggacgttcccgagcctagggttcacggccggcgtacggttggttccgtcggggaacctacgttattttccgaacctttcgtaccctaaaccctacgttaccgaacggtcctaacggtccccgttggaacccgtacggtacccggttacggggtaaacgttaccggttttccccgggtaaccgtttaacccgttttttaacgtttaaacccggtaccgttaaacccccgtaaaaactttaaacgttttaaccgttttttttaacccgtttttttttaaacgttaaccccccggttttaagtttttaaccgggggttttttttaacccgggaaccccgggttaaccgggggggttaaacccttaaacggggttcccggttaaacgggggtaacggttaaacccggtttaaccgggaaaaacggggtttaaccgtttaacggggttaacgggtaacccgttaccggaaacccgttaacccggttaaacggttttcccgtttaacgggttttaacccctttacccgtttacccgtttaccccggtttaacccccccgg

SEQ ID NO: 192717 - DNA, 582 bp, Homo sapiens
  misc_feature: GYAE6OF02G3NSK.44.23.C01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (393)..(393): a, c, t, g, unknown or other
  misc_feature (393)..(393): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggnaggcccctaaggtcctcgtctctcgtgaaaccngactggaagtagagtcccgtcaggttcagtgccagtccaggtggtgggccggagtccatctcaccattagcgacctgccggcctgaagnttctgcaacttatttctgtcagcagtatcatagtcgtccccgttctaccgttttcggccgtacggggaccaaggtccgtagggtaaacttaccgaaaacgtacgtaggtcggtcgtacgacctaccgtaacgtccgttacgttccttacgtacttcccgttacccgaccctactaccgttagtattaac

SEQ ID NO: 192718 - DNA, 758 bp, Homo sapiens
  misc_feature: GYAE6OF02HG0JJ.44.23.C01.1.454.CMB.1.raw
  modified_base (297)..(297): a, c, t, g, unknown or other
  misc_feature (297)..(297): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgcaaaatcgagatgacaagtctccttcctctgtcttctcgtgttggacgtcagcgtacacctatcacttcgggccgggcgtagtcgtagggttccggttttcggcgtcgttggttcgtccgttggttaccgaaacggtaaaaagggggngacggtacccgtaacggtccgttcgtactccgttcgtaacgaaacctacgacgtaggtaacggtagaccgttcccggtacctacggttacgtagtcgtacctacggtccgaagggtcgggtacggggaccgtaccggtaccgtaccgtcgtaccgtaccgtagttacggccgtacccgtacggacccgtccgtacgaacgttacgttcgtacgtaccgttaacgtttactttccgtggtaactcggtactaaacgttataccgttaggtaccgttacgtacccgttttactacgtttccgggacggtaacggtaacccgaagtaccgtaagtaacgttaacgaaaccgtaacgtacgggttcgtaccgtcgtaaccgtacccgtaagttcccgtaggtttaccttacccgttaccgttacccgtaccccgttgtaaccgtttcgtaccgtaagtttaaccc

SEQ ID NO: 192719 - DNA, 647 bp, Homo sapiens
  misc_feature: GYAE6OF02HD1YD.44.23.C01.1.454.CMB.1.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctgtcttcttctgttggagcagcgtcaccatcacttgccgggngagtctaggttcgttttcggngtcgtgttgccttagggttaacgaaaaaaagggggcacggacccctaaggtcctcgtctctcggtacgaaccagacgtagggaacgtagacgtcccgtacgaggttccagtcgacctagtccgtagggtgggtgggccggagtcccactctccacctagttacggccgtacctggcccggtcctagaacgtatttcctagtacctaacttttactttctcgtacagtactagttactcgtaattacgtccgtccctttacgttaccgttttcgggaccgtacggggtaacctacggacgtacggaaactaccgaaacgtaacgtcgtagctagtaccacgtactcgttacttcgttactaccgttcccgttacccgtcctacgttcttacgtacttacttaaccg

SEQ ID NO: 192720 - DNA, 224 bp, Homo sapiens
  misc_feature: GYAE6OF02GJRWN.44.23.C01.1.454.CMB.1.raw
  modified_base (219)..(224): a, c, t, g, unknown or other
  misc_feature (219)..(224): n is a, c, g, or t
tcagacagtatatacacgaccggtgctcgatttagtacacgtgattagggattggggggaagaggaagactgacggtcctcccaggagttcaggtgctgggcaccttgggcacgggggaggtgtgtcacaagatttgggctctgggcacagcggccctgggctgcctggtcaaggactacttctatatactgtctgagcgggctggcaaggcgcatagnnnnnn

SEQ ID NO: 192721 - DNA, 660 bp, Homo sapiens
  misc_feature: GYAE6OF02IKVZJ.44.23.C01.1.454.CMB.1.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggngagtcaggttcgttttcggngctgttgcctggtttacaaacgaaaaaagggggagacggcccctaaggtcctcgtctctcgtacgaaaccagactggaaggtagacgtcccgtccaggttcagtgccagtccaggtcggngggccgagtccactcncactatagcgacctgcggcctagaactattctgactaactttatttctgtcagctagtatcgtaatacgtcgtccccgtttactaccgttttggaccgtacggggaaccctaaaggtccgtaagggtaaactaccgtaaaaaccggtaacgttacggtacggtaccttacgaacccgtaacccgtaatttacccgtacgtttaccgtttaacccgtaaccgttttccccgtttacccccggaaccctttaaccgtttaccgtttacggtaacttttaaaccg

SEQ ID NO: 192722 - DNA, 760 bp, Homo sapiens
  misc_feature: GYAE6OF02IK6S2.44.23.C01.1.454.CMB.1.raw
tcagacagtatatacacgaccggtgctcgatttagtacacgtgattagggattgggggagtcagaccctgtcaggggacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggcgagtgccgacagttaggtactttttcggccttggtttcacgtcgaaggacgccgtggaccaaaacgtcccccgtaaagttcccctgttaacttccgtttttcgtagggtacttcccgtaacgttttaggaaggtaggtcggacgttaccccgaggtacccgtaggttcgaacgggccggtacgtacgggttagggtttccgtacgggggtaacctaacggttacttttcccgaaccttaccgtacccaacctaacgtccaacgccctaacgtcccgttacggaccgacggtacccgttagggtaacgttacgttccggaacgttaaccgtttaacgtttaccgtaccgtaccctaaaacttaacgttttaaccttttaccttttttacgtacccgttaacgtttcggttttaacgggaccggtaacggggtaacctaacggtacggttaacggaagtacgtaaccgaacggtacgttcggtacggtcctacgcctaaccgtcttaccgttcgttaccttactacctccgttaccccg

SEQ ID NO: 192723 - DNA, 658 bp, Homo sapiens
  misc_feature: GYAE6OF02GL498.44.23.C01.1.454.CMB.1.raw
  modified_base (278)..(278): a, c, t, g, unknown or other
  misc_feature (278)..(278): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttcgccgttggtttacaaacgaaaaagggggngacggacccctaaggtcctcgtctctcgtagaaaccagactggaaggtagacgtcccgtcgaggttcagtcgcagtccgaggtggtcgggccggagtccactctcacattacgcgacctgcgctgaagtatctcgactaactttatttcgtgtcgagtacacgtatcaagttcgttccgtccccgtttactaccgttttcggacccggtaacggggtaacccgtaacggtccgtaacgggtaaactaaccgtaaaaccgtaaacgtcgggtacgtaccgttacgacctaacccgttaagttcccttacggttaccctttaccgtaacctttacccgttacccccggtaccctaacgtttacctacggttaactttaaccg

SEQ ID NO: 192724 - DNA, 747 bp, Homo sapiens
  misc_feature: GYAE6OF02HZAJZ.44.23.C01.1.454.CMB.1.raw
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttctgtcttcttctgttggaggcagcgtcaccatcacttgccgggcgagtcgaggttcgttttcggngtctgttcgccgttggtttacaaacgtaaaaagggggacgacggtacccctaaggtccctcgtctcgtcgtacgaaaccngacgtggaaggtagacgtcccgtcgtaggttacagtcgcctagtccagggtggtcgggccggagtccactctaccacctattacggccgtaaccgttggaccggtccgttaggaacgttacgtttcgacgtaaccttaacgtttttactttcgttacggttaccaggtacctaaggttaactccgtaagtttaccggtcccgttacccccgtttgttaacccggttttccgggaaccgggtaaaccggggtaacctaaacgggtccgttaaacgggaaaacttaccgaaaaccggttaaacgtcgggttacggaccgttacggaacccttaacccggtaacgtttcccggtttacggttcccttttaccgaacccgttttcccgttacccccggacttaaccgttccggttacgtaactttaacg

SEQ ID NO: 192725 - DNA, 605 bp, Homo sapiens
  misc_feature: GYAE6OF02HKTOK.44.23.C01.1.454.CMB.1.raw
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (537)..(539): a, c, t, g, unknown or other
  misc_feature (537)..(539): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
tcagacagtatatacacgaccggtgctcgatttagtacacgtgattagggattgggagtatctattatagtgggagcaccaactacaaccccgccctcaagagtcgagtcaccatgtcactagacaggtccaagaaccagtttctccctgaaattgactttctgtgaccgccgcggacacggccgtatattattgtgcgagagattcctatcgaatacagtagaggacgggggggcgaactggctcgacccctggggccagggaaccctggtccaccgtctcctcagccctccaccaacgggcccagtccggtcctttccccccgtggaccctacccctccctaccgaaacgacgccacctcgtcggggaccaccgacggccggcccgttcggggcctcggtcccgttgggtaccgaacgggtacccttacctttcccgtacggtacttccggacggttcgtacggacgggccggggtaccgtcgggacgaacggggcccgacgtaacggttaacggcagtcagtcagagngngcgnnngcgacacgacgcgtacncacganacgnacgcncgagcgcncgngcncgcnagagncngcncncnnc

SEQ ID NO: 192726 - DNA, 855 bp, Homo sapiens
  misc_feature: GYAE6OF02H5SLZ.44.23.C01.1.454.CMB.1.raw
tcagacagtatatacacgaccggtgctcgatttagtacacgtgattagggattgggggagtcagaccctgtcaggggacagcatggacatgagggtccccgctcagctcctgggctcctgctgctctggcctcccaggttcgagactgtgacatcgagatgaccaagtccttccttccttcctcgttcttcttcgttggttggagtcagtccgtcaccatcacgttcggccgggcgagtcgtaggttcgtttcggtgtcgttcggttacgtccgttggttttaaccgaaaacggtaaaaaggggggtcgaccgggtaaccccgttaacgggttcccgttacggttccttaccgttacggtaaccgtaaaacccgtcggtaacggttagggtaacgggttacgaaccggtttccccgtacgtacgggtttaccgacggttcgaccgtacggtccggtaggggttcggggtacgggggtacccggtacgttacccgtacgttcgtaccgtaaccgtacgtttaccggacccgtacgttcgggcccggttacctaaggtaacggttacttttcgtacgtaaccgtttaaccgttttactttaccggtagttaccgtacgtacgttaaggttactacgttacgtttaccggtcccggtttaccccgtttagttaccggtttttaccggggaccggttaaccggggtaacctacggtaccggtaacggtaaacgttacccggtaaaagtaccgttacgggtacggtaccctagttaccccgacgttagttacccgttcgttacctttaccgtacccgtttcccgtaccccgttacttaccgtacgttacggtattaaccg

SEQ ID NO: 192727 - DNA, 709 bp, Homo sapiens
  misc_feature: GYAE6OF02GAZBA.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggagcagcgtcaccatctacttggccgggcgagtcgaggttcgttttcggtgtctgttcgccgttggtttacaaacgaaaagggggcacggacccctaaggtcctcgtctcgtcgtacgaaccagacgtggaagtagacgtcccgtcgtaggttcaggtcgcgtacgtccgtagggtgggtcgggccggtagtcccactcctaccaaccgtagttacggccgtaaccgtcggacccggtacctaggaaacgtcgtttaccgtagtacccgttaaacgttttcttttccgtacgtaccgtacgtaccgtaagttactacttaacgttacggttcccgttaccccgtttacgttaccggttttccgggacccggtaacggggtaaccctaaggtaccgttaacggtaaacctaaccgaaaaccgtacgttacgggtcgaccgttcggaacctaccgatttccgtaccgttacttaccgtacttcccgttacccgtcctaacgtcgttacgtattaacg

SEQ ID NO: 192728 - DNA, 797 bp, Homo sapiens
  misc_feature: GYAE6OF02FUX6P.44.23.C01.1.454.CMB.1.raw
  modified_base (291)..(291): a, c, t, g, unknown or other
  misc_feature (291)..(291): n is a, c, g, or t
  modified_base (712)..(712): a, c, t, g, unknown or other
  misc_feature (712)..(712): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatctacgttggccgggcgagtcagggttccgttttcggtgtcgttgttcgccgttggtttaccgaaaacgtaaaaaggggggntaccgggtacccccgttaaggttcccctacggttccttccgtcggtaacgaaacctaggtaaccgtgggtaaacggttacggacgttccccggtaccgtagggttaccaggtcgaccgtaggtacccgtaggggtcgggtcggggcccggtacgttcccacgttccgtacctaaccctaagtttacggacccgtaaccgttcgggacccgggtccttaacggaaacgttactttaccgtacggtaacccttaaacgtttttacgttttccgttagtaccgtacggtacgtaacggttattaacgtaagttaccgttcccggtccccgtttactaccggtttttacgggacccggtaaacggggtaccctaacggtccggttaaaggtaaccgttaaccgaaaacgtcgttagtaccgggtnttaccgaccgtaaccgtcgttacgttaccgttacctacgtacccgttcctaccccggtacttacgttacgttacgttattaaccg

SEQ ID NO: 192729 - DNA, 634 bp, Homo sapiens
  misc_feature: GYAE6OF02IFBFC.44.23.C01.1.454.CMB.1.raw
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgtctgttgccttggtttacaaacgaaaaagggggnacggtacccctaaggtcctcgtctctcgtanaaaccngactggaagtagacgtcccgtaccaggttcagtcgccagtccagggtgtcgggccgagtccactctacacattcgcgacctgccggcctaggaactnttcgtgtactaacttattctgtcagcagtatctagtacgtcgtccccgttactaccgttttcgggaccgtaggggtaacccaaggtactagggtaaaactaccgaaaaaccggtacgttacggtacggtcgttacgaccgtaaccgtagttaccgttacggttacctttacctacgtttccccgttccccgtaccttacgtttccttacggtactttaaccgg

SEQ ID NO: 192730 - DNA, 682 bp, Homo sapiens
  misc_feature: GYAE6OF02HAB8Z.44.23.C01.1.454.CMB.1.raw
  modified_base (551)..(551): a, c, t, g, unknown or other
  misc_feature (551)..(551): n is a, c, g, or t
tcagacagtatatacacgaccggtgctcgatttagtacacgtgattagggattggggagtcagaccctgtcagggacagcatggacatgagggtcccgctcagctcctgggctcctgctgctctggctcccaggttcgacgatgtgacatcgagatgaccagtctccttcctctgtcttctctgtgagtcagcgtcacatcacgttcgccggcgagtcgacgggttcgttttcggctcgtgttgccgttggtttaccaaaacggaaaagggggtgacggtaccccgtaaggtccctcgtcctcgttcgtacgaaacctagacgtaggaaggtagtacgtacccgtcacggttcgagtcgacacggtccgagggtcggtcgggccgagtaccactcgtaccacctagttacgccgacgttggtacgccctaaggtaacgtcttagtcgtaacctaacgttttactttccgtaggtcctaagtccgtaaagttctactagttaccggtcctaccccgtttattacgttcgggacccggtaccggggttaaccncggtaaccttagggaacttaaccggaaaacctaacgttcgggaagtcctcggaaccctacccgtaattcccgttggtaacccttgaaccgtttcccggtaccccggactacgttacctagactttaaaccg

SEQ ID NO: 192731 - DNA, 834 bp, Homo sapiens
  misc_feature: GYAE6OF02HPDKX.44.23.C01.1.454.CMB.1.raw
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttctcctgtcttcttctgttggaggcagcgtcaccatcacttgccggcgagtcgaggtcgtttcggtgctgttgcctggtttcaacgaaaaagggggagaggacccctaaggtcctcgtctcctcgtgaaaaccagacctggaagggtagaacggttcccgtccgacgggtttcaggtcgcctagtcccgaggtcgggtcggggccggagtcccgactccgtcctaaccgtattacggccgaaccgttcggaccgggtaccccttggaaaacgtacttttccgtacggtaccgtaaacccgtttttaacttttaccgttcggttaccgtaacgtccggtaaacgtttaacgttaccgttaaacgtttaacgggttacccggttaccccccggttttaccgttaacccggttttttttacggggaccccgttaaccggggggggtaaaccccctaaacggggtacccgtttaaacggggtaaaaccctttaacccgtaaaaaacccgggtaaaaccgttacgggttaccgggtaccggttaccggtacccgtaaaccccgtaactttacccgtttacggtttacccgtttaccgttaaccgtttacccccgttttacccccggtaaccccttacgtttacccgtttaggtaaccgttttaaaccg

SEQ ID NO: 192732 - DNA, 836 bp, Homo sapiens
  misc_feature: GYAE6OF02G0K9T.44.23.C01.1.454.CMB.1.raw
  modified_base (265)..(265): a, c, t, g, unknown or other
  misc_feature (265)..(265): n is a, c, g, or t
tcagacagtatatacacgaccggtgctcgatttagtacacgtgattagggtagttgggggagtcagaccctgtcaggggacagcatggacatgacgggtccccggctcagctccgtgggctcctgctgctctggcctccaggttcgagtatgtgacacgtcgagatacgaccaagtccttccttccttccgtgttccttcttcgttgtggacgcagcgtcaccatctacgttcggccggcgtacgtcgtaggtttcgttttcggngtcgttgttcgtccgttggtttaacgaaacggaaaaggggacgacggtcccgttaaacggtccgttcgtacgttccgtcgtaacgtaaaccgtagtacgtaggaaacggttacggaccgttacccgtacgtaacgggtttccgacggttccggtaccgtaacggttccggtaagggttcgggggttaccgggaccggttacttaacccggtaaccgttcgttaacccgtaacccgttaaacgttttaccggacccgttaaccgtcgggtaacccggtaccggttaacgaaggttaccgttccgtaccgtaaccgtttaactttaacgttttaccgtacggttacgaacggttacgtaagttaacttaccgttaacgttaggttcccggttacccgtttactttaccggttttcgggacccgtaaacgggggtaccctaaaggtaccgttaaacgggtaaacttaaccgtaaaccgttaaagtcgggtacgtaccgtacgaccgtaaccgtacgtccgttaccgtacttaccgttaccgttcccgtacctacctactcttacggtattaacg

SEQ ID NO: 192733 - DNA, 696 bp, Homo sapiens
  misc_feature: GYAE6OF02HJ5JT.44.23.C01.1.454.CMB.1.raw
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttcgccgggcagtcagggttcgttttcggngtctgttgcctggtttcaaacgaaaagggggngacggcccctaaggtcctcgtctcgtcgtacgaaaccagacgtaggaaggtacgacgtcccgtcgtaggttcacggtcgacctaggtaccgaggggtcgggtcgggggacccggtaggtacctaccgtctaccacccgtagtttacgaccgtaccgttggcccggtacctaggaacgtacttcgtaggtactaacgttttactttcgtcgttacaggtctaaggttactctaagttacggttccggtccccttttagtaccgtttttcgggaccggtaacggggtaacctaacggccgttaagggtaaacctaaccgtaaacgggtaaactgggttaccggacttacggacctaacccttgtccttacgttacctttacacctttcccgtacccggccttaacgtacttacgttaattaac

SEQ ID NO: 192734 - DNA, 606 bp, Homo sapiens
  misc_feature: GYAE6OF02FKOWW.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (591)..(591): a, c, t, g, unknown or other
  misc_feature (591)..(591): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttcgcctggttacaaacgaaaagggggnacggcccctaaggtcctcgtctctcgtagaaaccagactggaaggtagacgtcccgtcgaggttcagtcgccagtccgaggtgggtcgggccggacgtcccactcctcaccagttacgccgtaccgtggccggccgtagaacgtcttcgtcgactaactttatttcgtgtacagtctaagtactctaactaggtccgtccccgttattacgttttcgggacccgtaacggggtaaccaacggtcgtaaggtaaactacaaaacgtacgttgcgctacgacgtacctcgtctacgttaccttactacgttccttcccnctactctgtattaac

SEQ ID NO: 192735 - DNA, 720 bp, Homo sapiens
  misc_feature: GYAE6OF02I12OU.44.23.C01.1.454.CMB.1.raw
  modified_base (159)..(159): a, c, t, g, unknown or other
  misc_feature (159)..(159): n is a, c, g, or t
  modified_base (186)..(186): a, c, t, g, unknown or other
  misc_feature (186)..(186): n is a, c, g, or t
  modified_base (236)..(236): a, c, t, g, unknown or other
  misc_feature (236)..(236): n is a, c, g, or t
tcagacagtatatacacgaccggtgctcgatttagtacacgtgattagggattgggggagtcagaccctgtcaggggacagcatggacatgagggtccccgctcagctccgtgggctcctgctgctctggctcccgaggttcgagatgtgacatcgagntgaccagtctccttcttctgtcttctntgtgagcagcgtcacatcacgtcgccggatagtctaggttcgttttcggngtcgttgttgccgttaggtttacaaaacggaaaaagggggcgtaccggtaccccgttaacggtccgttcgtaccttcgtacgtaacgaaaccgtaggtacgtacggtaaaggtacgtaccgtcccgtacgaggttacacgttcgacacgtcgaggtcggtcgggacgtacgtcctactcgacactagtacgacgaccgttggaccggtactaggaacgttcgttcgtacggtaccttaaacgttttaacgtttccgttacgtcgaacggtactaacgttacgtaactaacgttaccgtccgttaccccgtttacgttaccggttttacggaccggtaaccgggtaaccgtaacggtacgttaacggtaaacttaacgaaacggtaaaccgttggtaccgacgttacgaccctaccgtaacgttaacgttcgttaccttcctaaccgttcccgttaccccgcgttaacgtcttacggtattaacg

SEQ ID NO: 192736 - DNA, 833 bp, Homo sapiens
  misc_feature: GYAE6OF02FQP5E.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtgggctcctgctgctctggctcccaggttcgagatgtgacatcgagatcgacccagtcctccctttccttccttgttcctttcttcgtgttggagcagccgtcacctatccacttcggccgggacgtacgtcgtacggtttcggttttcggtgtcgttgttcgccgtttggtttaccaaaacggtaaaaaaggggggcgtaccgggacccccgttaagggttccccttcggttaccttccgtaccggtaacgaaaaccgaggtaccgtagggaacggttacggaccgttaccccgtaccgtaggtttcgaacggttcgaccgtacgtccggaagggttggggtacggggaccggtacgtaccctacgttcctaccgaaccctaagttaccggaccgtaacccgtggcccgggtacccttagggaaacgtctttacgtacgaccgttaaaccttttacgttttccgtagttacaggtaacctaagttacttacgtaagttaccggttccggttcccccgttacgttaccggtttttacgggacccggtaacgggggtaacccgtaaggccggttaaacggtaaaccgttaaccgaaaaacgttacgttacgggtacgggtccttaggtaccccaaccggttcttaccgtttacggttaccctttaccgtaccgttttaccccgttccccgtaaccgttacttaccgttaggtaacctttaacg

SEQ ID NO: 192737 - DNA, 746 bp, Homo sapiens
  misc_feature: GYAE6OF02GILYH.44.23.C01.1.454.CMB.1.raw
tcagacagtatatacacgaccggtgctcgatttagtacacgtgattagggattgggggatgctttctgagagtcaaggacctcctgtgcaagaacatgaagcacctgtggtttttcctcctgctggtggcagcctcccagatgggtcctgtcccaggtgcagctgcaggagtcgggccaggactggtgaggccttcgggaaccctgtctctcatctgcactgtctcgtggtacttccatcacgttctgatctattcgttaggggctggacgtccggcacggcccccgaggggacgggtaagtcgggtaggtggtagttcggtacgactacgtcctaagtttacgtacggtcggggaccgtacggtacttaccgttccgtcccgtacccgtacgaacgtcggtccgtctacctaaccgtacttacgggaacgggacctaccggtccaagtccgtaacccgtctttacccgtacccgttacgaaacccgttcgtaccccgttccggtacggtacccggtacccggccggtaaccgtaccgggttaccgtttttacgttccgtacggtcggaccggtacgggtccggtaacggtacggttcgggttacctttaacgtaacgttccgttaacgggttccggggtaccgtcgggtacccttacccggttcgggtacccacgtttccggtcccttacccgttccgtacgtccctttaccgaacccggtaccgggtcccctaggttcccccgg

SEQ ID NO: 192738 - DNA, 636 bp, Homo sapiens
  misc_feature: GYAE6OF02GSHSS.44.23.C01.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacgttgccggcgagtcaggttcgtttcggngtctgttcgccttggttacaaacgaaaagggtnacggtacccctaaggtcctcgtctctcgtacgaaaccngacgtggaagtaggacgttcccgtacgtaggttcaggtcgcctaggtcctagggtggtcggaccgtagtccactctacactagttacgcgtaccgtgaccggtcctaggaacgtcttcgtacgtactaaacttttctttctgtacacgtactagtacttacgtaagttacgtccgttacccgtttataccgttttcgggaccgtaacgggtacctaagtcgtaagaacgtacgaaaacgtacgtggtacgtacacgtaccaccgtagttaccgttcgtacttcgtaccttcccgttacccgacttactccgttagtacgttaacg

SEQ ID NO: 192739 - DNA, 750 bp, Homo sapiens
  misc_feature: GYAE6OF02HMZZ7.44.23.C01.1.454.CMB.1.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
tcagacagtatatacacgaccggtgctcgatttagtacacgtgattagggagttgggggagtcagaccctgtcagggacagcatggacatgaggtcccgctcagctcctgggctcctgctgctctggctccaggttcgagatgtgacatcgagatagacccagtctccttcttcctgtcttcttctgtggacggcagcgtcacatcgacttcgccggnagtcaggttcgtttcggngtctgtcncgttgttacaagaaaagggngacggccctaaggtcctcgtcctctcgtacgaaaccgagtacgtgggaaacggtacaccggttaccccgtacgtaggtttccgaacgttcggacctacggtacccgaagggttcgggtcggaccgggttacgtaccgtaccgttccgtacgtaacccgtaagttaccggaccgtacccgtaggcccggttaaccgtaaggaacgttacgtttccgtacgtaacttaaccgttttaccgtttcgttacggtacgtaacgtcgtaagttacgtacgtaacgtttcgtcgtaacccgtttacgtacggtttaccggaccgttaaacggggaccctaaggtacgttacggaaacgttacgtaaaacgtacgtacgggtactcgttaccgaccgtaaaccgttcggtacctttacgttacccgttacgttaccgttaccccgttaccccggtaattttacccggtaaccgtttaggtaactttaaacccgg

SEQ ID NO: 192740 - DNA, 782 bp, Homo sapiens
  misc_feature: GYAE6OF02GS27X.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtcctccttccttcctgtcttcttctgttggaggcagtcgtcaccatctacgttcggccgggcgtagtacgtaggttccggttttacggtgtacgttcggttcgtccgtttgggtttaaccaaaacggaaaaaggggggtacgaaccggtacccccgttaaagggtcccttaccgtctccgttacggtacgaaaacccgtaggtaccgtagggtaacgggtacgtaccggttccccgtaacgtagggttccaaggttcgaccgtaggtccgaggggttcgggtacgggggaccggtacgtccctacgtccgtaccgtaacctagttacggaccgtaccgtgggccggtccgtaggaacgttctcgtacgtacttaacttttagtttcctacgttacacgtacgacgttatacgaacgttacgttcccggttacccgttgtttaccgtttaccgggacccggtaacggggaaccgtaacggtacggtaaggtaaacgttaaccggaaacgtaccggttagaccgggttactaccggtaaccacgttaaccgtccgttaccgttaccttaccgtaccgttcccgttcccgtaccttacctacgttacgtacttaacgg

SEQ ID NO: 192741 - DNA, 819 bp, Homo sapiens
  misc_feature: GYAE6OF02FMDMF.44.23.C01.1.454.CMB.1.raw
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgatatgacccagtctccttccttcctgtcttcttctgttggaggcagcgtcaccatcctacttcggccgggcgtagtccgaggttcggtttttccggtgcgttggttcgcccgttaggtttaccgaaacggaaaaaaggggggacggacggtaccccggttaacggtcccgttcgtcttccgttacggtacgaaaccaggacgtagggtaaggtacggtaccggtccccggtccgtaggttaccgacggtcgtacccacggttcccgagggttggggtcggggacccggtacgtcctacgtccgtaccaacctagttacggaccgtaccgtacggccggaccgtacggaacgtactttcgtaggtaccttaaacttttagttttcccttagttcgtaacgtcgtaagtacttcctaagttacggttcccggttacccccgtttaccgttttacccggtttttacgggacccgggaaacggggtaaacccgtaaccggttaccgttaaaggggtaaaaccgttaacccgtaaaaaccggtaaacgtttcgggtaccgggtaccttaccggaccctaaccgttaccgttaccgttcggtttacccctttacgtaccgttttccccgttaccccgtaccgttaacctttcggtacgtaactttaaccgg

SEQ ID NO: 192742 - DNA, 717 bp, Homo sapiens
  misc_feature: GYAE6OF02GI2KK.44.23.C01.1.454.CMB.1.raw
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctcccaggttcgagatgtgacatcgagatgacccagtctccttcttcctgtcttcttctgttggagcagcgtcaccatcacttgccgggcgagtcgaggttcgtttcggngtctgttcgccttggttacaaacgtaaaaagggggngacggtccctaaggtcctcgtctctcgtagaaaccagacgtaggaacggtagtacgtacccgtaccgtaggttccagtcgacccgtagtccgaagggttgggtcggggtaccggaacgtcccaacgtccgtacaccgtagttaacggccgtaaccctggaccggtacccgtagaaacggtactttccgtagaccgttaaaccttttagttttccgtaggttacaggtacctaaggttactacgtaacgtacggttaccggtccccgttaacgttaccgttttaccgggacccggtaaacgggggtaaccaaggtaccgttaaggaaaaccttaaccgaaaaccgtaacgttacgggtacgaccgttacggaccaaccgtacgttacgttacgtacctttacgactttacccgtacccgtacctagttactacgtaattaacg

SEQ ID NO: 192743 - DNA, 702 bp, Homo sapiens
  misc_feature: GYAE6OF02GWAF5.44.23.C01.1.454.CMB.1.raw
  modified_base (202)..(202): a, c, t, g, unknown or other
  misc_feature (202)..(202): n is a, c, g, or t
  modified_base (401)..(401): a, c, t, g, unknown or other
  misc_feature (401)..(401): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagagtgacccagtctccttccacctgtctagcatctgtagagacagngtcaccatcacttggcccgggcctaggtcaggtacgttatttaggtaggtttggttggccttggtatcgaggtacagaaaccgaagggaaacacccgttaaaccgtccgtacgactacgtaataacgggctatctacggtttaagggaaacggtacgggtccgaagttaccgtaaggtttcgacgtcggcaggtacggntacgtgggtacaggtaattcgactctaccacgtactcagtcacgtctacgactcgctgtacttgtactttcgtaacttaacgtttattaccgtacgtaaccgtaactaacttaaattaaacgtttaacgtttttaccgggttacgttaccggggtttaaccgtacccgggtaaacgggtaaacgttaaacggggtagggtaaacgttacgaaaacggtaaccgttacgggttaaggccggttacgacgtaaccggtacgttaccggtactttaaggttccctaacgtttccccttacccgg

SEQ ID NO: 192744 - DNA, 781 bp, Homo sapiens
  misc_feature: GYAE6OF02IW9B7.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtggggctcctgctgctctggctcccgaggttcgagatgtgacatcgagatcgaccagtcctccttccttcctgttctttcttcttggttggaggcagtcgtccaccatcacgttcggccgggtcgagtcgtacggtttcgttttcggtgtcgttgttcgtccgttagggtttaaacggaaaaaaagggggcgaccggtacccgtaacggttccgtcgttacgtcgtcggtaacgaaaccgaggtacggtagggtaaggtacgtaccggtacccgtccggtacggttacgacggtcgccgtaacgttccggaggggttcggggtaccggggtaccggtaccgtacccgtaaccgttccgtacccgtaacctaagttaccggtaccggtaccgtcggccggtacgtacgtaacggttcgttcgtacgtacgttaactttgtttcgtcgtactacgtacttagttacgtacgtagttacggtcccgttacccgtttacgttaccggtttcggaccggtaacgggtaaccaacggttacgtaacggtaaacttaaccggaaacgtcgtaggtaccggtaccgttagaccttaccgtacttcgtaaccggtttccttacttacccggttccccttaccgtaccgttacggttacttacgtaacgttattacccgg

SEQ ID NO: 192745 - DNA, 638 bp, Homo sapiens
  misc_feature: GYAE6OF02G0DS3.44.23.C01.1.454.CMB.1.raw
  modified_base (243)..(243): a, c, t, g, unknown or other
  misc_feature (243)..(243): n is a, c, g, or t
  modified_base (623)..(623): a, c, t, g, unknown or other
  misc_feature (623)..(623): n is a, c, g, or t
  modified_base (634)..(634): a, c, t, g, unknown or other
  misc_feature (634)..(634): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttcgccgggcgagtcgaggttcgttttcggngtctgttcgtccgttggtttacaaacgaaaagggggagacggacccctaaggtcctcgtctctcgtagaaaccaggacgtaggaaggtacgtacggtcccgtaccgtaggttcagttcgcctacggtccgagggtgggcgggaccggtacgtaccgactccgtacacgtagttacgccgtaaccgtggacccggcccgtaggaacgtacgttctacgaccttaaactttacttttcgtcgtacacgactaacgttagtacctatacggtccgtccccgttactacgttttacggaccgtaacggggacctaagacgtaaggaaacttacgaaacgtacgtaggtacgctacgaccactactctctacttctactcctccnctactctactntaac

SEQ ID NO: 192746 - DNA, 817 bp, Homo sapiens
  misc_feature: GYAE6OF02HGQLL.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatcgacccagtcctccgtcctcactgtctgcgtctagttggggacagacgtcaccatcacgttcggccgggcgaggtcgaccgtaactagtttacggttacgttttttcggccgtttgggtttccaggcgagggtacggccgtgggaaccaaaccggtcccccgttaagtccccgttagactttcctttttcgtcggtacttccctaacgtttgaagtaggtcggacgtccgacgccgtaggttcgacggcggactagggttcgggttcgacgggtaactacgtacgttttacacctttcctaccgtaccctaacgttaccacgggtaccgaccggtcccgtcggtaccgacccgggtaccggttacggtaccggtttaccggtttcggtaaccgtttacctttaccgttaccggtacctaaaccgttaaacgttactttttaacgttttttacccggttttttaccttaacccggtttcgtttttaaccggggttacgggtaacccgggtaaacgggtacccggttaaagggtaccggttaacggacgggttaaacgtaacggtaaacgggttcgggttaaggtcggttaccggtaccgaaccgtttaaccgtctttaccggttcctttacttacccgttacccgttacccgttacccgg

SEQ ID NO: 192747 - DNA, 740 bp, Homo sapiens
  misc_feature: GYAE6OF02IWMUT.44.23.C01.1.454.CMB.1.raw
  modified_base (262)..(262): a, c, t, g, unknown or other
  misc_feature (262)..(262): n is a, c, g, or t
tcagacagtatatacacgaccggtgctcgatttagtacacgtgattagggattgggggagtcagaccctgtcaggggacagcatggacatgagggtccccgctcagctccgtgggctcctgctgctctggctccaggttcgagatgtgacatcgagatcgacccagtctccttcctctgtcttctctgtgagcagcgtcacatcactggcggcagtcaggttcgtttcgtctgtacgccttggttacaaacggtaaaggggnacggaccctaaggtcctggtctcgtgtacgaacctagacgtggaaggtacaccggttcccgaccgtagtcagtacgccgtaaggtccgtaggggtgggtcgggaccggtacgtccacgttcgaaccgtacctaagttacggaccgtaccgttgggcccggacgttagggaaacgttcgtttacgtacgtaaccgttaaattttcgtttcggtacttacgacgttaccgtaaggtttacctacgtaacggtttaccggtaccgttaccccggtttacgtttaaccggttttccggggaaccgtttaccgggggaaccctaacgggtaacccgtaacgggttaaacctaaccgaaaacggttaccgtagggttaccgtaccggtactaaacccggaccttaacttccgttcgttacccgttaccgttaccggttaccccttcccggaccctttaccgtacgttaccgtacgtttaaaccg

SEQ ID NO: 192748 - DNA, 822 bp, Homo sapiens
  misc_feature: GYAE6OF02HQDT5.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttcctgtcttcttctgttgagcagcgtcaccatcacttcggccgggcgacgtcgtaggttcgttttcggtgtcttggttagccgttaggtttacaaacggaaaaaggggggtacgaccgggtacccccttaagggttcccttacgtccgttccgtacggttaacgaaaaccctaggaaccgttagggaaacgggttaggtaccggtccccggttaccgtaagggttctaacggttcgacccgtacgttcccggaaggggttcgggtcggggcccggtagtacccgtacgtactaccaaccgtagttacgaccgtaccgttacggccgggtacctagggaaacgtacgtttacgtacggtaccttaaacgttttactttcgttagttaccgtaaggtactaacggttactacgtaaacgtttcggtacccggtttccccgtttacgttaaccggtttttccgggaccggtaaaccgggggtaacctaacgggttaccgtaagggtaaaaccgttaccggaaaaccgttacggtaacggttacgggtacgttacggacccttaaaccgtacttacccgtttacggttaccctttacgtacctttacccgttccccggtaactacggtttacccttagtaactttaacg

SEQ ID NO: 192749 - DNA, 671 bp, Homo sapiens
  misc_feature: GYAE6OF02HTZC4.44.23.C01.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagttctccttccttcctgtctgcttctataggaanacagagtcgcatcacgttgccgggcaagtcagacctaattaacagcttaatttaaagttgtatcagcaagagaccaagggaacnccctagaactcgtgatctcgtgctcgcctccattcgngtacgaaggtgtacgttccttacgttacgaacggtttcaacgggtggaccgtaaggtcggaacgttcggagggtaaccaggtaacttttcaccgtcttacgaaccctacgtcctaccgtagtacttccgaacgtaaccgtgtaaacgttacgttttaccggtaccttaaacgtttacctaacgttacgtaacctaacgtaaggtaacgtttactaccgtaccgtacccgtttaccgttacggttttcggaccggggtaacctacgggtacgtaggtaacgaactaaccgtaaacggtaacgttacggtacgtaccggttacgtaaccaccgtaaccgttcgtactttaccg

SEQ ID NO: 192750 - DNA, 720 bp, Homo sapiens
  misc_feature: GYAE6OF02IKPXO.44.23.C01.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
tcagacagtatatacacgaccggtgctcgatttagtacacgtgattagggattgggggagtcagaccctgtcaggggacagcatggacatgaggtccccgctcagctcctggggctcctgctgctctggctcccaggttcgagatgtgacatcgagatgaccaagttctccttccttctgtcttctntgtgngcagctcacntcacgtcgcgggctagtcgtacggttcgtttcggtgtntgttcgcgttgttacgaaaggtaaaaggggagacggtccgtaacggtcctcgtctcgtcgtacgaaccgngacgtaggaaggtacgacgtcccgtacgtacggtcaggtcgaccgtacggtccgtaggttcgggtcggggaccggtacgtcctaaccgtctaccgtaacgtgttacggcccgtacgtacggccggtaccgtaagtacgtacttaccgtacgtaacccttaacgttttacgtttccgtagtacgtaacgtctaacgtacgttaataacggttaccggtacccggtttaccccgttaggtttaacccggttttacgggaccggtaaaccggggtactaaaccggtcgtaaacggtaacctaaaccgaaacggtaccgtaaggtcgtacgtacgaccgtaccgtacgttctaccgttacttacccgtaccgttccccgttaccgtaccgtaccgttctaccgttaaggttaac

SEQ ID NO: 192751 - DNA, 808 bp, Homo sapiens
  misc_feature: GYAE6OF02JOL5M.44.23.C01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggcctcccaggttccgagatggtgacatcgagacgtgacccagtcctcccttccttcctgttccttacttcgttgttggacggcagccgtcaccatccacgttgccgggcgatcgaggttcgtttcggntccgtggttacnccgttggttaccaaacggaaaagggggtcgacggtacccccgtaaggttccctcgtcctcgtacgtacgaaacccaggtacgtggaacggtaggaccgtcccgtacctagggttcaaggtcacccgtaacgtccgtaggggtcggtcgggccgtaacgtccacgtccgtacctaccgtagttacgccgtaccggttcgacccggtcgtacgtaacgtcttcggtaacgtccttaaacgttttacgttcgtcgtaacgtccgtacgttaacggtacttacgttacgtttaagggttcccccgtttacccgggttaactttaccgggttttaccgggaaccccggtaacgggggtaaccttaaccgggtccgttaaaaccggaaccggtttaaaccaaaccgggttacacgggtttaacgggccttcgggtaaacccgtaaccccgttacgttccggtttaccggtttaacccgtccgttaaccgtttaccccccgttccggaaccttaaccccggtttacgttaacggtacgtttaaaccc

SEQ ID NO: 192752 - DNA, 658 bp, Homo sapiens
  misc_feature: GYAE6OF02FR0Y8.44.23.C01.1.454.CMB.1.raw
  modified_base (279)..(279): a, c, t, g, unknown or other
  misc_feature (279)..(279): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcacggttcggttttcggtgcgttgttcgccttggtttcaaacgtaaaagggggnacggcccctaaggtcctcgtctcgtcgtagaaaccagacgtaggaaggtcgacgtccccgtcgtaggttcagtcgcctaggtccgaggttcgggcggggccgtagtccaacttcaccacctagttaggaccgtaacctggccggtctagaacggtctttcgtagtacctaacgtttactttctggtccacgtactacggttactctaagttacgtcgttacccccgtttataccgttttcgggaccgtaacggggtaacctaaggtccgttaacggaacgttaaccgaaaacgtacgtaggtcggacctgtaccctacgtaattccttagttacctctaaccgttcccgtacccgtaccgtacttcgtagtacttaacg

SEQ ID NO: 192753 - DNA, 619 bp, Homo sapiens
  misc_feature: GYAE6OF02GBUVX.44.23.C01.1.454.CMB.1.raw
  modified_base (243)..(243): a, c, t, g, unknown or other
  misc_feature (243)..(243): n is a, c, g, or t
  modified_base (278)..(278): a, c, t, g, unknown or other
  misc_feature (278)..(278): n is a, c, g, or t
  modified_base (441)..(441): a, c, t, g, unknown or other
  misc_feature (441)..(441): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttcgccgggcagtcgaggttcgttttcggngcttgttgccttggtttacaaacgaaaaagggggngacggcccctaaggtccctacgtctctcgtagaaccagacgtaggaaggtacgacggtcccgtaccgaggttcagtgacctagtccgaggtgggtcgggaccgtagtccactcgtaccacattagccgtactggccgcctagaagtcttctcgtactaacttnttctgtcagctagtatactagtcgtcgtcccgttactacgttttcggaccgtagggacctaagtcggtaggacgactaacgaaaggtaacgtcggtagtcgacgtaccgtaaccctaattcgtaccgttacctttccgacctttcccgttaccccctactaccgtttctacggttaac

SEQ ID NO: 192754 - DNA, 778 bp, Homo sapiens
  misc_feature: GYAE6OF02IYT4N.44.23.C01.1.454.CMB.1.raw
  modified_base (254)..(254): a, c, t, g, unknown or other
  misc_feature (254)..(254): n is a, c, g, or t
  modified_base (356)..(356): a, c, t, g, unknown or other
  misc_feature (356)..(356): n is a, c, g, or t
  modified_base (743)..(743): a, c, t, g, unknown or other
  misc_feature (743)..(743): n is a, c, g, or t
  modified_base (772)..(772): a, c, t, g, unknown or other
  misc_feature (772)..(772): n is a, c, g, or t
tcagacagtatatacacgaccggtgctcgatttagtacacgtgattagggattgggggagtcagaccctgtcaggggacagcatggacatgagggtccccgctcagctccgtgggctcctgctgctctggctccgaggttcgagatgtgacatcgagatcgaccagtcctccttccttcctgttcttcttcgttgttcggagcagtcgtccacatctacgttggccgggctagtcgtacggtttcgttttcggngtcgttgttcgtcccgtttggtttaaccaaaaaggtaaaaggggggtctaacgggtacccccgtaaggttcctccggttactacctacggttaacgaaaccnggtacgtaggggtaagtaccggacgttcccgacgtaaggtttcacggtttcggcccgtaagtccggtaaggggttcgggtaccgggggaccgtacgtaccgttaccgttacccgtaccgaaccgttaacggttaaccggccgtaacccgttcggcccgggttacccgtaagggtaaaccgttcgttcgttacggtaccctttaaagttttcgtttccgtacgtacgtagtaccgttaacgttacgtacgtaacgtttaccgttaaccgtcccgtttaacttacggttttccggaacggtaaccggggtaactaacgtcggtaaacggtaaacctagggtaaacctaacggttcgagtacgtacaccctagcttacgtctacgttacncgttaccctcggaaccttcgtactacgtnttaacg

SEQ ID NO: 192755 - DNA, 753 bp, Homo sapiens
  misc_feature: GYAE6OF02J0YAT.44.23.C01.1.454.CMB.1.raw
tcagacagtatatacacgaccggtgctcgatttagtacacgtgattagggattgggggagtcagaccctgtcaggggacagcatggacatgagggtccccgctcagctccgtggggctcctgctgctctggcctcccaggttcgagatgtgacatcgagtatcgaccctagtcctccttccttcctcgtctttcttctggttggcgtcagtcgtccaccatcgacttggcccgggcgtaggtcgtacgggtttcgttttcggtgtcgttcgttcggtccgttggtttaccaaaacgggtaaaaggggggcaccggtacccctaaggtcccgtacgtcgtcgtacgtaacgaactcgtacggtaggtaacgtacgtacgttcccgtaccgtaggttctagggtcgacccgtagtaccggacgggttgggcggaccggtagtccgtctactccgacttacgtcggactacgcggaccgtctaggaacgttacgttctacgttacctaacttttcgtacgtgtacgtacgtacttaggtactctacgggtttacctcccgggtttacccgttacggttacgttttaccggggaccggtaacggggtaacctaaacgggtccgttaaaacggttaacccgaacggttaaaacggtcttgggaaccgttaccgacgtaaccgtacgtccttacggtttctaaccctttacgtcccgtttaaccccgtcgaactttaccgtagttacgttacgtaaacg

SEQ ID NO: 192756 - DNA, 841 bp, Homo sapiens
  misc_feature: GYAE6OF02F52O6.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttgaggcagcgtcaccatcacttgccgggcgagtcaggttcgttttcggtgcgttgttcgccttgggtttaccaaaacgtaaaaagggggggacgacggacccccttaaagggtcccttacgttctcgttcggtacgaaacccaggtaccgtagggaaacgggttacgaacggttccccggtccgtagggtttccaacgggtgacccgtaaggttccccgtaggggttcggggttacggggacccgggtagttcccgaacttccgtaccgtaacccgtaagtttacggaccgtaacccgttcggcccggggtacctacgggtaaacggtaccgttttccgtacggtaccgttaaaccgtttttacgtttttaccgttcggttaccgtaacggtaccgtaaggtttaactacgttacgtttaacgttccggtacccccgttttcgttaaccggttttttccgggacccggtaaccgggggtaaccctaaaggtaccgttaaggtaaaaccgtttaaccgaaaacggttaaccgttagggttaccggtaccgttacggacccgtaaccgtaacgtttaccgttcggtttaccctttaccgtaccgtttacccctttcccggaccccttaacttaccgttacgttaacgttaac

SEQ ID NO: 192757 - DNA, 783 bp, Homo sapiens
  misc_feature: GYAE6OF02J2YY3.44.23.C01.1.454.CMB.1.raw
  modified_base (269)..(269): a, c, t, g, unknown or other
  misc_feature (269)..(269): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagttccttcccttccgttcctgttccttcttcgttggttcggaggcaggccgttcacctagtcctacgttcggcccgggcgtagtccgtacggttcgttttcggngtcgttgttcggtccttaggtttaccaaaacggaaaagggggcgtaccggtaccccgttaacggtcccttaccgttccgtacgtacggtaaccgaaacccgtagtaccggtaggtaacgggtacgtaccgttccccggtacgtaaggttccgtacgtcgccgtacggttacgagggtcgggtcgggacccggtacgttacccgacttccgtacaccgtagttacgccgtaccgtcgggccggtaccgtaggtaacttacgtttcgtacgtacccttaacgttttatttcccgtagtaccgtacgtacgtacgtactacttaacgttcggttacccgttcccgtttacgttaccgttttcgggaacccggtacggggtaaccctaacgtaccgtaagggtaaacctaacgtaaaccgtacgtcggtacgtcctagtaccctacgtgttaccgttcgttacccgttacctaccgttcccttaccccggactttacgttaccggttcttacttaacg

SEQ ID NO: 192758 - DNA, 832 bp, Homo sapiens
  misc_feature: GYAE6OF02GLO7Z.44.23.C01.1.454.CMB.1.raw
  modified_base (102)..(102): a, c, t, g, unknown or other
  misc_feature (102)..(102): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggattgggggagtcagaccctgtcaggggacagcatggacatgagggtccccgntcagctcctggggctcctgctgctctggcctcccaggttcgagatgtgacagtcgagatcgaaccaagtccttcccttccttctcgttctttcttcgttggttaggacgcagtccgtccacctactcctacgttcggcccgggcgtagtacgtacgggttccgttttcggngtcgttggttcgtccgttggtttacaaaacggaaaagggggacgaccggtaccccgtaaggttccgtacgtctcgtcgtagaaaccgaggacggtaggtaacggtacggtaccggtcccgtacgtacggttcaggtcgccgtacgtcggtaggtcgggtcgggtccgtacgtccacgtcctactaccgtagttacggaccgtaccgtcggccggtacgtaggaagttcttcggtacgtacttaacgttttactttacgtacgttcgacgtacgtagttactacgtaacgttacggttcccggttacccgttacgtttaacccggttttcgggaacccggtaaacggggtaacccttacgggttaacccgtaaaccgggtaaaactttaaacccggtaaaaaccggttaacggttcgggtaacccggtcgttacccgggtaaccgttaacccttacggtttaccgttacccggttttaacccttaccggtttacccgttttacccccccttcccggttaaccgttaccttttaaccggtttaacttaaccgttttaaccg

SEQ ID NO: 192759 - DNA, 657 bp, Homo sapiens
  misc_feature: GYAE6OF02JQ1JP.44.23.C01.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
tcagacagtatatacacgaccggtgctcgatttagtacacgtgattaggattggggagtcgagaccctgtcagggacagcatggacatgagggtcccgctcagctcctggggctcctcgctgctctggctcccaggttcgagatgtgacatcgagatcgaccagtctccttcctcctgtcttcttctgttcgagcagcgtcacatcacttggccggngagtcaggttcggttttcgagtcttgttcgccttggttacaaacgtaaaaggggnaccggtccctaaggtcctcgtctctgtacgaaccngacgtggaaggtacgcgttacccgtccgaggttcaggtcgaccgagtccgaggtcgggtccggcggtacgtccngttccncacgtaatcgggacctacgtcggccggtctaggtacttactcgttacacgttaacttttagttcgtacgtctaacggtactacgtactacgtagttacggtccgtaaccccggtttcttaccggtttccggacgtacgggaacctaggtacgtacggtaactaaccgaaaccgtcgttaggtcgtcgtacgtacccgtacgaaccgtttctccgttaacgttccctaacgtttccccgtccctaccgttacgttactttccggattaacg

SEQ ID NO: 192760 - DNA, 657 bp, Homo sapiens
  misc_feature: GYAE6OF02HDEHY.44.23.C01.1.454.CMB.1.raw
  modified_base (472)..(472): a, c, t, g, unknown or other
  misc_feature (472)..(472): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctccaggttcgagatgtgacatcgagatgacccagtctccttccttcctgtcttcttctgttggagcagcgtcaccatctacttcggccgggcgacgtcagggttcgttttcggtgcgttgttcgtcctggtttacaaacgaaaaagggggtgacggcccctaaggtcctcgtctcgtcgtacgaaaccagacgtaggaaggtacgacggtcccgtacagggttcagttcgccagtcgagggtggtcgggaccggtgtccactctacgacagttacgcgtaccgtgccggacctgaacgtacgtctacgactaactttatttctgtactagacttagtacttnaacttacgttccggtaccccgtttagtaccgtttttcggggaccctaacggggtaccctaaggtccggttaaacggaacttaaccgaaaccgtacgtcggtcgtacctgacctccgtaatccgttacgttaccttacgtaccgttcccgtttacccggaccttacgtttacgtacgtaattaacg

SEQ ID NO: 192761 - DNA, 972 bp, Homo sapiens
  misc_feature: GYAE6OF02JP9XS.44.23.C01.1.454.CMB.1.raw
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggcctcccaggttcgagatgtgacatcgagatgacccagtctccttcctcctgtcttcttctgttgacgcagcgtcacngtcacgttcggccgggcgtagtccgtaggttccgttttcgggngtccgttggttcgtaccgttggttttaccaaaaaacgggtaaaaaacggggggtgtaacccggggtccccccttaaaaggggttcccccgttaccggtttacccgttaccggttaccgggtaaacccggtaaaaaacccgtacgggtaacccggttaggggtaaaaacggggttaccgtaaccggttacccccgggttacccggtaaggggtttaccctaacgggggttccaacccggtaaccggtccccgggttaaagggggttcgggggttacggggggtacccccggtaacgttccccgaaccgttcccgtacccgtaaaccccggtaaggttttaccgggaccccgttaacccgtcgggacccgggtaccccttagggaaaacgtttcccgtttaacgcgttacccttaaacgtttttgtttcctaggtaccgtacggtaccgtaagttaccgtatacgtttaacggtcccgttccccctttagttacgtttcccgggaccggtaaacggggtaacccttaagggtccggttaaaacggtaaaaccgttaacccgttaaaaaaccgggcggtttaacggggtcccgtaacgttacccgggaccctaaacccgggttactttaccggttaccggtttaacccttaacccggtacccgttttaccccggttccccccctaaaggttacccttaacgggtacccgtttaacgtttaaacccg

SEQ ID NO: 192762 - DNA, 675 bp, Homo sapiens
  misc_feature: GYAE6OF02HU22B.44.23.C01.1.454.CMB.1.raw
  modified_base (278)..(278): a, c, t, g, unknown or other
  misc_feature (278)..(278): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttcctgtcttcttctgttgaggcagcgtcacatcacttcggccggcgagtcgaggttcgttttcggtgcttgttgccttggtttacaaacggaaaaaggggngacggacccctaaggtccctacgtctcgtcgtacgaaaccagtaacgtgggaaggtaggacgttcccggtccaggtttcaggtcgaccgaggtccgagggtcgggtcggggacccggtagtccacgtcctcaaccgtattacggaccgtacctggaccggtccgtagaacgtactttcgtcgtactaacgttttactttctcgttacagtacctagtactcgtagttacgttccgtacccgtttcgtaccgttttcggacccgtaacggggtaacccgtaggtccgtaaggtaaaccttacgaaaaccgtaacgtagtacgacttcgacctaaccgtacgtccttgttcttaccgtacttacccgttaccccgacgttactaccgttacgattaacg

SEQ ID NO: 192763 - DNA, 670 bp, Homo sapiens
  misc_feature: GYAE6OF02I3AJU.44.23.C01.1.454.CMB.1.raw
  modified_base (239)..(239): a, c, t, g, unknown or other
  misc_feature (239)..(239): n is a, c, g, or t
  modified_base (659)..(659): a, c, t, g, unknown or other
  misc_feature (659)..(659): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttcctctgtcttcttctgttggaggcagcgtcaccatcacttgccgggcagtcaggttcgttttcggngtctgttcgccttggtttacaaacggaaaaggggtgacggtacccctaaggtcctacgttctactcgtacgaaacccgagacgttagggaaggtacgtacggtcccggtactacggttctaggtcgacctaggtacccgtaagggttcggtcggggtaccggaggtacccgaacttcctaaccgaacccgtaaggttacgccgtaacccgtcggccggtacccgttaggaaacgtactttccgtacgacctaaaccgttttattccgtgttaccgagtcctaaggttactacgtaaggttactccggtccccgtttcttacgtttcgggaccgtaacgggtacctaagtcgtaaggtaaactacgaaaacgttctagggtcgactagacacgtcttcgtcgtctactctaccgtccactntctagtatacg

SEQ ID NO: 192764 - DNA, 735 bp, Homo sapiens
  misc_feature: GYAE6OF02JSYBX.44.23.C01.1.454.CMB.1.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
tcagacagtatatacacgaccggtgctcgatttagtacacgtgattagggattgggggagtcagaccctgtcagggacagcatggacatgagggtccccgctcagctcctgggctcctgctgctctggctcccaggttcgagatgtgacatcgagatgaccagtctccttctctgtcttctctgttgagcagcgtcaccatcacttgccgggcgagtcaggttcgttttcggngtctgttgccgttggtttacaaacgaaaagggggnacggcccctaaggtccgtacgtctcgtcgtacgaaaccnggacgtggaagtagacgtcccgtacgaggttcaggtcgaccgtaggtccgagggtggtacgggccggtagtcccgtatccgtaccaaccgtagttacggcgtacctcggaccggtccttagggaaactcggtttacctacggaaccttaacgttttaacttcgtagtaccaggtacctaaggttactccgtaacgtttacgttaccgttaccccgtttattaacggtttttccgggaacccgtaacgggggtaaccctaaacggtaccggttaacgggtaaaacttacccgaaaaacggttacccggttacgggttacgggtaccttacgacccggtttaaccgaagtttacccgttggttaaccccgtttactaaccgtttccccgtacccggtacccttaacgttccgttaacgttacttaaccgg

SEQ ID NO: 192765 - DNA, 786 bp, Homo sapiens
  misc_feature: GYAE6OF02I3OQI.44.23.C01.1.454.CMB.1.raw
  modified_base (393)..(393): a, c, t, g, unknown or other
  misc_feature (393)..(393): n is a, c, g, or t
  modified_base (438)..(438): a, c, t, g, unknown or other
  misc_feature (438)..(438): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgaacccagttcctccttccgttccttcgttcctttcttccgttggtttggacggtcgtaggtccgtaccacctactccgacttcggccgggtcgacgtccgtacggttccgttttacgggtcgtccgttggttcgtcccgtttggtttaaccgaaaaagggtaaaaaagggggggtctaaccgggtacccccgtaagggttcccttaccggtcttcgtccgtaacgaaaaccngtacgtagggtaacggtcgacgtccccgtactaggttcaggtacncccgtagtacccggtagggtgggtcggggccgtacgtcctacgttcctacgaacctaagttcggaccgtacctagggcccggtactagggtaaactcgtttccgtacgtacctttaacgttttaactttccgtacggttaccaacgtaccgtaagttactaccgttaaacgttacggttcccggttaccctttaccggttaccggttttaccgggaccgttaacggggaacctaacggtaccgaacggtaaactaacgtaaaacggtcttagggtacgactacgactaccgtattccttagttccttacgacccttcccgttaccctcgtacttacgtagtacttaag

SEQ ID NO: 192766 - DNA, 866 bp, Homo sapiens
  misc_feature: GYAE6OF02H34AN.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagtatgtgacatcgagatcgacccagttcctccttcctttcctgttcttcttctgttaggacggcagccgtacacctatcacgttcggaccgggcgtagtcgtacgggttccggttttcggtcgtcttggttcgtccgttttagggtttaccaaaaacgggtaaaaaaggggggtacgaacccgggtacccccggttaaacgggttcccttacggttccttaccgtacggttacggaaaacccgcgggtaaccgttaaggggaaaacgggttaaccggtaaccggttacccccggttacgtaacggggttttaccgaaggttcggaacccgtacggttacccggtagggggttcgggtcgggggacccggtacggttacctaccgttccgaccttaaccgtaacgtttacggaccctaccgttcgggacccgggtcctaagggtaacgttacgtttacgttacggtaaccctttaaagtttttaccgttttaccggttacgttacgaacgttacgttagttaacctacgttagtttaccggttccttcccccgtttataccggttttcgggaaccggtacgggaaccctacgggtacgtaacgtaaacgttccgtaaaacggtaacgtgggttaccgtactacggtaccctaacgtcttccgttagttcccttaacgaccctttcccgtaccccgacctttacgtcgttaacgttactttaacg

SEQ ID NO: 192767 - DNA, 650 bp, Homo sapiens
  misc_feature: GYAE6OF02FJN6Q.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcacatcacttgccgggcagtcaggttcgtttcggtgctgttgccttggtttacaaacgaaaagggggagacggcccctaaggtcctcgtctcgtcgtgaaccagacgtggaaggtagacgtcccgtcaggttcagtgccagtccgaggtcggtcgggccgagtccacgtcctcacctagttacgccgtacctggccggcctagaagtacgttcgtacgaccgtaacttttatttccgtagttccgtaagtccgtaagttactacgtacgttacggttccgtaccccgtttctaacgtttttccgggaccgtacggggttaaccaacggtcgttaaggaaacgttaccgaaaacgtacgttgggaacgtcgtacgacctaaccgacgttccgttacggttccttaccgtacttcccgttacccgccgtacttccgtataacttaacg

SEQ ID NO: 192768 - DNA, 852 bp, Homo sapiens
  misc_feature: GYAE6OF02JRSBC.44.23.C01.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
tcagacagtatatacacgaccggtgctcgatttagtacacgtgattaggattgggggagtcagaccctgtcaggggacagcatggacatgagggtccccgctcagctcctgggctcctgctgctctggctcccaggttcgagatgtgacatcgagtatcgacccagttctcccttccttacctgttccttcttcttggttgtaggccagccgtcaccatcacttcgccgggtnagtcagggttccgtttttggngtcgtgtttgccgttaggttacaaagtaaaacgggggacaggacccctaggtcctcgtctcgttcggtaacgtaaccaggtactaggtaacggtacgtacgttccccggttacgtaggttcccgtaagtcggtcccgaagtcccgaaggggtcggtcgggggtcccgaggtccctaacgtccgtccgaaccttacgttacggtccgaaccgttcggaccggtaccgtagggaaaccttcgtttccgtacgacctttaaaccgttttagttttccttaggtacctaaggtaccgttaaggtaactttccgttaaactttcgggttaccccggttacccccggtttttacgtacccgtttttttacccgggggaaccccggtaaggggggttaaacccctaaaccggggtaacccgttttaaagggaaaaacccttttaccgaaaaaaccgggttaccgtttcgggttacgttccgggaccgtaaccccggtaaccttcgggtttaacccgtttcgtttcccccgtttaaccgtttaccttttaacccccggtttccccgtaaccttacgggtttccccttaaggtttacctttaaacgg

SEQ ID NO: 192769 - DNA, 692 bp, Homo sapiens
  misc_feature: GYAE6OF02GB9WO.44.23.C01.1.454.CMB.1.raw
  modified_base (543)..(543): a, c, t, g, unknown or other
  misc_feature (543)..(543): n is a, c, g, or t
tcagacagtatatacacgaccggtgctcgatttagtacacgtgattagggattggggagtgctttctgagagtcaaggacctcctgtgcaagaacatgaagcacctgtggttttcctcctgctggtggcagctccagatgggtcctgtcccaggtgcagctgcaggagtcgggccaggactggtgaggtccttcgggaaccctgtctctcgatctgctactgtctcgtggtacgtttccatctagttctgattactgtttcgttggggtactacggtacgttccggcgtaccggcccccggtaggggacggggtaagcgggtaggtggtacgttgggtcgacgtacgtcctagttacgtacgtcggggtaccgtacgttacgtacctccgtaccgtcctaacgacgtacgtccgtcgtacctacgttacgttacgggaacggactaacgtccgactacgtacccgtccttaccgtaccctagaaacctcgaacccgttccgtccgacccgccgtcggaaccgtccggttacgtttacgttcgngttacggcggaacggtcgtacggtacgtcgtttacctcgttaactcgtacggtcgggtccgtacgtccgtaaccgtcggtaccgtcgttacgtcccgttcgagttccgtcccgttaacccgacggaacccgggtcctacgttaccccgg

SEQ ID NO: 192770 - DNA, 635 bp, Homo sapiens
  misc_feature: GYAE6OF02FNQVD.44.23.C01.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (435)..(435): a, c, t, g, unknown or other
  misc_feature (435)..(435): n is a, c, g, or t
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
tcagacagtatatacacgaccggtgctcgatttagtacacgtgattagggagttgggggagtcagaccctgtcaggggacagcatggacatgagggtccccgctcagctcctggggctcctgctgctctggctcccaggttcgagatgtgacatcgagatgacccagtctccttccttctgtcttctctgttggaggcngcgtcaccatcacttgccgggcgagtcaggttcgttttcggngcttggttcgccttggtttaccaaacgaaaaagggggtnacggaccctaaggtcctcgtctctcgagaaccngactaggaaggtcgacgtcccgtacgaggttcagtcgccagtcgagggttggtcgggcgacgtccacgtcacacagttacgctaccgtgccggcctagacgtcttcgacgacttaaacgttntttcgtcgtacagtcaagttacnctaagtcggtccgtccccgtttntccgttttcggaccgtacgggacctagtacgttaggaaacttaccgaaaccgtaacgttcggtacggactacgacctaaccgtactttcgtaccgtttccttacgttacccgttcccgttaccccggacttacctacgttacgttaacttaacg

SEQ ID NO: 192771 - DNA, 712 bp, Homo sapiens
  misc_feature: GYAE6OF02GSFHX.44.23.C01.1.454.CMB.1.raw
  modified_base (251)..(251): a, c, t, g, unknown or other
  misc_feature (251)..(251): n is a, c, g, or t
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
tcagacagtatatacacgaccggtgctcgatttagtacacgtgattagggattggggagtcagaccctgtcaggggacagcatggacatgagggtcccgctcagctccgtggggctcctgctgctctggctcccaggttcgagatcgtgacatcgagatgaccaagtctccttccttcctgttcttcttcttgttggtacgctagcgtcaccgatctacttcgccgggcagtcgaggttcggttttacggngtctgttcgcttggttcaaacgaaaaggggnaccggaccttaaggtcctagtctacgtcggtanaaacctgacgtaggaaggagtaccggtcccgtactagggttacaagtcgacctaggtaccgtggtcggggtacggccggtaggttaccctaatcccgtactaccggtaatttcggccgaaccgttggaacccggtcgttagaaagtcgtttcgtacgtactaacgtttactttcgttacgtcgtaacgtcgtaagtactactagtacgttacgtcccgtttacgttacgttttcgggtaccggtaacgggtaccgtaacggtccgttaaacggtaaacgttaaccgtaaaaccgtaacggttccggtacggtaccgttcggacctaaccggtaactcgttaccggttcctttacgtacctcccggttccctacctacgtttacctaggtacttaacg

SEQ ID NO: 192772 - DNA, 741 bp, Homo sapiens
  misc_feature: GYAE6OF02I6200.44.23.C01.1.454.CMB.1.raw
  modified_base (199)..(199): a, c, t, g, unknown or other
  misc_feature (199)..(199): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctccaggtgccaaatgtgacatccagatcgacccagtctcccttccaccctgtctgcatctgtagganacagacgtcaccatcacttcgccggcaagtcagtatagttagtagttggttcggccgtggtatcgagtacgaacgaaaccgagggaaactaccccctaaatcccgttagacttacgtttcgactcgtactacttacctacgttttcgactaacgtcggtaccgggtaccctacttcgtaccggttacgacggtccgtacggtagttcggtacgtcggttacgggaacttaggttactttccctcgtacctacgtaccgtatccgaagcctacggccttacggctacgtaccgtagaaattcgttagtttacggtaccttaaacgtttacttacgtaacggtaaactaaaccggtacctaacgttacccggtacctccccgttaactaacccgtttaaccggtttacccgggacccgttaacgggtaaaccccgttaaaggggttacccgtaaacgttaaccgttaaaccggtaaaacccggttaccgtttcggtaaccggtaccgttaccgaaaccctttaccggtacgtttcccgtttaac

SEQ ID NO: 192773 - DNA, 714 bp, Homo sapiens
  misc_feature: GYAE6OF02HJHS9.44.23.C01.1.454.CMB.1.raw
  modified_base (188)..(188): a, c, t, g, unknown or other
  misc_feature (188)..(188): n is a, c, g, or t
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcgagctgcaggagtcgggcccaggactgggngacggccttcgggaaccctgtctctcatctgcactgtctcgtggtactttccatcagttctgatctattcgttgggctggactccggacncgccccgagggagggatgggaggtggagttggtagacgtactcgtattagtacgtggggacgtaacgtactaccgttctccgtccctagtaacgtcgtccgtctaccaccgttagttcggacggacctaccgtcaacgtcgaacccgtcctttaccncctaacgtaaccgtccgtcccgttcccggtacggacccggacccggaccggaacccgtaccggttacccggttttactttccggtacgtcggaccgggaggtaccgacggttacgttcgggttacctttacgtaacgttggtaacgggttccggggtccgttaccgggtacccgtacccggtttcggtaccctaccgttccggttacccttcccgttaccgtacccgttcccttaacccggaaccccggtacccggtacccccttacggttacccccgg

SEQ ID NO: 192774 - DNA, 766 bp, Homo sapiens
  misc_feature: GYAE6OF02IT1JM.44.23.C01.1.454.CMB.1.raw
  modified_base (433)..(433): a, c, t, g, unknown or other
  misc_feature (433)..(433): n is a, c, g, or t
tcagacagtatatacacgaccggtgctcgatttagtacacgtgattagggattgggggatcagaccctgtcaggggacagcatggacatgagggtccccgctcagctccgtggggcctcctgctgctctggcctcccgaggttcgagtatgtagactagtacgagatacgaacctaagttcctttcccttcctttccgttgttccttttactttcgttggtttacgggacggccacggtccgtaccaacctacgttccgtacgttccgggccggggacgtaacgtcggtacgggttttcgtttcggtcgtcgtttggtccgtcgttacggttaacgaaaacgggaaaaggggtcgaaccggtaccccgtagtccgtcgtctcgtacgtacgaaaccagtacgtaggaggtagaccgtcccgtacgtaggtacngtacgcctacggtacgtagggtcggtcggccggtacgtccgtacgtcctactacgtacgtcgaccacgtggtccgtacgtagaacttacgtactagtaaccttatttacgttccgtagtaccagtacctaacgtagtacgtaagttacgtacccggtttccttaacgttccggtttacggaacggtacccgggtaactaacggtacgtaagtaaaccgtaaccgaaacgttaggtacgttaacgccgttacgaccctacggttaccgttacttacggttaccttacccgttacgttacccggtacccttaaccttcgttactacgtaactacg

SEQ ID NO: 192775 - DNA, 734 bp, Homo sapiens
  misc_feature: GYAE6OF02GXAXE.44.23.C01.1.454.CMB.1.raw
  modified_base (320)..(320): a, c, t, g, unknown or other
  misc_feature (320)..(320): n is a, c, g, or t
  modified_base (350)..(350): a, c, t, g, unknown or other
  misc_feature (350)..(350): n is a, c, g, or t
  modified_base (519)..(519): a, c, t, g, unknown or other
  misc_feature (519)..(519): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttaccttcctgtaccttcttccttggttggacggcagcgtcaccatcacttggccgggcagtcgaggtcgttttcggtctgttcgccttggttacaaacgaaaagggggcacggtacccgtaaggtcctcgtctctccgtagaaaccngacgtggaagtagcgtcccgtcaggttacngtcgaccgtagttccgagggtcggtcgggggcccggacgtcccgacttaccgtccaacccgtagtttaaccggccgtaacccgttgggcccggaccttaagggaacgtactttaccggtcgaccctaaacgtttttatttcgttggtaaccagtaacctacgtacgtanaactttaacgggtccgttccccggtttacgttaccggttttacggcccgtaacgggggaacccgtaacgtaccgttaacgggaaacttacccgtaaaaacggtaccgtcgggttacgccgttaccggactaaccggtaacgttccttggttacccttacgtaccgtttccccgttaacccggtccttaacggttcccgttaggtacctttaacgg

SEQ ID NO: 192776 - DNA, 953 bp, Homo sapiens
  misc_feature: GYAE6OF02IZKRC.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccagtctccttccttcctgtcttcttctgttggagcagcgtcaccatcacttcggcccgggcgagtcgtacgggttccgttttcggtgcgttgttcgtccgtttaggtttaccaaaaacggaaaaacggggggcgaccgggttacccccgttaagggtccccgttcgttccgtaccgttccggtaaccgaaaacccgtaggtaccgttaggggaacgggttacggacccggttcccccggtaacggtacggtttaccgaacggttcgaccccgtacggtccggtaagggggttcggggtaccggggaccccgggttacgttaccccgtaccgtttaccccgttacccgaaaccgttaacgttaaccggccccggtaacccgttaccgggccccgggttaaccccgttagggtaaaccggttcgttttaacccgttacggttaaccctttaaccgttttttacgtttttcccgttacggttaccgtaacggtaccgtaacgtttaaccgttacgttaacgtttaccggttaccccgtttcccccggttttaacccgtttcccgggtttttaaccgggaccccgggttaaaccggggtaaccgttaaacccgggttaccggttaaaccgggtaaaacgttaaacccggtaaaaacggttaccggtttaacgggtacggttaccgtaccgggtaccttaaccggttaaccggtttccttaacggtttcccttaaccgtttacccttacccggtttccccgacccgtttaccgtacttaggtaactttaaccg

SEQ ID NO: 192777 - DNA, 709 bp, Homo sapiens
  misc_feature: GYAE6OF02G4O6F.44.23.C01.1.454.CMB.1.raw
  modified_base (158)..(158): a, c, t, g, unknown or other
  misc_feature (158)..(158): n is a, c, g, or t
  modified_base (216)..(216): a, c, t, g, unknown or other
  misc_feature (216)..(216): n is a, c, g, or t
  modified_base (632)..(632): a, c, t, g, unknown or other
  misc_feature (632)..(632): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagntgaccagtctcctctcctgtcttctctgttggagcagcgtcaccatcacttgccgggnagtcaggtcgtttcggtagctgtcgtcctggtttacaacgaaaagggggcgaggtcccctaaggtcctacggtctctcgtagaaaccgaggactggtaaggtagtacgtccgtacctaggttcagttcgactacgtccgagggtcggtcggggaccggagtcccgacttcgtacacccaagtttcggaccgtaccgtggaccggtccgtacgaacgttacgtccgttaacggccttaaaacgttttacgttttccgtcggttaccgtacggtaaccctagggttaacttccgaatttaacgggttcccgtaccccgtttattaaccggttttcgggacccgtaacgggggtaacccaggtacctaggaaactaaccgaaacggttactacgggtagaccgttaggacctaaccgtnttaccggttacttccgtttaacctacggtttaccccgtttacccgcccgtaaaccgtttcgttaacgtacttaaccg

SEQ ID NO: 192778 - DNA, 728 bp, Homo sapiens
  misc_feature: GYAE6OF02G7UC5.44.23.C01.1.454.CMB.1.raw
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtcctccttccttcctgtcttcttctgttggaggcagcgtcaccatcacttggccgggcgagtcgtaggttcgttttcggtgtcttgttcgtccgttggtttacaaacggaaaaagggggtcgaccgggtacccctaaggtcccgtcgtcctccgtacgtacgaaacccgagtacgtagggaaggtacgaccgtcccgtcgtaggttcgacgtcgacctacggtcgtaagggtgggtcgggaccggtacgtcccgtactccgtaccaaccgtaatttccggaccgtacccgtacgggtcccggtacctagggtaacgttacgtttccgtacgtaacccgtttaaacttttcgtttccgttacgtacgtacggtaccgtaagttaacctcgtaagttccgttaccgttccccgtttacgttaccgttttacgggaccgtaacggggtaacctagtccgttaagaaacttccgaaaacggtctggtggtacctacgctaacctgttacggttacttcctacgttaccttcccgttacccgtactccgtttacgtacgtatttaacg

SEQ ID NO: 192779 - DNA, 602 bp, Homo sapiens
  misc_feature: GYAE6OF02GPFQW.44.23.C01.1.454.CMB.1.raw
  modified_base (273)..(273): a, c, t, g, unknown or other
  misc_feature (273)..(273): n is a, c, g, or t
  modified_base (411)..(411): a, c, t, g, unknown or other
  misc_feature (411)..(411): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgcctggtttacaaacgaaaaggggngacggcccctaaggtcctcgtctctcgtagaaaccagacgtggaagtagacgtcccgcgtaggttcagtcgcctagtccaggtggtgggccggagtccactctacactattacgcgacctgccggtaccgtagaagtnttctagactaacgtttattctgtcagactagtactacgatacgtacgtccccgtttactaccgttttcggaccgtaacggggtaaccaacgtaccgtaaggaaacttacgaaaacgtactggtacgactcgactaccgtacttccgtcgtccttacgacttcccgttcccgacctacgtcttagacttaac

SEQ ID NO: 192780 - DNA, 634 bp, Homo sapiens
  misc_feature: GYAE6OF02HIML5.44.23.C01.1.454.CMB.1.raw
  modified_base (245)..(245): a, c, t, g, unknown or other
  misc_feature (245)..(245): n is a, c, g, or t
  modified_base (591)..(591): a, c, t, g, unknown or other
  misc_feature (591)..(591): n is a, c, g, or t
  modified_base (629)..(629): a, c, t, g, unknown or other
  misc_feature (629)..(629): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccagtcctccttccttcctgtcttcttctgttggagcagcgtcaccatcacttggccgggcagtcacggttcgttttcggngtctgttgccgttggtttacaaacggaaaaaggggggcacgggtacccctaaggtcctcggtctcgtcgtacgaaaccaggacgtagggaagtacggacggtcccgtacgaaggttcaaggtcgccagtccgagggtgggtcggggaccgagtccacgttccacactacgtacggccgaaccgttcggcgggaccctagggaattacttctgtacctaactttactttcgtagtccgaagtcctagttactagtaacttagtcccgcccgttagttaccgtttggaccgtacggggaacctagtcgtaaggaataccgaaacgtactaggtcgctacgcctaccgnttcgtctacctctaaccttcctacccgcttatcctagnttaac

SEQ ID NO: 192781 - DNA, 638 bp, Homo sapiens
  misc_feature: GYAE6OF02G4LTU.44.23.C01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttcgccgtggtttcaaacgaaaagggggngacggacccctaaggtcctcgtctcgtcgtacgaaccaggacgtggaaggtagacgtcccgtccgtaggttcagtcgccagtccgaggtcggtgggcccggtagtcccacttcgtcaaccgtacttacggaccgtacctggccggacctacggaagtcttacgtacgtaccttaaacgtttcgtttctacgtacaggcctagtacttactagtacgttccgtccccttagttacgttttcgggaccgacggggtaaccaaggtccgtaaaggaacctaacgtaaacgtaacgttggacgtcacgaccaacgtcttcgtcgttccgttactcttacccgtccctactaccgtcttacgtattaac

SEQ ID NO: 192782 - DNA, 659 bp, Homo sapiens
  misc_feature: GYAE6OF02F4AFN.44.23.C01.1.454.CMB.1.raw
  modified_base (239)..(239): a, c, t, g, unknown or other
  misc_feature (239)..(239): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacttgccgggcgagtcaggtcgttttcggngctgttcgccttggtttacaaacgaaaaagggggcaggacccctaaggtcctcgtctctcgtacgaaaccgagtactaggaaggtacgacgtcccggtactagggttccaggttcgccgaagtccgagggtggtcggggacccggtagtcccacttccactacctattacgcgacccttggccggcctaggaatcttcgtagctaactttatttctagtcagtactaagtactcgtaatacgttcgtccccgttctacgttttcgggaccgtaacggggaacctaagtaccgttaacggtaaacgtacgaaaaccgtaaacgttcggacggtacttaccggaccttaaccgtagttaccttcggttaccttactaaccgttcccgtttacccggacctaacgttccgttagaacttaacg

SEQ ID NO: 192783 - DNA, 693 bp, Homo sapiens
  misc_feature: GYAE6OF02IK0CX.44.23.C01.1.454.CMB.1.raw
  modified_base (551)..(551): a, c, t, g, unknown or other
  misc_feature (551)..(551): n is a, c, g, or t
  modified_base (686)..(686): a, c, t, g, unknown or other
  misc_feature (686)..(686): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccttctgtcttcttctgttggaggcagcgtcaccatcacttgccgggcgagtctaggttcgtttcggtgctgttcgccgttggtttacaaacgaaaaaggggggagacgggacccccgtaagggttccctcggtccttcgtaccgtacgtaaaacccgagaccgttaggggaaaggttacggaccggttaccccggtccgtaagggtttccgaaggttccggaccctacggttccccggaaggggttcgggtccgggggcccggtaacggtcccgtaacctccgtacaaccctagttacgccgtaacccgtggccgggaccgttggaacgtctttcgtacgtacctaatttacgttttctgttacgagtctaagttntacgtagttacgtccgtccccgtttcgtacgttttcgggccggtagggtaccgtagcgtacgaactacgaaactacgtacgtggactgacccagtactcgtacgttcttcgtactccgttcccgactactacgtntataacg

SEQ ID NO: 192784 - DNA, 679 bp, Homo sapiens
  misc_feature: GYAE6OF02I0AOW.44.23.C01.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (617)..(617): a, c, t, g, unknown or other
  misc_feature (617)..(617): n is a, c, g, or t
tcagacagtatatacacgaccggtgctcgatttagtacacgtgattagggattgggggagtcagaccctgtcaggggacagcatggacatgagggtccccgctcagctccgtgggcctcctgctgctctggcctccctaggttcgagatgtgacagtcgagatcgaccctagtcctccttccttcctgtcttcttctgttggagcngcgtcacctagtcacgtggccggcgagtcgtaggttcgtttcggngtcttgtcgtcgttcggtttaaacgaaaaaaacgggggngaccgggtaccccgtaacggtcccgttccgccgttactccgtacgaaacccgtagtaaccgtggtaacggtagacggtccccggtacgtggttacagtcgcctaggtccgtaggtcggtcgggtccgtagtccgacctcgtccgactacgtacgcgaaccgttgccggtaccgtagaacggttactcgtaggtacctaacgttttcttactcgtactacgtctaacgttatcctaagttccgtcgttccccgttattaccgttttcggaccggcggtaaccaacggtcgtacgggtatacgtacgaaaggtactggtacgcgacgtntaccgacttccggtgttcctaccgtcttaccgtccccgtactaacgtccgttagtcttaacg

SEQ ID NO: 192785 - DNA, 626 bp, Homo sapiens
  misc_feature: GYAE6OF02H9OQT.44.23.C01.1.454.CMB.1.raw
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
  modified_base (586)..(586): a, c, t, g, unknown or other
  misc_feature (586)..(586): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccagttcgagatgtgacatcgagatgacccagtctccttcttcctgtcttcttctcgttggaggcaggcgtcaccatcacttggccggcgagtcaggttcgttttggngctgtgcctggtttcaaacgtaaaaggggggtacggacccctaaggtcctgtctctcggtagaaaccngacgtggaagtagcgtcctcgagttcagtcgccagtcgagggtgcggacggactccacttcnccacgtagtcgcgtactggccgggcctagaacgtnttcngactaacttttntttcgtagtnagtaccaagtttacgtactagttaccgtccgtcccccgttttagtaccgtttttcgggaccggtaaggggtaccccaaggtcccgtaaggaacctacgtaaaaccggtcttacggtaggccttacgaccgtaacgtgtaccgttgtaacctttcnccgtttcccttccccgacgtaactttccgtacgtattaac

SEQ ID NO: 192786 - DNA, 529 bp, Homo sapiens
  misc_feature: GYAE6OF02G25GT.44.23.C01.1.454.CMB.1.raw
  modified_base (487)..(487): a, c, t, g, unknown or other
  misc_feature (487)..(487): n is a, c, g, or t
  modified_base (490)..(491): a, c, t, g, unknown or other
  misc_feature (490)..(491): n is a, c, g, or t
  modified_base (493)..(494): a, c, t, g, unknown or other
  misc_feature (493)..(494): n is a, c, g, or t
  modified_base (496)..(529): a, c, t, g, unknown or other
  misc_feature (496)..(529): n is a, c, g, or t
tcagacagtatatacacgaccggtgctcgatttagtacacgtgattagggattggggaagtcagccataatggaagcaccagctaataacccgtccctcaagagtcgactcaccatctccgtcgacacgtccaagagacagatgtccctgagtctgacgtctgtgacccgccgcggacgcggctgtgtatttctgtgcgagacggccctggtaccagcgagtggtacctctactactactctctggacgtcgtggggaccaggggaccgcggtccacccgtctcctaccgacgccctaccgaacccgaacgggaccctacgttccggtcccttccccccgtcgggccctacccctccctaccgaagacgacctaccgtccggtcggggcacgacggccggcccgtggccgtgccgttggaccaaaggtacctacttccaccgtcctacgtgctaggcggcgggtctaggacgacggcgctaagtagncannannannnnnnnnnnnnnnnnnnnnnnnnnnnnnnnnnn

SEQ ID NO: 192787 - DNA, 816 bp, Homo sapiens
  misc_feature: GYAE6OF02HEO52.44.23.C01.1.454.CMB.1.raw
  modified_base (101)..(101): a, c, t, g, unknown or other
  misc_feature (101)..(101): n is a, c, g, or t
  modified_base (265)..(265): a, c, t, g, unknown or other
  misc_feature (265)..(265): n is a, c, g, or t
tcagacagtatatacacgaccggtgctcgatttagtacacgtgattagggattggggagtcagaccctgtcaggggacagcatggacatgagggtccccgntcagctcctggggctcctgctgctcgtggctcccgaggttcgagatgtgacatcgatatcgaccctagtcctcccttccttcctgtccttcttcgtggttggaggcagcgtacacctagtcctacgttcggcccgggagtacgtcgtacgggttccgtttcggngtacgttgttcgccgttaggttaacgaaaggaaaagggggcgtacggaccccgttaaggtcccgtacgttctcgtacggtaacgaaaccgacggtacgtacgggtaacggtaccgaccgttccccggtacgtaggttcgacggtcgaccgtacgtaccgtggggtacgggtcgggacccggtaacgtcccgtaactcctaaccaccgttaagttaccggccgtacgtacggcccgggtactaacggtaagttcttaccgtacgtaaccgtttaactttttaccgtttcgtaccggttaacgacggtcgttaaacgttcaacccgtttaagtttccgggttaccccgttccccggttttaatttacccgggtttaccgggacccgggtaaacggggtaacccttaagggccgttaaaagggttaaacctaaacccgggtaaaacggtcggtttacggcggtacctaccggtaccctaaccgagttttcccggttacgttaaccttcgaacctttccccggtaccgacttacgtccgttaacgtttaaacccg

SEQ ID NO: 192788 - DNA, 685 bp, Homo sapiens
  misc_feature: GYAE6OF02JDV07.44.23.C01.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagacagtatatacacgaccggtgctcgatttagtacacgtgattagggattgggggcatgagtcagaccctgtcaggggacagcatggacatgagggtccccgctcagctcctggggctcctgctgctctggctcccaggttcgagatgtgacatcgagatgacccagtctccttcttcctgtcttcttctgttggagcagcgtcaccatcactcggccgggngagtcaggttcgtttcggntctgttgccttggttacaaacgtaaaaggggagacggacccctaaggtcctcgtcctctacgtagaaaccaggactagggaacgtagacgtcccgtacgtaggttcagtcgacacgtacgaggtcggtcgggccggtagtcctacgtctacaccgtagttacgccgtacgtcggccggtcgtagaacgtacttcgcgtacgtaactttntttacgtacggtcacgtntacgtactactagtacggtacccgtcccgtttacgttaccgttttaccggccggtaaccggggtaccctaaggtaccggttaacggtaaaccgtaacgaacgttaaccggtaggttacgggtaccgttacggaccctaacccgtacgttaacgttccgtttaccgtttaccttaaccgtttcccgtttcccccgtacccgttacgtttaacccg

SEQ ID NO: 192789 - DNA, 768 bp, Homo sapiens
  misc_feature: GYAE6OF02JZTWD.44.23.C01.1.454.CMB.1.raw
  modified_base (162)..(162): a, c, t, g, unknown or other
  misc_feature (162)..(162): n is a, c, g, or t
  modified_base (243)..(243): a, c, t, g, unknown or other
  misc_feature (243)..(243): n is a, c, g, or t
tcagacagtatatacacgaccggtgctcgatttagtacacgtgattagggagttgggggagtcagacctgtcagggacagcatggacatgagggtcccgctcagctcctgggctccgtgctgctctggctccgaggttcgagatgtgacatcgagatgaccntctccttccttctgtcttctcgttgttggagcagcgttacaccatcacgttcggccggcgagtcgtaggttcgttttcggngcgttagttcgtccgttggtttaccaaacgaaaaggggggcgtacggtaccccgtaaggttccgtacggttctacgttcggttaacaaaacccgtggaacctacggggtaaggtacgaccgtttcccggtaccgtaagggtttccagggttacgacccctaggtcccggtaacgggtggggttccggggaacccggttagcccgttacgtccttaaccgtaccgtaagttttaaccggcgttaacccgtggtaaccggggaccgtttaagaacggtacgtttccgtacggacctttaaacgtttacgttttccgtagtacgtacgtctaagtacctcgtaagttacgtccgttaccgttcttacgtttccggacgtacgggaacctaacggggtacttacgggtaaacttacgtaaaaccggtagtccgttaaggtccgttacaccgaccgttgttacctacggtttcttaacccgtgttaaccccctttccgacctttaacttaccggttcaacgtttttaacg

SEQ ID NO: 192790 - DNA, 605 bp, Homo sapiens
  misc_feature: GYAE6OF02HMA9C.44.23.C01.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgtttcggngctgttgcctggtttcaagaaaagggggnacggccctaaggtcctcgtctctcgtgaaaccagactggaaggtagagtcccgtcaggttcagtgccagtccaggtggtgggccggagtccactctcaccattagaccgacctggccggtcctaggaacgtagttctcgtactaactttatttcgtacgttcacgtctaaggtactcgatttacgtccgtacccgttctacgtttttcgggacccgtagggggtaaccctaacgtacgtacgggtaaactcgaaaaccgtaccttagggtcgtcgtcgacctaccgtaattaccgtcgtctttaccacttcccttccgacctctctagtactaacg

SEQ ID NO: 192791 - DNA, 875 bp, Homo sapiens
  misc_feature: GYAE6OF02IVOGQ.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccgaggttcgagatgtgacatcgagatcgacccagtcctccttccttcctgtcttcttctgttgaggcagcgtcaccatcacgttcggccgggcgagtcgtacgggttcgttttcggtgtcgtttcgttcgtccgtttggtttaccgaaaacggtaaaaaagggggacggtaccggtacccccgttaaggttccccgttcggttaccgttccgtaccggtacgaaaacccgtacggtaaccggtagggtaaacgggtacgtaccggtccccgttaccgtacggtttaccgaacggttccgaccgtacgttacccggtaggggttcggggtccgggggacccgggtaccgttcccggtaaccgttccgtaacccgtaccgttaaacggtttaaccggcccggtaacccggttcgggaccccgggtccgtaaacggtaaagttccttttaccggtacgtacgtttaaacccgttttaacttttcgttcggtaccgtaacgtaccgtaagttacttacggtaacgttcgttccccggttaccccgtttcgtttaacccggttttccgggacccggtaaccgggtaccctaaacggtcgtaacgggttaaactaaccgtaaaaccggtaaccttagggttccgtaaccgttcggaaccctaacccggttaattccccggttgtttaccgtaaccttaccgttacccttaccccggaactttacggtcccttaaggttactttaacg

SEQ ID NO: 192792 - DNA, 770 bp, Homo sapiens
  misc_feature: GYAE6OF02IAHFZ.44.23.C01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (685)..(685): a, c, t, g, unknown or other
  misc_feature (685)..(685): n is a, c, g, or t
tcagacagtatatacacgaccggtgctcgatttagtacacgtgattagggtatttggggacgtcagaccctgtcgaggggacagcatggacgatgacgggtccccgctcagctcctgggggctccgtgctgctctggcctcccgaggttccgagactgtgacatcgagatcgacccagtcctccttcttccngttcttctttctggttggaggtacgngcgtaccactactacgtacgtcggccggagtactacggtaggttacgtttggctacgtgtctccgtttggttaaccgaaaaacgggtaaaaaggggtcgaacccgggtaccccttaacggttccccgttacggtacctcggttaccggtaaacgaaccaacgtacgtaagggtaacggttacgtacccggtacccgtacgtacggtttcaacggttcaccggttaccgtacggaagggttcgggtcggggtaccggtacgtcctaccgtccgtacccaacgtacgtaaccggccgttaaccgtacggtcccggtacgtacgggaacgttcgttactcggaaccttttaaccgttttattccgtagttcgacgtaagttacgtatacgtaagttacgccgttacccgttgttacgttccggacggtacggaacctaggtacgttaacgacgttaaaccaacggttacncggtgaccgttcgaacccgtaagtccttgttaccgttaaccttccgtaccttcccctaccggtctaaccggtctagtacttaacg

SEQ ID NO: 192793 - DNA, 511 bp, Homo sapiens
  misc_feature: GYAE6OF02JTVJG.44.23.C01.1.454.CMB.1.raw
  modified_base (379)..(379): a, c, t, g, unknown or other
  misc_feature (379)..(379): n is a, c, g, or t
  modified_base (469)..(469): a, c, t, g, unknown or other
  misc_feature (469)..(469): n is a, c, g, or t
  modified_base (473)..(511): a, c, t, g, unknown or other
  misc_feature (473)..(511): n is a, c, g, or t
tcagacagtatatacacgaccggtgctcgatttagtacacgtgattagggattgggagtatctattatagtgggagcacctactacaacccgtccctcaagagtcgagtcaccatatcagtagacacgtccaagaaccagttctccctgagctgagctctgtgaccgccgcggacacggccgtgtattactgtgcgagagtaggggctagttcgacacctaactactttgaccacgtcggggccacggggtaaccctggtccacccgtctccctcacgccctccaccacgggccccagtcggtcccttccccctggccctacccctccctcccaacgacgcctaaccctccggtggggaccacgacgccgggtccccgnggcgtggccctcgggtcgtaacggccgttaacttccgtcgaactccgcgtactcggaggccgggtcgaggtaccgaaggccgtcaacgtnagcnnnnnnnnnnnnnnnnnnnnnnnnnnnnnnnnnnnnnnn

SEQ ID NO: 192794 - DNA, 795 bp, Homo sapiens
  misc_feature: GYAE6OF02G1NZ8.44.23.C01.1.454.CMB.1.raw
  modified_base (181)..(181): a, c, t, g, unknown or other
  misc_feature (181)..(181): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtcctccttccttcctnttcttcttctgttggacgcagccgtcacctagtcctacgttcggccgggcgagtcgtacggttccggttttcggtgtcttagttcgtccttggtttaacaaacggaaaaggggcgacggtaccccgtaaggtccctcgtcctctacgtacgaaccagacgtggaaggtacggacgtcccgtaccgtaggttcgacgtcggtacccaacggttccggtagggttcggggtaccgggggtaccggtacggttacccgaaccttccgtacccaaaccgttaggttaaccggaccggtaacccgttcggccggtcccgttaggtaacgtacttcgtacgtaaccttaacttttaacgtttcgttaacgtctaacgtacgtaacgtaacgttaacgtacgttaagttcccggttacccggtttaccgtttaacccggtttttcgggacccgggttaacggggaaacctcggtaaccgttaaggaaaccgtttaacccgaaaaacgttcggtaacggtcgttaccggtacgtacccgtaacctaacgtttccttacgttccgtttaccgttacctttcccgttaaccccgtccttaccgtttacggtagtaacgtttaac

SEQ ID NO: 192795 - DNA, 738 bp, Homo sapiens
  misc_feature: GYAE6OF02FYJFB.44.23.C01.1.454.CMB.1.raw
  modified_base (221)..(221): a, c, t, g, unknown or other
  misc_feature (221)..(221): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggagcagcgtcaccatcacttgccgggngagtcaggttcgttttcggtgctgttgccgttggtttcaaacgaaaagggggagacggcccctaaggtcctcgtctctcgtagaaccagacgtaggaaggtagacgtcccgtcgtaggtcagtcgccgaggtccgtaggtggtcggggccggtagtcccgactctccaaccctagttacgaccgtacccgtggcccgggtacccgtaggaaacgtcgtttccgtacggtaccttaaacgttttattttcccgttgttccgtagtacctagttactcgttaagttcgttaccggttcccccgtttacttaccggttttttccgggaccggtaaccggggtaaccgtaacggtccgttaacgggtaaaccgttaccgtaaaaaccggtaacgttacggggttaccggtccgttacggaccgtaaccccgtagttaccgttcggttaacccttttccgtaaccgttttccccctttacccccggtaccttaaccgtttcccgttaacggtacttttaacc

SEQ ID NO: 192796 - DNA, 645 bp, Homo sapiens
  misc_feature: GYAE6OF02J2Z1Q.44.23.C01.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (601)..(601): a, c, t, g, unknown or other
  misc_feature (601)..(601): n is a, c, g, or t
  modified_base (610)..(645): a, c, t, g, unknown or other
  misc_feature (610)..(645): n is a, c, g, or t
tcagacagtatatacacgaccggtgctcgatttagtacacgtgattagggattggggaagtcagccataatggaagcaccagctataacccgtcctcaagagtcgactcaccatctccgtcgacacgtccaagagacagatgtcccngtacgtctgacgttctggtcgaccgccggcggacgcggcttgtgttactttcgnggtgccgaggaccggtcccgtggtaaccagggtccgagggttaccgttacccttcttaaccttaccgtacctccgttcggtacggggtaccgttccggggtcggggggacccggacggggggtacccggtccggtacctacccggttccttcccgtacgaccggccccttacccgaaccgaaccgggtccctacgtccccggttccccttcccccgtcggccccaccccttcccgaccgaacgtccgccgtacccgtgggtccggggaccaccggaccggcccgggtcccggtcgggtccctccgggtacccgttacgggtaccaaacggttcccttaccgttacccgaccgttcgttaccgtcggcgtacggcggtacgggtcggtacggacgtacggngacagtcgnnnnnnnnnnnnnnnnnnnnnnnnnnnnnnnnnnnn

SEQ ID NO: 192797 - DNA, 708 bp, Homo sapiens
  misc_feature: GYAE6OF02FYEL9.44.23.C01.1.454.CMB.1.raw
  modified_base (253)..(253): a, c, t, g, unknown or other
  misc_feature (253)..(253): n is a, c, g, or t
  modified_base (331)..(331): a, c, t, g, unknown or other
  misc_feature (331)..(331): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggcctcccaggttcgagatgtgacatcgagatcgacccagtcctccttccttcctgtccttcttctgttcggaggctagcgtcaccatcacttcggccgggacgagtcaggtttccgttttcggngtcgttgttcgccttggtttacaaaacggaaaagggggcacggaccccttaaggtcctcggtctcgtcgacgaaaccngtaccgtaggaaggtcgaccgtcccgtacgaaggttcaggtcgccgtacgtccgagggttcgggtcggggcccgtagtcccaccgtcgtaccaccgtattcgccgtacgtcgccggtctagtaacgtcttcgacgtactaacgttttacttcgtgtccgagtccgttaacgtactacggtaaagttccggttaccccgttcccgttacttaccggttttaccgggacccggttaaacgggaaccctacgggtacgttaacggtaaacttacccgaaaacggtactcgggtacgtacgttaccgaccttaccgtaacgttccgtcgtttaaccttacttacgttccccttaccggctaacgtttcgagtatttaaccg

SEQ ID NO: 192798 - DNA, 618 bp, Homo sapiens
  misc_feature: GYAE6OF02FUPHO.44.23.C01.1.454.CMB.1.raw
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcagtcaggtcgttttggngctgttgcctggtttcaacgaaaaaggggngaggcccctaaggtcctcgtctctcgtgaaaccagacgtggaagtagagtcccgtccgaggttcagtgaccaggtcccaggtggtgggccggagtccactctcacgattacgcgaccgtgccgggccctagaacgtattctgtctaactttactttacgtgtacctagtacgtagtagtccaattaacgttcggccccccgtttactaccgtttttcgggacccgtacgggggtaacccgaacgtaccgtagggaaactaccgtaaaacgtacgtagttacggtctcgccaccgtaacgtcttcggtactttacaccttccgttccctaccgtactacttaggtacttaa

SEQ ID NO: 192799 - DNA, 744 bp, Homo sapiens
  misc_feature: GYAE6OF02FZO3E.44.23.C01.1.454.CMB.1.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgcgtcagctcctggggctcctgctgctctggctcccaggttcgagatgtgacatcgagatgaccagtctccttccttctgtcttctntgttggagcagcgtcaccatcacttgccggacgagtctaggttcgttttcggntcttgttcgccttggtttacaaacggaaaaggggtnaccggaccccttaagggtcctgtcctctacggtacgaaccgtaagacgttagggaaagggttacgaccggttccccgtaccgtagggtttaccgagttacggccgtacgtccggtaaggggttgggttccggggccggtagtcccactcgtaccactaagttacgcgtacctcggaccgggttccagtaacgtacgtttcgtacgtaccgtaaacgtttacgtttacgttacggttacgtacgtaccgtaaacggttacgtaacgtaacgttacggttccggttacccccgtttacgttaacccgtttttaccgggaccggtaacggggtaaccacggtaccgttaacggtaaaccttaaaccgaaacgtaacggttagtacgggtacgtacggacctaccggtaacttccgttcgttaccgtaccgtacgttcccgttacccgtaccgacttactacgtacttaacg

SEQ ID NO: 192800 - DNA, 780 bp, Homo sapiens
  misc_feature: GYAE6OF02F6HRC.44.23.C01.1.454.CMB.1.raw
tcagacagtatatacacgaccggtgctcgatttagtacacgtgattagggattgggggagtcagaccctgtcagggacagcactggacatgagggtccccgctcagctcctgggctcctgctgctctggctcccaggttcgagatgtgacatcgagatgaccaagtctccttccttctgtcttcttctgttgaggcagcgtcaccatcacttcgccgggcgagtcgacggttcgttttcggtgtaccgttgtttcgccgtttcggtttacaaaaccggaaaaaggggggtacgtaacgggtacccccgttaaagggttccccgttcggttccgtccgttaccggtaacggaaaaccccgtaggaacccggttaggggaaacgggttacggtaccggttaccccggttaccgtacgggtttaccagggttcgacccgtacggttaccccgaggggttcggggtccggggcccggtaacgtcccgtaccgttccggttaccacctaagttacggccggtacccgttcggccggtccttacggtaacggtactttcgtcgtacgtaaccttttacgtttcgttcggtatacgtacttaggtactcgtaacgtttacgttcccggtccccgtttacgttaccgttttccgggaccgaacgggtacccaaggtacccgtaggaaacttaccgaaacgtacgttcgtacgcgttacgacctacgtaatttcctacgttcccttacgtcttacccggttacccgtacgtacttacttacgtattaac

SEQ ID NO: 192801 - DNA, 891 bp, Homo sapiens
  misc_feature: GYAE6OF02HN09L.44.23.C01.1.454.CMB.1.raw
  modified_base (553)..(553): a, c, t, g, unknown or other
  misc_feature (553)..(553): n is a, c, g, or t
  modified_base (786)..(786): a, c, t, g, unknown or other
  misc_feature (786)..(786): n is a, c, g, or t
tcagacagtatatacacgaccggtgctcgatttagtacacgtgattagggagttgggggagtcagaccctgtcaggggacagcatggacatgagggtccccgctcagctccgtgggctcctgctgctctggctccaggttcagatgtgacatcgagatcgaccctagtctccttccttcctgttacttcttctggtggagcagtccgtacaccatctacgttcggccgggatacgtcgtaggtttcggttttcggctcgttgtacgtccgttaggttaaccgaaacgggtaaaaagggggtcgaccgggtacccgttaacggtccgttaccgttccgtaccgtacggtaaacgtaaacccgtggtaaacggtacgggtaaaacggtacggtaccggtaccccgttacggtacgggttttaccgacggttccgaaccggttaaccgttacccggggtagggggttcgggggttaccggggtaccggtaacccggttaccttaaccggttcccgttaccggtacgttaacggttaaccggaccggtttaacccgngggtacccggtaccggttacgaaacgtttccgttaccggtacgttaacccgtttaaacgtttttcgtttaccggtacgtttacgacggaacgttaggtttaaccacgggtttacgtaccggttccggttacccgtttagttaccggttttacgggaccgggtaacggtaaccgtaacggttccgttaaacggtaaaccttaacggtaaaccggttacgtacggttaccgggtntttacccggacccgttaacgttcccggttattaccgggttttaccctacggttacctttaccccggttcccgttacgttacgttcccgttaacgttacttaaccg

SEQ ID NO: 192802 - DNA, 594 bp, Homo sapiens
  misc_feature: GYAE6OF02F09C2.44.23.C01.1.454.CMB.1.raw
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
  modified_base (449)..(449): a, c, t, g, unknown or other
  misc_feature (449)..(449): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggaggcagcgtcaccatcacttgccgggcgagtcaggttcgttttcggngcttgttcgccgttggtttacaaacggaaaaagggggngacggacccctaaggtccctacgtctctcgtagaaaccagacgtagggaagtacgcgtcccgtcaggttcagtcgccagtccagggtggtggccgagtccactcncacattacgcgtactgccggctagagtnttctagctaacttctttcgtcgtcagtcgtatactntaagtcgtccgtcccgttcgtacgttttcggccgtaagggaccaggtcgtaagtaactaacgaaacgtacgtggtcgtcgtcgaccacgtactccgttcgttcctttactaccgttccttcccgcctacttccgtacgtattaac

SEQ ID NO: 192803 - DNA, 738 bp, Homo sapiens
  misc_feature: GYAE6OF02F9JCG.44.23.C01.1.454.CMB.1.raw
  modified_base (240)..(240): a, c, t, g, unknown or other
  misc_feature (240)..(240): n is a, c, g, or t
tcagacagtatatacacgaccggtgctcgatttagtacacgtgattagggattgggggagtcagaccctgtcaggggacagcatggacatgagggtccccgctcagctcctggggctcctgctactctggctccgaggtgccagatgtgacatccagatgacccagtcctccttcctcctgtctgcttctataggagacagagtcgccatcacttggccgggcaagtcagaccattaacngtcttaatttaaatggtatcagcagacgacagggaacgccctagactcctgactctctgctcgcctccactctgacgaggtgtagttcttcttacgtaacggttccaggttcggacgtaggttggtacgtcgttacggggactagttacgtttaccacttcgtaccacccgtatttccctacgtacttactacggtacccttaaacgtcgtaaaagtttccgtttaacgaccctttaaaccctttacttaccgttacgtaacccaaacgtttaccggttaaagttttaccttacccggttaacccggttttacccccgttttaaacgtttcccgggttttttaacccgggggggtaaccggggtaacccttaacggggtccgggttaacgggtaacggttaaccgttaaacccggaaaaccggttaacggtttcgggtaacccggttacgttccggtaaaccctttaccggtaactttcccggtttagttttaacccc

SEQ ID NO: 192804 - DNA, 542 bp, Homo sapiens
  misc_feature: GYAE6OF02HTLGD.44.23.C01.1.454.CMB.1.raw
  modified_base (224)..(224): a, c, t, g, unknown or other
  misc_feature (224)..(224): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (456)..(456): a, c, t, g, unknown or other
  misc_feature (456)..(456): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (505)..(507): a, c, t, g, unknown or other
  misc_feature (505)..(507): n is a, c, g, or t
  modified_base (509)..(518): a, c, t, g, unknown or other
  misc_feature (509)..(518): n is a, c, g, or t
  modified_base (520)..(522): a, c, t, g, unknown or other
  misc_feature (520)..(522): n is a, c, g, or t
  modified_base (524)..(542): a, c, t, g, unknown or other
  misc_feature (524)..(542): n is a, c, g, or t
tcagacagtatatacacgaccggtgctcgatttagtacacgtgattagggattggggaagtcagccataatggaagcaccagctataaacccgtccctcaaagagtcgactcaccatctccgtcgacacgtaccaaagacgacagatggtccctgagtcctgacgtctgtcgaccgccgcggacgcggtctgtgttatttctgtgcgagacggcccttggaccngcgagtcggtacctactactactactctctggaccttgtcggggcaggggaccgcggtcacccggttctccgtcacgccacctaccgaaacggccaacgtccggtaccctttcccccgtggcctaccccttccctaccaagtaccgacncccgtacgtcggggctacagccgtccgngggcctacgccggtcggtacaaacggtctaacgttccacttaccgtactcgtacncgtacggcgggtcgtcgggacgaacggccgganaacgtagcgnagnacnnnannnnnnnnnnannncnnnnnnnnnnnnnnnnnnn

SEQ ID NO: 192805 - DNA, 724 bp, Homo sapiens
  misc_feature: GYAE6OF02HX8RU.44.23.C01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (236)..(237): a, c, t, g, unknown or other
  misc_feature (236)..(237): n is a, c, g, or t
  modified_base (273)..(273): a, c, t, g, unknown or other
  misc_feature (273)..(273): n is a, c, g, or t
tcagacagtatatacacgaccggtgctcgatttagtacacgtgattagggattggggagtcagaccctgtcaggggacagcatggacatgagggtccccgctcagctcctgggctcctgctgctctggctcccaggttcgagatgtgactagtcgagatcgacccagtcctccttcttcctgtcttcttctgttggagcagctcacntcatcgccgngagtctaggttcgtttcgnngttgttgccgttaggtttacaaacggaaaacggggngacggtacccgaggtcctcgtctctcgtacgaaaccgacgtacgtaggtaacggtagacgttcccgtacgaggtttacaggttcgacctacggtacgtagggtcgggtcggggtaccggacgtacccgtaacctcgtacctaaacgtaacgtttaaacgccgtaccgttcgggacccggtccgtagggaacgttacgtactacggtaactaacgttttactttcgttagtacgacgtactaaggttactactaagttaccgttacccggtccccgtttagtaaccggttttaccggacggtaaacggggaacctaagggtaccgttaagaaaactaaccgtaaacggtaacctggtacgtcctacgaacgtcccttaacgtccgttacgttaccgtaccttaaccgtttcccggttaacccggtaccttaacgtcggttaccttataaacg

SEQ ID NO: 192806 - DNA, 615 bp, Homo sapiens
  misc_feature: GYAE6OF02GE83W.44.23.C01.1.454.CMB.1.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcgagatgtgacatcgagatgacccagtctccttccttctgtcttcttctgttggagcagcgtcacatccacgttggccgggcgagtcgaggttcgttttcggngcgttgttcgcctggtttacaaacgaaaaagggggnaggcccctaaggtcctcgtctctcgtagaaaccagactggaaggtagcgtcccgtcaggttcagttcgccgagtccgaggtggtcgggccggtagtccactctcactagttagcgacctgccggctgaagcttcgnctaacttagttctagtcacgctagtactgtactagtcgtcccttagtaccttttcgggacccgtaacggggacctaaagggccgtaacggtaaactaccgaaaaaccgttacgtagggtcggaccttgaccctaacgtcttacgtccgttaccttacgaactttccccgttaccgtaccctacttacgtacgtagttaacc

SEQ ID NO: 192807 - DNA, 609 bp, Homo sapiens
  misc_feature: GYAE6OF02FGCOM.44.23.C01.1.454.CMB.1.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (489)..(489): a, c, t, g, unknown or other
  misc_feature (489)..(489): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatccacttgccgggtcagtcaggtcgttttcggngtctgttcgccttggttccaaacgaaaagggggngacggccccttaaggtcctacgtctcgtcgtagaaaccagaccgtaggaaggtagaacgtcccgtctaggttcagtcgccaggtccagggtggtgggccgagtccactcacacctagttcgaccgtaccgtgccggtcctaggaactactttcgtgacttaacttacttttccgtgtacctacgtacacgtatacattacgtccgtccccgttntaccgttttcggaccgtaaggggacctaaggtcgtaagggtaactacgaaactacgtgtcgctagtccaccgtatctacgttccttctacttccgttcccgacctactcgtagtattaac

SEQ ID NO: 192808 - DNA, 750 bp, Homo sapiens
  misc_feature: GYAE6OF02G3LVP.44.23.C01.1.454.CMB.1.raw
  modified_base (169)..(169): a, c, t, g, unknown or other
  misc_feature (169)..(169): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggcctcccgaggttcgagatgtgacatcgagatcgacccngtccttccttcctctgttcttcttctgttggaggcaggctcacatcacttcggccggngacgtcgtaggttcgttcggngcttgtcgccgttggtttacaaacggaaaaggggnaccggacccctaggtcctcgtctcgcgtacgaaccnggacgtaggaagtacgacgttcccgagtagttcagtcgctacggtccgagggtggtcgggaccggtacgtcctacgtctacacgtaagttcggacgtaccgtggaccggtctaagggtaacgttattaccgtcggtaacctttaatttttaccgttaccgttaggtacctaaggttctaacggttactacgtaacgttaccggttcccggttccccgttttaacgttaccggttttaccgggcccgggttaaacggggaaccccttacgggtaacggttaaacggtaaaaccgttaaccggtaaaacccggtttaaccgtcggggtaaccgtttccgtaccggtaccctaaaccggtcgtttacggttaccgttaccttaacgtcccgttaccccgtacccgtaccttaggtcccttagtaaccgtttacg

SEQ ID NO: 192809 - DNA, 857 bp, Homo sapiens
  misc_feature: GYAE6OF02GJES5.44.23.C01.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagacagtatatacacgaccggtgctcgatttagtacacgtgattagggattgggggagtcagaccctgtaaggggacagcatggacatgagggtccccgctcagctcctggggctcctgctgctctggctcccaggttcgagatgtgacatcgagatgacccagtctccttccttcctgtcttctctgttggagcagcgtcaccatcacttgccggcgagtcaggttccgttttcggngctgttgcccttggtttacaacgaaaaagggggnacggccccgtaaaggtcctcgtctctcgtagaaaccagactgggaaggtagacggtcccgtccgaggttccagtcgaccgtagtccgagggttcgggtcgggcccggtagtcccactcctccaccgtatttacggccgtaacccgttcgggacccgggtacccttagggaaaacgtacgtttccgtacggtacccgttaaaacgtttttacgtttttaccgttacggtttaccgtacggtacccgttaaaggtttaacctttaccgaaagtttaaccgggttacccggttaccccccggttttacccgttaaacccggtttttttccggggaaccccggttaaccggggggtaaccctaaaacggggttcccgtttaacggggaaaaaccttacccgggtaaaaaacccggtaaccggtttacgggttaaccgggtaccgttaccgggacccttaaaccccggttaacgtttcccgttacgggtttaccctttaccccgttaaccgttttacccccggtttaccccccggtacctttaaacccgttcccgttaacggtttaacccttaacgttttaaacccgg

SEQ ID NO: 192810 - DNA, 704 bp, Homo sapiens
  misc_feature: GYAE6OF02GRA7I.44.23.C01.1.454.CMB.1.raw
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
  modified_base (466)..(466): a, c, t, g, unknown or other
  misc_feature (466)..(466): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccgagtctccttccttcctgtcttcttctgttggagcagcgtcaccatctacgttcgccgggcgacgtcgaggttcggtttttcgggngcttggttgccttgggtttacaaacggaaaaagggggngacggacccctaagggtccctacgtctcgtcgtacgaaaccagacgtggaaggtaggacgttccccgtacgtacggttcaggtcgaccagtccgaagggttggtccgggggaccggtagtcccacgttcctacgacctagttacggcctaccgtcgccggtactcgaaagtcctttcncgtaaccgttaaactttcttttacgtacggtactacgacttaggtaacctcgtaagttacggttcccgttccccgttacgtttaccgttttacgggaccggtaacggggtaacccaacggtcgtaacggtaaactaccgaaaacggtactagggtcggaactccgacctaccgtagttaccctgttaccttaccgttacttaccccgttcccgtactacgttacgtacgtatttaacc

SEQ ID NO: 192811 - DNA, 671 bp, Homo sapiens
  misc_feature: GYAE6OF02FGHS3.44.23.C01.1.454.CMB.1.raw
tcagacagtatatacacgaccggtgctcgatttagtacacgtgattagggattggggggagtcagaccctgtcaggggacagcatggacatgagggtcccccgctcagctccgtggggctcctgctgctctggcctcccaggttcgagatgtgacatcgagatcgacccagttcttccctttcccttccttgttctttcttcttgttggaggcagcgtcaccatcctacttgccgggcgagtccgtaggttcggtttttcggtgtcgttgttcggtccgttggtttaccaaaacggaaaaaggggggacggaaccggacccccgttaaacggttccccttacggttccttccgttaccggtacgaaaccgagtacgtagggaaaggtagaccgtccccgtcgtaggttcagtcgccgtacggtccgtagggtcgggtcggggcggtacgtcccactcctaccaacctagttacggccgtacctggccggcctagaatattcgtcgactacttacttcttgtcgatacagtatactacgtacgtccgtcccgttcgttcgtttcggtaccgtacgggacgaacgacgtagtaactaacgaaacgaacgtagtcgcgtcgactaccgtactctcgttcttctactcctccacctacggggggtctacgtatac

SEQ ID NO: 192812 - DNA, 833 bp, Homo sapiens
  misc_feature: GYAE6OF02FRGAO.44.23.C01.1.454.CMB.1.raw
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggctccgaggtgccaggatgtgacatccagatgacccagtctccttccnccctgtctgcttctataggagacaggagtccgcctaatccacgttgcccggggtanaaagtcaagaccctaagttaacacgtacttaattttaaacttggtaactcgtagactaggtaacgaacccgaaggggtaaaaccgcccccgttagaaccgtttaccctggtaacttccgttacgtcgtccgtcggtaccccttacccaacgttccgtacggtaccggtaaaaacggggtttggggtacgtttaccgttaaccgttttaccgttaaacgggggttttacctaacggggttccggggtacgttaacggggtacgggtttaacgttacgggttacgggggtaaaccgttaacgggtttaaactttttccggtacctttacccggttaccctaacccgttaaacgttcccgttacccgttaaggtaccgttacggtaacccggttaaacccgttaggtaaacgtttaacgttttacggaaccctttaacttaaaccgttacttacggttacctaaacggtaagttaacgtttactacccgtaccgtttcccgtactttacggttttcggggtaccgggtacacggtacgtagggtaactaactacggtaaacgtacgttcggtaggacctacggacctaccgtagttcttaccgg

SEQ ID NO: 192813 - DNA, 657 bp, Homo sapiens
  misc_feature: GYAE6OF02IRW74.44.23.C01.1.454.CMB.1.raw
  modified_base (181)..(181): a, c, t, g, unknown or other
  misc_feature (181)..(181): n is a, c, g, or t
  modified_base (382)..(382): a, c, t, g, unknown or other
  misc_feature (382)..(382): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtcctccttccttctnttcttcttctgttggagcagcgtcaccatcacgttcgccgggcgagtcgtaggttcgttttcggtgtcttgttcgccgttggtttacaaaaggaaaagggggcgacggtacccctaaggtcctcgtctctcgacgaaaccagacgtggaaggtacgaccgtcccgtacgaggttcagtcgcctacgtccgtagggtcgggngggcccggtacgtcctactcctacctacctaagttacgccgaaccgttcggccggaccttagaacgtatttccgtaggtacctttaaactttacttttcgcggttacagtactagttactcaagttcgtccgttcccgtttatacggtttcgaccggtacgggaacctaggtctaacgggaaactaaccgaaacgtattcgggtcgcttacgactaccgtacttcgttcgttccttacgtacctttccgtcccctactacttcttacgtattacg

SEQ ID NO: 192814 - DNA, 836 bp, Homo sapiens
  misc_feature: GYAE6OF02IP80U.44.23.C01.1.454.CMB.1.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcgaggttcggttttcggtgcttgttcgccgttggtttacaaaacggaaaaagggggngacggtacccctaaggtcctgtctctcgtacgaaaccngactggaaggtagacgttacccgtacgtaggttcgagtcgaccgtaggtccgtagggtcgggtcgggggacccggtacgtacccgaccgttcctaccgaacccgttaagtttaaccggacccgggtaaccccgttcggggacccggggtacccgttaagggtaaaacgggttactttttcccgtacggtaaaccctttaaaaccgttttttaacgtttttccgtacggttaaccgaacgggttacccttaaggttaaccttaccgtaaaggtttaccggtttcccggttaccccccgtttttacgtttaaccgggtttttaccgggaccccgggttaaacggggggtaaaccctaacggggtaccgtttaaacgggaaaaccgtttaacccgaaaaacgggttaacgttcgggtacggtacccgttagaaccctaccgtaacttccgttacgtttcccgttactacccgtttccccgttacccgtaccttaacgttcgttacgtaatttaaccg

SEQ ID NO: 192815 - DNA, 505 bp, Homo sapiens
  misc_feature: GYAE6OF02I4BBE.44.23.C01.1.454.CMB.1.raw
  modified_base (285)..(285): a, c, t, g, unknown or other
  misc_feature (285)..(285): n is a, c, g, or t
  modified_base (484)..(484): a, c, t, g, unknown or other
  misc_feature (484)..(484): n is a, c, g, or t
  modified_base (486)..(505): a, c, t, g, unknown or other
  misc_feature (486)..(505): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtcgtggggccgagggggaccgcggtcaccgtcttcctcncgcctcccaccaacgggcccacgtccggttcccttccccctcggccaccccctccctccaacgacgccacctcggtcgggggccacgacggccgggcccgtcgggcctcggcccgttggtacgaacggtaccttaccgtttcctataacttacgttgtactcggacggcggggcgtcgggacgaacgggcgacaatagncnnnnnnnnnnnnnnnnnnnn

SEQ ID NO: 192816 - DNA, 789 bp, Homo sapiens
  misc_feature: GYAE6OF02FVJL3.44.23.C01.1.454.CMB.1.raw
  modified_base (254)..(254): a, c, t, g, unknown or other
  misc_feature (254)..(254): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatcgacccagtctccttccgttcctgttcttcttctggttggaggcagcgtcaccatcctacgttgccgggtctagtcgaggtttccggttttcggngtccgttggttacgcccgtttggtttaaccgaaaacggtaaaaaaggggggctaacgggtacccccttaaaggtccccgtcgttacctccgttaccggtaacgaaaaccctggtaaccgtagggtaaggttacgaccggttccccgtacgtaggttccaggtcgaccgtcgtaccgagggtgggtcgggaccgtagttacccactccgtaccgacctaattcggacccgtacccgtacggcccggtaccgttagtaaacgtctttacgtacgtaaccttaaacgttttactttccggttacgtaccgtacggtaccttaacggtacttaccgtaagttaccggtcccgttaccccggtttcgttaaccggttttccgggacccgttaaggggaacctacggtcggtaaacgtaaacgtacccgtaaaacggtcgtggttaccgtaccgtccgaacctaccgtacgtccgtttacgttccttaccgtaccgtttccccgttcccgtaaccgttctacccggtttagtactttaccg

SEQ ID NO: 192817 - DNA, 678 bp, Homo sapiens
  misc_feature: GYAE6OF02G2HBZ.44.23.C01.1.454.CMB.1.raw
  modified_base (630)..(630): a, c, t, g, unknown or other
  misc_feature (630)..(630): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (667)..(667): a, c, t, g, unknown or other
  misc_feature (667)..(667): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacagtcgagatcgaccagtccttcccttccttcctgttcttcttcgtgtggagcagcgtcacctatcgtacttggccgggcgtagtccgtaggtttcgttttcggtgtcgttgttcgtccgttcggttttaccgaaaacggaaaaagggggacgaaccggtaccccgttaacggttcccttccgtacgttccgtccggtaacgaaaccgacggacgttagggaaggtacgaccggtcccgtacgtaggttacgaggtccgccgtacggtccggtagggttcggtcggggaccggtacgtcccgactccacgtactacgttacgccgtaccgtcggtccgccgtagtaacgtcgttcgtacggtactttaaccgttttatttccgtagtctaacgctaagttactacgttagtcgtccgttcccgttgttcgtttcggacgacggtaccgagtcgtaagactacgaagtacgtagcgcgtcnctactntcgtntcttgtcctacgttccacgttacgtntacgtacttac

SEQ ID NO: 192818 - DNA, 907 bp, Homo sapiens
  misc_feature: GYAE6OF02I3JID.44.23.C01.1.454.CMB.1.raw
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtccttccttccttctgtcttcttctgttggagcagccgtcaccatctacttggccgggcgagtcgaggttcggttttcggtgccgttggttcgtccgttggttttacaaacggaaaaagggggagaccgggtacccccgtaaaggttccccgtcggtccttcgtacggtacgaaaacccagacgtagggaaagggttagaccggttcccggtacctaggtttcgagtccgccgtaacgtccgagggttcgggtccggggtaccggtacgtcccgtactcccgtaccgtaaccgtaacgtttaccggacccggtaacccgtcgggtccccgggtacccgttaacgggtaaacgtcgttttacccgtacggtacccgtttaaaaccgttttttacgttttaccttcgggttaaccgtaacggtaccggtaaacggttttaccgttaccggttaaacgtttacccgggttaccccggttaccccccgtttttaacgtttacccggttttttaccgggggaccccgggttaaacgggggtaacccctaacggtaacccgggttaaacggtttaaaacccgttaaccggtaaaaaacccggtacggtttaacgggtacgggttacccgtaccggtttacccaaaccgttaccgttttaaccggttacggtttaaccctttaccgttaaccgtttcccccgtttaaccccgtaaccgtacccgtttacgttacgtaactttaaaccc

SEQ ID NO: 192819 - DNA, 864 bp, Homo sapiens
  misc_feature: GYAE6OF02GEHI6.44.23.C01.1.454.CMB.1.raw
  modified_base (243)..(243): a, c, t, g, unknown or other
  misc_feature (243)..(243): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgtggaggcagcgtcacatcacttggccgggcagtcgagggttcgttttcgggngtcgttgttcgtccgtttaggtttaccgaaaacggaaaaacggggggcgtaaccgggtaccccccgttaaaggttccccgttaccggttccttccgtacggtacgaaaacccgtaacggtaccgtaggggaaacggttacggtaccggtaccccgtaccgtaaggtttccgaacggttcggacccgtacggtcccgaggggttcggggtccggggacccggtacgtacccgaacgttcccgtaccaaccgttaacgttcggaccgtaaccgtcggaccggtaccgtaggtaacgtacttacgtacggtaccttaaccttttagttccttacggtacaggtacctaaggtaccttacgtaactttacggttaccccgttccccggtttacgtttacccggtttttacgggaccccgggttaaacggggtacccgttaacggtaccggttaaacgggtaaaaccttaacccgtaaaacggtaaaccggtttcggggtacgtcccggtaacgaacccgtaacccgttcggttaccgtttacccggttaccctttaccgaacccgtttttcccccggtaacccgttaccccttacgtttaaccgttacggttaaactttaaaccg

SEQ ID NO: 192820 - DNA, 726 bp, Homo sapiens
  misc_feature: GYAE6OF02H4HO2.44.23.C01.1.454.CMB.1.raw
  modified_base (561)..(561): a, c, t, g, unknown or other
  misc_feature (561)..(561): n is a, c, g, or t
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
tcagacagtatatacacgaccggtgctcgatttagtacacgtgattagggattggggagtcagaccctgtcaggggacagcatggacatgagggtccccgctcagctcctggggctcctgctgctctggcctcccaggttcgagatgtgacatcgagatcgaccctagtccttccttccttcctgttcttcttcgtgttggagcagcgtacaccatctacgttcggccgggacgtaggtcgtagggtttcggttttcgggtcgtcgttggttcgtaccgtttggtttaaccgaaaacgggaaaaaaggggggtacggaaccgggtacccccgttaacgggtccccttacggttcctccgttacggtaacgaaaccgaacggtacgttaagggaaacgggttacgtaccggttccccgtaccgtaggtttccgacggtcgaccgtaggtaccggtaggggtcgggtacggggccggtacgtccgtacctcctaccaaccgtacgttacggccgtaccgtcggccggtacgtagaacgttctttacgtacgactttaactttntttcgtagtacagtacgtagttctactagttccgtccgttcccgttacgttcgttcgggaccgtagggtaacctaggtactaaggaactaacgaaacgngtcggngtctacgactcgtactccgttcgtactccttctcccgttaccgctctacgtgtacttacg

SEQ ID NO: 192821 - DNA, 700 bp, Homo sapiens
  misc_feature: GYAE6OF02I99D9.44.23.C01.1.454.CMB.1.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
tcagacagtatatacacgaccggtgctcgatttagtacacgtgattagggtagttgggggagtcagaccctgtcacgggacagcatggacactgaggtccccgctcagctcctgggctcctgctgctctggctccagttcgagatgtgacatcgagatgacccagtctccttctctgtcttctctgtgagcagcgtcacatcacttgccgggcagtcaggtcgtttacgngcttgttcgccttggtttacaaacgaaaaaggggctaggaccccctaaggtccctcgtctctcgtacgaacngactggaagtagacgtcccgcacggttcagtcgacctgtccagggtgtcgggaccgnttccgactctacaccgtagttacgaccgtcctggaccggcctaggaaagtctttaccgcgtacctaacttttagtttccgtagttcgaacgactaacggttataccgaagttttacgtccgttaccccccgttcgttaacggttttaccgggacccggtaaggggtaaacccttaaccggacggtttaacgggaaaacctttacgaaaacccggttaacggttacggtacgggtaccttacgggacctaacccgtacggtttacctacggtttaacccgtttaccgtaacgttcccgtttaccccggacccttttaacggtctttaacgaagttttaaccc

SEQ ID NO: 192822 - DNA, 604 bp, Homo sapiens
  misc_feature: GYAE6OF02F8NPE.44.23.C01.1.454.CMB.1.raw
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
  modified_base (334)..(334): a, c, t, g, unknown or other
  misc_feature (334)..(334): n is a, c, g, or t
  modified_base (395)..(395): a, c, t, g, unknown or other
  misc_feature (395)..(395): n is a, c, g, or t
  modified_base (471)..(471): a, c, t, g, unknown or other
  misc_feature (471)..(471): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (583)..(583): a, c, t, g, unknown or other
  misc_feature (583)..(583): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggcctccctaggttcgagatgtgacatcgagatcgacccagtcctcctccttcctgtcttctctgttggagcagtccgcaccatctacgttcggccggcagtcnggttcgttttcggtctgttcgccgttaggttaccaaacggaaaaggggtnacggcccctaaggtcctcggtctcgtcgtagaacctagacgtaggaggtanaccggtccctccgtaagggtctaggtctccgaagttcccggagggtgggtcgggccggtanaccctactccgatacctaagtcgaccgacgtcgcggaccttgaatcgttctagactaacttctttcgaattccganactagtatctaagtcgtcgtcccgttntacggtttcggcgttacggactacgtntaacggacaacgtaactngtaccgngtcacctcgtacttctgtaccttacgcctttcnccctacctatcgtattaactg

SEQ ID NO: 192823 - DNA, 735 bp, Homo sapiens
  misc_feature: GYAE6OF02JDFMT.44.23.C01.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (673)..(673): a, c, t, g, unknown or other
  misc_feature (673)..(673): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttctgttggagcagcgtcaccatcacttgccgggcgagtcgtaggttcgttttcggngtcgtgttcgccttggtttacaaacgaaaaagggggnacggtcccctaaggtcctcgtctctacgtagaaaccngacgtaggaaggtacgacgtcccgtccgtaggttacaggtcgacccgtaggtaccgagggttcgggtcggggacccggtaggtccctaaccttccgtacctaaccgttaagttaacggccggtaaccctgggtacccggccgttaggaaacgtctttacctacggtaacctaaacgttttactttcgttacgtaacgtaacgtaccttaaggtaactacgttaacgttacgttacccgttacccccgtttactttaccggttttacggacccgggaacggggaaccctaaacggtcgttaacggtaaactaccgtaaaaaccgtacgtcgggtaccgtccgtacgacctaaccgtntacccgttgttccctacgtaccttcccgttacccgtacctcgttaccttacggtatttaacg

SEQ ID NO: 192824 - DNA, 745 bp, Homo sapiens
  misc_feature: GYAE6OF02G3IPZ.44.23.C01.1.454.CMB.1.raw
  modified_base (286)..(286): a, c, t, g, unknown or other
  misc_feature (286)..(286): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtctaggttcgttttcggtgtcttgttcgccttaggtttaccaaaacggtaaaaagggggnaccggtaccccgtaaggtcctcggtctcgtacgtaacgaaaccagtacgtagggaaacggtacgacggtcccgtacgtaggttcaacggtcgacctaggtccgagggtgggtcgggaccgtatcccgacgtctaacaccctaagttacgaccgtacttaggaccggtaccgttagaaacgtcgtttacgtacgtaccttaaacgttttacgtttacgtaggtaccgtaagtactaacggttaactacgttaagttaccggtcccgttaccccgtttacgttaacccggttttacgggacccggttaaacggggtaacctaaacggtccgttaaacggtaaaccttaccgaaaaaccgtagttacggtacgtaccgtacgtacccgtaacttcgttaccgtacgttacccttacttacgttaccccttaccccgggataaccgttacctacgtattaacg

SEQ ID NO: 192825 - DNA, 774 bp, Homo sapiens
  misc_feature: GYAE6OF02HF49J.44.23.C01.1.454.CMB.1.raw
  modified_base (115)..(115): a, c, t, g, unknown or other
  misc_feature (115)..(115): n is a, c, g, or t
  modified_base (274)..(274): a, c, t, g, unknown or other
  misc_feature (274)..(274): n is a, c, g, or t
tcagacagtatatacacgaccggtgctcgatttagtacacgtgattagggattggggatgctttctgagagtcaaggacctcctgtgcaagaacatgaagcacctgtgttttccnctgctggtgcagctccagagtcggtcctgtcccgaggtcgcagtctgcgagggacggtccgggcccgaaggcgtgggtcgacggtccgttaccgggaaccttgtctccgtctaactcgtgacctcttggtcctcgtggttacttccattcgtagttcgngtactctagttcggttggcgtacggtacgtccggtaccgaccggtaccccggaggggtacgggtaacggtaggggtacggtaggttacgtcgggtacggtaacctacttaccggttaacgttacgtaaccgggtcgggtaaccgtaacgttaccgtaaccgttcccgtccgtacccgttaacgaaacggttcgtaccgttctacccgtaacgttacggttacggacggtacctacgtaccctaagtccgtacctcgtttcccgaacctagtaaccgtaccgtccgtaccggtacgtacccgggtaccgacggttaccgtacccgtttacgtttacgttcggtacgtcgggcgacgtaccggattcgttacggttacttacgtacgttcggtacgaccgggtcgtcggtacccgttaggtccggttaacctcgttcggttccctccgtacgttaccgtcccgtttaccgaacccggtacgttacccgtaggttccccccgg

SEQ ID NO: 192826 - DNA, 679 bp, Homo sapiens
  misc_feature: GYAE6OF02HXF1G.44.23.C01.1.454.CMB.1.raw
  modified_base (342)..(342): a, c, t, g, unknown or other
  misc_feature (342)..(342): n is a, c, g, or t
tcagacagtatatacacgaccggtgctcgatttagtacacgtgattagggattggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcactctagctactcgtctcgtggtactttccatctagttctgatctattcgttgggctggtacgtccggcacgaccccggaggggacgggaagtggagtggtagtttggagactactctagttagtacggngggacgtacgtaccttacgtcctccgtcctacaagtctcgttctacgtaccgtactttacgacgggtactacctcgtactaccggtaccgttccttaccctaccgtaacgtaacgtcccgtaccttacccggacgtaccccggccggaccgaacccgttaccgggttcttttacttccgtacggtcggcggtacggcgacgtccggtttcgtttaccttaccgtaagttcgtacgggtccggggtacgtcgacccgttaccgttcggtaactcgttccttccgtccgtactccgtacccgtaccgtacccgaacgggtccctaccgttacccccggg

SEQ ID NO: 192827 - DNA, 733 bp, Homo sapiens
  misc_feature: GYAE6OF02JEBVX.44.23.C01.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (528)..(528): a, c, t, g, unknown or other
  misc_feature (528)..(528): n is a, c, g, or t
  modified_base (723)..(723): a, c, t, g, unknown or other
  misc_feature (723)..(723): n is a, c, g, or t
tcagacagtatatacacgaccggtgctcgatttagtacacgtgattagggtagttgggggagtcagaccctgtcagggacagcatggacatgagggtcccgctcagctccgtgggctcctgctgctctggctcccaggttcgagatgtgacatcgagactgacccagtcctccttcctctgtcttctcgtgttcggaggcagcgtcaccngtctagtcgccgggacagtcgaggttcgtttcggagccttgtcgccgttggttacaaacggaaagggcgacgtccccgtaagtcctcgtntcgtacgtaagaaccgagtacgtgggtaaacgtcggaccgtcccggtaactagggtttccaacgggttcgaccgtacgtaccggtaggtcgggtcggaccggtacggttaccctaccgtaccgtaccaaccgttacgttacgtcggtaacccgtgggcccgtaccgttaagaacgtccttaccgtagtaacccttaagtttaactttcgtaacgtcgaactcgtaacngttaaccgaagtccgttacccgggttccctttaacgtttacgtaccggaccgggtaacgggaccttaaacgggtcgttaaacgggaaacctaacggtaaaaccgaacggttggtaccgtaacggtgtaaaccctcggttaactccggttcgtacccgtttacacctttccggttcccgaccttaagcccctttanaaccgtttac

SEQ ID NO: 192828 - DNA, 888 bp, Homo sapiens
  misc_feature: GYAE6OF02HL3X7.44.23.C01.1.454.CMB.1.raw
  modified_base (160)..(160): a, c, t, g, unknown or other
  misc_feature (160)..(160): n is a, c, g, or t
  modified_base (242)..(242): a, c, t, g, unknown or other
  misc_feature (242)..(242): n is a, c, g, or t
  modified_base (771)..(771): a, c, t, g, unknown or other
  misc_feature (771)..(771): n is a, c, g, or t
tcagacagtatatacacgaccggtgctcgatttagtacacgtgattagggagttgggggagtcagaccctgtcaggggacagcatggacatggacgggtccccgctcagctccgtggggtcctcctgctgctctggctccgaggttcgagtatgtagacngtcgagatacgaccctagtcctccttccttcctgtctttcttcgttggtaggacgcagcgtacactatcacgtcggccgggngagtcgagggtttcgttggtcgtagtcgttcgtccgttaggtttaccgaaaaacgggtaaaaagggggctaaccgggtaccccgtaacggttcccgtacgttacgttccgtacggtaacgaaaaccgtacggtaaccgttaagggtaaacggttaacggaacccggtttccccgtaacggtaaccgggtttactaacggttacgaccgttaaggttacccgggtaagggggttcgggttaccgggggaccggttaaccgttaccccgaacgttaccgtaaccctaaaccgtacggtttaccggaccgtaaccgtcgggtacccgggtaactaagggtaaacgtcgtttaccgtcgtaaaccgttttaaactttccgtttacgtcggtaaacgttaaccgaacgtaacgttaactaacgtaacggtttcgttacccggttcccttagttaacggttaccggggaccgggtaaaccggtaacggtaacgttaccggaaaacgttaaaccgtaaaccggaaaaacccggttntagggggttacctaacggaccgttaacgtaccggtaacttaacccgttcggttaaacctttccgaacccgtttccccgtcccgtaaataccggtttaaccgttagttaacgttaacg

SEQ ID NO: 192829 - DNA, 755 bp, Homo sapiens
  misc_feature: GYAE6OF02IZXIW.44.23.C01.1.454.CMB.1.raw
  modified_base (189)..(189): a, c, t, g, unknown or other
  misc_feature (189)..(189): n is a, c, g, or t
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgaccaagtctccttccttcctgtcttcttntgttggagcagcgtcaccatcacttgccgggcgagtcgaggttcgttttcggngtctgttcgcgttggttacaaacgaaaagggggngacggtaccccgtaaggtccctcgtctcgtcgtagaaaccaggtacgtagggaacggtaggaccggtcccgtaccgtacggtttcgagtcggacctagtccgtagggtcgggtcgggccgagtcccacgtcctacacctagttacggaccgtccgtcgccggacctaggaacgtactttccgacgtaccttaaactttacttttcgtacgtacgtacgtacgtaagtacgttactaagttaccggttcccgttaccccgttttaccgttaccggtttttaccgggaacccggtaacggggtaaccctaacgggtaccgttaacggtaaaccttaacccggttaaaacggtaccgttacgggtacgttaccgtacggtaaccctaaccggttcgtttacccgttcgggtttacccttaaccgttacccgtttacccgttccccggtaacccttaggtttcccttaggttaactttaaccg

SEQ ID NO: 192830 - DNA, 638 bp, Homo sapiens
  misc_feature: GYAE6OF02JFOXQ.44.23.C01.1.454.CMB.1.raw
  modified_base (482)..(482): a, c, t, g, unknown or other
  misc_feature (482)..(482): n is a, c, g, or t
tcagacagtatatacacgaccggtgctcgatttagtacacgtgattagggattgggggagtcagaccctgtcaggggacagcatggacatgagggtccccgctcagctcctgggctcctgctgctctggctcccaggttcgagatgtgacatcgagatgacccagtcctccttccttcctgtcttcttctgttggagcagcgtacacatcacgttcgccgggcgagtcgtacggttcgttttcggtgcgtgttcgccgttaggttacgaaaacggaaaaggggacgtacggcccctaaggtccttcgtcgtcgtacgtacgaaaccgtagacgtaggaggtagaccgtcccgtactaggtcagcgcacgtcgaggtggcggcgagtccactcctacacctagttacgccgtacgtcgaccggaccttaggaacgttcttccgtacgtactaacttttgttactgtcgtacgtactacgttanacgtacgtttacgccgttaccccgttcttacgttaccggtacgtaacggggacctagaccgttagaacgtaacgtaaacgtacgagttcgacgtacgtacgaccgtactcgttactccgttactacgttccctcccgccttagtcctagtaatacg

SEQ ID NO: 192831 - DNA, 687 bp, Homo sapiens
  misc_feature: GYAE6OF02G0K4T.44.23.C01.1.454.CMB.1.raw
  modified_base (409)..(409): a, c, t, g, unknown or other
  misc_feature (409)..(409): n is a, c, g, or t
  modified_base (614)..(614): a, c, t, g, unknown or other
  misc_feature (614)..(614): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggctcccaggttcgagatgtgacatcgagatcgacccagtctccttccttcctatcttcttctgttggagcagccgtacaccatccacttcggccgggcgagtccgtaggttcgttttcggtgtctgttcgccgttggttacaaaacgtaaaagggggcacggtcccgtaaggtcctcgtctcgtcgtacgaaaccgagtacgtaggtaaggtagaccggtcccgtacgtaggttcaggtcgccgacgtccggagggtcgggtacgggccggacttaccnccgttctacctaacgtagtacgccgtaccgcgaccggtctagaagtcgtttcgacgtacctttaaacttttcgttcttacgcgtaactctagttacacgttaacgtaccgttccccgttccctttacttccgggtttacggaaccggtaacgggaactaacggccgtaaagggaacctaacggaaacctacggtagtgtaccgtnaccgtactatcctttccggtcctttaccgtactttccccgtaccgttacctacggttccttaggtacttaacg

SEQ ID NO: 192832 - DNA, 771 bp, Homo sapiens
  misc_feature: GYAE6OF02JYXCH.44.23.C01.1.454.CMB.1.raw
  modified_base (146)..(146): a, c, t, g, unknown or other
  misc_feature (146)..(146): n is a, c, g, or t
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
tcagacagtatatacacgaccggtgctcgatttagtacacgtgattagggagttgggggagtcagaccctgtcaggggacagcatggacatgagggtccccgctcagctccgtgggctctgctgctctggcctccgaggttcgagntgtacganatcgagatcgacccngtctccttcctctgtcttntcgtgtaggngtcagcgtacacntcacgttggccgggctagtacgtggttcgttttcgggcngtttggtccgtaccgttagggtttaaccaaaaagggaaaacggggggcgtacccggaccccgtttaagggttccccttacggtccgttacggttcggaacgaaaacccggnggtaacggtgggaaacggttcgtacccgttacccggtacgtacgggttaccacggttcgaaccgtacggttcggaggggttcgggcggtaccggtaccgttcctaccgtactaccgtaactagttaaccggcgtacccgttcgggacgttacgtaacggtaacgttccgtacgtcgtaacctttacgttacgttcgtacgtacgtacgtactaacgtactagtacgttaccgtccgggttacccttacgttaccggttacggaacccggtacggtaacgtacggttaccgtaaacggtaaacctacgttaaacgcggttacggtcgtacctacgttaaccgtaccgtacgtttaccgtacttccgttacgttacctaccggtaccctacgttcgttactacgttacctac

SEQ ID NO: 192833 - DNA, 839 bp, Homo sapiens
  misc_feature: GYAE6OF02IAFA4.44.23.C01.1.454.CMB.1.raw
  modified_base (251)..(251): a, c, t, g, unknown or other
  misc_feature (251)..(251): n is a, c, g, or t
tcagacagtatatacacgaccggtgctcgatttagtacacgtgattagggattggggagtcagaccctgtcaggggacagcatggacatgagggtccccgctcagctccgtggggcctcctgctcgctctggcttccaggttcgagatcggtgactatcggagtactggacccagtccttcccttcctttccgtgtcctttcttcgttgtgggacggtcagtccgtccaccgtatcctcgtcggcccgggngagtcgtaggttcggttttcggctgttcgtcgtaccgttcggttaacaaaacgggtaaaaggggggctaccggtaccccgttaacggtcccgttacgttctaccgtaccgtaaccgaaacccggtaagtaccggttacggggtaaaacgtacggacccgttccccgtaacgtcgggtttaccaggtcccgtaaccgtacgggtccggttaaggggttccggggtacggggtacccggtacttacccgtaccgttccgtaccctaaacggttaccgttaccggacctaacccgttccggccgggtttcccgtaagggaaaccttcgtttacggtacgttaccgtttaaacttttgtttaccgtgtaccgaacgtccgttaattacccgtagttaactttcccggttcctttacccccgttaagttaccggttttccgggaaccgggtaccggggtaaacctacggtaccgttaacgtaaaacccgtaccttaaaacggaccttaacggttccggaccgtacggtacctaccggtaattccgttgttacccgtactccgttacccgtcctacctcgtctacgttataacg

SEQ ID NO: 192834 - DNA, 713 bp, Homo sapiens
  misc_feature: GYAE6OF02JD4Q4.44.23.C01.1.454.CMB.1.raw
  modified_base (185)..(185): a, c, t, g, unknown or other
  misc_feature (185)..(185): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (647)..(647): a, c, t, g, unknown or other
  misc_feature (647)..(647): n is a, c, g, or t
  modified_base (704)..(704): a, c, t, g, unknown or other
  misc_feature (704)..(704): n is a, c, g, or t
tcagacagtatatacacgaccggtgctcgatttagtacacgtgattagggagttgggggagtcagaccctgtcaggggacagcatggacatgagggtccccgctcagctccgtgggctcctgctgctctggctcccaggttcgagatgtgacatcgagatcgaccagtctccttcctctgtcttnttctgtggacgcagcgtcacctatcacgttcggccggcgagtcaggttcgttttcggngcgttgttcgtccgttggttacgaaacggaaaagggggnacggtacccctaaggtcctcgtcctcgtcgtacgaaccgagtacgtaggaaggtacgtaccgtacccgtacgtacggttctaggtcgaccgtacgtccggagggttcgggcgggaccggtaccgttccgtacgttccctaccgtacctaacggttacgaccgaccgttcgcccgggtacctacgggaaacttctttcggtacgtactaaaccttttgtttacccgtagttacgacgtacgtattacgtacttaacggttaccggtccgtaaccccgtttgttaacggtttccgggaccggttacggggtaaccaagggttacgtaaacggtaactaaccggtaacgtaccgttgggtcgttaccncggaacttccggtattaccgtgttcctacgtcttaccccggtcacttacgcgtttanactttaacg

SEQ ID NO: 192835 - DNA, 694 bp, Homo sapiens
  misc_feature: GYAE6OF02FXS2K.44.23.C01.1.454.CMB.1.raw
  modified_base (102)..(102): a, c, t, g, unknown or other
  misc_feature (102)..(102): n is a, c, g, or t
  modified_base (648)..(648): a, c, t, g, unknown or other
  misc_feature (648)..(648): n is a, c, g, or t
tcagacagtatatacacgaccggtgctcgatttagtacacgtgattagggattgggggagtcagaccctgtcaggggacagcatggacatgagggtccccgntcagctcctggggctcctgctgctctggtcctaccctaggttcgagatgtgacatcgagatcgacctagtctccttccttctgtcttcttcgtgtgagcagcgtcacatccaacgttcgccgggtagagtcgtaggttcgttttcgacgtcttggttcgtccgttaggttacgaaaacggtaaaagggggtacgacggtccccgttaaggttccctacgttaccgttcgtccgtaacgaaccgtagtacgtagggtaaggtacgtacggttccccgtacggtaaggttctaaggtccgaccgtcgtaccggtagggtcggtcgggccggtacgtcctctacgtcctaacgtagtacgccgtaacgtcggaccgtcgtaggaacttcgtcgtacgtactaactttctttacgtcgtacgacgtcgtagtcgttacaagtttaccggtaccgttccgttaccgttcgtttacgggccgacgggtaacacgttacgtagtaaaccgtacgtaaacgtacgtaggtcgaacgttcgaaccgtctacgttntccttacgtcttaccgtcctacctcccgtataccgttatagtaacc

SEQ ID NO: 192836 - DNA, 636 bp, Homo sapiens
  misc_feature: GYAE6OF02HNQJ9.44.23.C01.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
tcagacagtatatacacgaccggtgctcgatttagtacacgtgattagggagttggggagtcagaccctgtcaggggacagcatggacatgagggtccccgctcagctcctgggctcctgctgctctggctccaggttcgagatgtgacatcgagatgaccagtctccttccttcctgtcttcttctgttggagcagcgtcacatcactgcgggcgagtctaggttcgtttcggngtctgttcgccgttggtttacaaacggaaaaggggngacggacccctaaggtcctcgtactcgtcgtacgaaaccagacgtaggaacggtacgtacgtcccgtacgacggttccaagtcggacctaggtaccggagggtcgggtacggggccggtacgtccgacgtcctacgaaccgtagtttacggacggtacccgttcggaccggtaccgtaggaaacgtcttacgtacgtacttaacttttcgttctcgtacagtacgtatactactaacgttcgccgttcccgtacttacgtttcggaccgtagggacctagcgtacggaactccgaaacgtactgtacgcgacgctacctgtctgtacctactacgttccttcccattaccgtgttacagtttaac

SEQ ID NO: 192837 - DNA, 557 bp, Homo sapiens
  misc_feature: GYAE6OF02GQGW0.44.23.C01.1.454.CMB.1.raw
  modified_base (511)..(511): a, c, t, g, unknown or other
  misc_feature (511)..(511): n is a, c, g, or t
  modified_base (517)..(518): a, c, t, g, unknown or other
  misc_feature (517)..(518): n is a, c, g, or t
  modified_base (521)..(521): a, c, t, g, unknown or other
  misc_feature (521)..(521): n is a, c, g, or t
  modified_base (524)..(526): a, c, t, g, unknown or other
  misc_feature (524)..(526): n is a, c, g, or t
  modified_base (528)..(557): a, c, t, g, unknown or other
  misc_feature (528)..(557): n is a, c, g, or t
tcagacagtatatacacgaccggtgctcgatttagtacacgtgattagggattggggaagtcagccataatggaagcaccagctataacccgtccctcaagagtcgactcaccatctccgtcgacacgtccaagagacagatgtccctgagtctgacgtctgtgaccgccgcggacgcggctgtgtatttctgtgcgagcggccctggtaccagcgagtggtacctctactactactctctggacgtcgtcgggggaccgtagggggaccgtcggtccaccgtcctcctcgacgccctcccgaccgacgggcccctacgtcccggttccccttcccccgtcggcccgtcccctcccgtaccgaacgacgcctacccgttcggtacgggggccaacggcggccggtcccgtgggcccgtcgccgtcggtaccgaacggtaccttacttacccgacgttctacgtcgtcgtaggcgggtcggacgtcgggacgtaacgggcgacgtagtagancgtagnngcngtnnngnnnnnnnnnnnnnnnnnnnnnnnnnnnnnn

SEQ ID NO: 192838 - DNA, 800 bp, Homo sapiens
  misc_feature: GYAE6OF02G5X9W.44.23.C01.1.454.CMB.1.raw
  modified_base (794)..(794): a, c, t, g, unknown or other
  misc_feature (794)..(794): n is a, c, g, or t
tcagacagtatatacacgaccggtgctcgatttagtacacgtgattagggattgggggagtcagaccctgtcgaggggacagcatggacatgagggtccccgctcagctccgtggggctcctgctgctcgtcggctcccgaggttcgagatgtgacagtcgagatcgactacgtcctccttccttcctcgttctttcttcgtggttggacgcacgtccgtaccacctactctacgttcggccgggcgtacgtcgttacgggttcgttttcggtgtcgttcgttcgccgtttacgttaacggaaaacgggaaaaggggcgtacccggtcccgttaacggttcccttacgtccttcgtaccggtaacgaaaacccgtggtaacggttaggggtaaacggttacgacccgttacccgtccggttaaggttaccgtacggtacccggaccgtacggtaccggtagggggtcgggtccgggggaacccgtcgtacccttcgtcctaacccgtaccgttcgttaaccggcccggttaccgtccgggaccggttacccgtaagtaaccgttcgtttccgacggttaaccctttacgtttttaactttcggacgttaccgtacgttcggtaaacttcgtacgtaacggtttcccggttcccgttacccgtttagttacggtttaccggggaccggtaaaccgggtaaccttaacggtaccgttaaaggaacctaaccgtaacggtattcggacgttctacgactacgtcttcgtactcgtcctacgtccgtcccatctacgntgtaac

SEQ ID NO: 192839 - DNA, 810 bp, Homo sapiens
  misc_feature: GYAE6OF02F8Q0R.44.23.C01.1.454.CMB.1.raw
  modified_base (397)..(397): a, c, t, g, unknown or other
  misc_feature (397)..(397): n is a, c, g, or t
  modified_base (770)..(770): a, c, t, g, unknown or other
  misc_feature (770)..(770): n is a, c, g, or t
  modified_base (797)..(797): a, c, t, g, unknown or other
  misc_feature (797)..(797): n is a, c, g, or t
  modified_base (802)..(802): a, c, t, g, unknown or other
  misc_feature (802)..(802): n is a, c, g, or t
tcagacagtatatacacgaccggtgctcgatttagtacacgtgattagggattgggggagtcagaccctgtcaggggacagcatggacatgaggtccccgctcagctcctggggctcctgctgctctggcctcccaggttcgagtacgtgtgactagtcgagatacgaccgagtccttccttccttcctgttctttcttcgttggttaggagcagccgtacaccgataccgtacgttcggccgggtacgacgtcgtacggtttccgttttcgggtagtcgttggttcggtccgtttacgggtttaccgaaaaacgggtaaaaaggggggtcgaccgggtaacccccgttaagggtcccctacggttacctacgttaccgggtaaaccgaaaacccgnggtaaccggttaggggaaaggttaaccggtaccggttacccccggtaacggttaacgggttacccgagggttaccggacccgtaacgggttcccggtaacgggggttggggtacccgggggtaccccggtaagtttaccccgaacggtttccctaccggaaccttaacggtttaccgggaccgtaaccgtccggggtaccgggtacccttaaaggacggtttacttccgtaagtaaccctttaacgtttaccgtttacgtcgtaacgtcgtaacgtacgtattacgtacgtacgttccgtcccttacgttcgttacggacggacggtaccagtacgtaggaactacgaacgtacgtgtacgactcgctacgtntacttcgtctctaccgtctcccgtctntactntacgtacg

SEQ ID NO: 192840 - DNA, 773 bp, Homo sapiens
  misc_feature: GYAE6OF02H0WIZ.44.23.C01.1.454.CMB.1.raw
tcagacagtatatacacgaccggtgctcgatttagtacacgtgattagggattggggagtcagaccctgtcaggggacagcatggacatgagggtccccgctcagctcctggggctcctgctgctctggcctcccgaggttcgagatgtgacatcgagatcgacccagtccttcccttccttccttgttcctttcttcgtggttggaggcgagccgtaccaacctactcctacgttcggcccgggcgtacgttcgtacgggtttccggttttcggtcggtccgttgttcgtccgtttaggtttaacgaaaacgggaaaaaagggggacggtaacccggtacccccgtaacgggttccccgttccgttccgttccgttaccggtaacgaaacccgtaggtaaccggttaggggaacgggttacggtacccggttccccggtaccggtacgggtttaccgacgttccgacccgtacggtaccgtaaggggttcgggtcggggtacccggtacgttaccctactccgtacctaaccgtagttacgccgtaccgtcggaccggtacctagaacgtacttccgtacgtaccttaacgtttcgtttccgtgtacgacgtacgtagtactacttacgtcgttcccgtccctttacgtaccgttacggaccgtaacgggtaccaagtcgtaacgtaacgtacgaaacgtcgtacgtcgtactgaccacgtattccgttagtccttacaccgtttccgcccgtacctacgttctagtattac

SEQ ID NO: 192841 - DNA, 835 bp, Homo sapiens
  misc_feature: GYAE6OF02F5VEK.44.23.C01.1.454.CMB.1.raw
  modified_base (258)..(258): a, c, t, g, unknown or other
  misc_feature (258)..(258): n is a, c, g, or t
tcagacagtatatacacgaccggtgctcgatttagtacacgtgattagggattgggggagtcagaccctgtcaggggacagcatggacatgagggtccccgctcagctccgtggggctcctgctgctctggcctcccaggttcgagagtgtgacatcgagatcgacccagtctccttccttcctgtcttcttctgttggaggcagcgtcaccatctacgttcgccgggcgacgttacgtacggttcggtttttcgggngtccgttagttcgccgtttaggtttaccaaaaaaccgggtaaaaaagggggggtctaaccgggtacccccgttaaagggttccccgtacgttaccttccgtacggtaacgaaaacccgtacggtaacggtagggaaacgggtacgtaccggtacccccggtacgtaagggttccgaaggttcgacccgtaggttccgaagggttgggttaccggggccggtaagtaccctacgtacctacgaacccttaagttacgaccgtacccgttagggcccgtacgtaagaacggtactttaccgtacgtaaaccgtttaacttttaacgttttccgaggttacaggtacctaacggttataacgtaacgttacggttacccgttacccccgttagttaccggtttttaccgggaccggttaaccggggtaaccgtaacggtccgttaaagggtaaaccttaccggaaaacggttaagtcgggtacgtaccgttacgtaccaacccgtgtttacccgttactttaccctttacggttacccctttaccccggtaacctaccgttagtctaaatttacgtaacg

SEQ ID NO: 192842 - DNA, 764 bp, Homo sapiens
  misc_feature: GYAE6OF02JYK1I.44.23.C01.1.454.CMB.1.raw
  modified_base (284)..(284): a, c, t, g, unknown or other
  misc_feature (284)..(284): n is a, c, g, or t
  modified_base (334)..(334): a, c, t, g, unknown or other
  misc_feature (334)..(334): n is a, c, g, or t
tcagacagtatatacacgaccggtgctcgatttagtacacgtgattagggagttgggggagtcagaccctgtcaggggacagcatggacatgagggtccccgctcacgctcctgggctcctgctgctctggcctcccaggttcgagatgtcgacatcgagatcgacccagtcctcccttccgttcctgtcctttcttcttgttggagcagcgtcaccatcattcgccggcagtctaggttcgttttgcgcttgttcgccgtttggttacaaacgaaaagggggnaccggtcccccttaaggtcccttacggtctacgtacggtaccgaaaaccnggtacgtggaaacgtacgtccggttacccggtaccaggttacctaggcgacccgtagtccgagggttcgggaccggggtcccgtaacggtccctaaccgttcgaccgtaacctagtttaaccggcccgtaacctgggtccccggacctttaaggaaacgttccgtttacgtaccgaacctttaagttttaccgtttagtcttaaccgacgtaacgttacggtactacgttagttaccgttccgtaaccctttccgtttaagttcccgggtaccgtaccgggtacctaacgtacgttaacgtaacgttaaccaaacgggtacttgggtaaccctggtaaccaccgtaacccttagttcccggttattaaccctttccggtaaccttccccgttaccccggtacctacggttaccgtacgttaacttaaccc

SEQ ID NO: 192843 - DNA, 813 bp, Homo sapiens
  misc_feature: GYAE6OF02G030Z.44.23.C01.1.454.CMB.1.raw
  modified_base (736)..(736): a, c, t, g, unknown or other
  misc_feature (736)..(736): n is a, c, g, or t
  modified_base (805)..(805): a, c, t, g, unknown or other
  misc_feature (805)..(805): n is a, c, g, or t
tcagacagtatatacacgaccggtgctcgatttagtacacgtgattagggtagttgggggagtcagaccctgtcagggacagcatggacatgaggtccccgctcagctcctggggctcctgctgctctggctcccaggttcgagatgtgacatcgagatgaccaagtctccttccttcctgtcttcttctagttggagcgagcgtcaccatcacttgccgggcacgtctaggttccgttttcggtacgtcgttgttcgtccgttaggtttaccaaacggtaaaaagggggacgtaccgggtacccccgtaaggttcccgttaccggtaccttccgtaccggtaacgtaaacccgaggtaaccgttacgggtaaggtacggtaccggtccccggttaccgtaacgggtttaccacggttaccgcccgtaacggttaccgtaacgggtcgggttcggggacccggtacgttacccgtaccgttccgtacccacccgtaagtttacggccgtaaccgttcggcccggtaccgtagtaaacggtacgttaccgtacggtaccttaaaccgttttatttaccgtcggttaccgtagtacctaagtaccttacgttaacgttacgtaccggttacccccgttagttacccggtttcgggacccggtacggggaaccctaggtacctaagggtaaacccttacgaaacggttacgtaggtacggcctagtaccaacccggttnttaacccggttctttaaccgtttacgaccccgtttaccgttcccccgacttacgttacgttaaccggtntttaaacc

SEQ ID NO: 192844 - DNA, 819 bp, Homo sapiens
  misc_feature: GYAE6OF02HXV23.44.23.C01.1.454.CMB.1.raw
  modified_base (285)..(285): a, c, t, g, unknown or other
  misc_feature (285)..(285): n is a, c, g, or t
tcagacagtatatacacgaccggtgctcgatttagtacacgtgattagggagttgggggagtcagaccctgtcaggggacagcatggacatgacgggtccccgctcagctccgtgggctcctgctgctctggctccgaggttcgagatgtcgaacatcgagatcgacccagttccttcccttcttccgtgttctttccttgttggttaggacggtcacggtccgtaccaacctagtccgtacgttcggcccgggcgtacgttcgtacgggtttccgtttttcggngtcgttcggttcgtcccgttagggttttaaccgaaaaacgggtaaaaaacggggggtacggtacccggtacccccgttaaaagggttccccgttacgttccgttccgttaaccggtaacgaaaaccgtacggtacgttaacggggtaaggttaaccggtacccggtaccccgttacggtacggtttaccaggttcgaccccgttaacggccgggttaaggggtcgggtaccggggacccggtccgttaccgtaccgtctaccgtaacgtacggtacgcctaccgtgaccgtctaaggacgtactttcgacgtattaaccttttagtccgtagtaccgtaggacttaggtactcgtaacgttccgttacccgttccctttagtacgtttaacccgggacgggtaaaccgggtaccttaacgggacttaaaacggtaacctaaccgtaaacggtaacgttcggtaacgccgactaaccgtacgttactgtaccgttctaccgtacttccggtccctaatcgtactagtacttaacg

SEQ ID NO: 192845 - DNA, 525 bp, Homo sapiens
  misc_feature: GYAE6OF02HRUA9.44.23.C01.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (391)..(391): a, c, t, g, unknown or other
  misc_feature (391)..(391): n is a, c, g, or t
  modified_base (487)..(487): a, c, t, g, unknown or other
  misc_feature (487)..(487): n is a, c, g, or t
tcagacagtatatacacgaccggtgctcgatttagtacacgtgattagggattgggggagtcagaccctgtcaggggacagcatggacatgagggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccngactggaaggtagagtcccgtcaggttcagtgccagtccaggtggtggccggagtccactctcaccattagcacctgcggcctgaagntctgcaacttattctgtcagcagtatcatagtcgcccgttctacttttcggctaggggaccaagctaggtaatacaaacgactgtcgctgcaccgntcctgtcttctacttccttcccgcctactctagtatac

SEQ ID NO: 192846 - DNA, 707 bp, Homo sapiens
  misc_feature: GYAE6OF02H39VB.44.23.C01.1.454.CMB.1.raw
  modified_base (150)..(150): a, c, t, g, unknown or other
  misc_feature (150)..(150): n is a, c, g, or t
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (451)..(451): a, c, t, g, unknown or other
  misc_feature (451)..(451): n is a, c, g, or t
  modified_base (530)..(530): a, c, t, g, unknown or other
  misc_feature (530)..(530): n is a, c, g, or t
tcagacagtatatacacgaccggtgctcgatttagtacacgtgattagggattgggggagtcagaccctgtcaggggacagcatggacatggacgggtccccgctcagctccgtggggcctcctgcctgctctggcctccgaggttcagntgcgaacngtcggantacgaccctgtccttccgttccttcgtgttcttcttcgtggtcggaggctagctccaacctgtactcgtgggaccggcgtacgttcgtgggttttccggttggtcgtcgttcggttacgtcgttacggttaacgaaacgggtaaaaggggctacggtaccgtacgtccgtctcgtccgtacggacaaacgtagaacgtggtaaggtaccgtaccggttccccgaggttacgtccgagtccgtacgtacgtcggtaggggtcgggtacggccggtcgaccacgtccnctaacgcgtcgcgaccgttcggccgacgttacgaagtcgtcgtacgacgtttaaacgtttcttcgtacgtctacggtanaacgttcagttacttacccggtccgttacccttacggttccgtacgggtccgaacgggtacctaggtccgtaaaggtaaccacgaaaccgtgtacgacgtcgcgtaactccgtacttctccggttaccttacgccctttaacccgtcccgagttaccttacgttacgtacgtttaac

SEQ ID NO: 192847 - DNA, 568 bp, Homo sapiens
  misc_feature: GYAE6OF02JBI5K.44.23.C01.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (546)..(568): a, c, t, g, unknown or other
  misc_feature (546)..(568): n is a, c, g, or t
tcagacagtatatacacgaccggtgctcgatttagtacacgtgattagggattggggaagtcagccataatggaagcaccagctataaccccgtccctcaagagtcgactcaccatctccgtcgacacgtccaagagacagatcgtccctgagtctgacgtctgtcgacccgccgacggacgccggctggtgtattttcnggtcgcgagacggccctggtaccngcgtagtcggtacctcgttacctactactctcgtacggaccgtcgtcgggggccgacgggggccgcggtccaccggttcctcctcacgccctcccaccgaacgggcccctacgttccggttccccgttcccccgtcggccctaccccctcccgtaaccgacgacnccctaccgtcgggtcgggaccacgcggccggccggtcggtcncgtccgtggacctagtaccttacctactactactcgttacgngtacgcgggtcgtcggtacgacggacgtcgactaggtacacgtcngactgtncactgactncntacgnctggnnnnnnnnnnnnnnnnnnnnnnn

SEQ ID NO: 192848 - DNA, 140 bp, Homo sapiens
  misc_feature: GYAE6OF02G9DZT.44.23.C01.1.454.CMB.1.raw
  modified_base (129)..(140): a, c, t, g, unknown or other
  misc_feature (129)..(140): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctnnnnnnnnnnnn

SEQ ID NO: 192849 - DNA, 613 bp, Homo sapiens
  misc_feature: GYAE6OF02G065V.44.23.C01.1.454.CMB.1.raw
  modified_base (242)..(242): a, c, t, g, unknown or other
  misc_feature (242)..(242): n is a, c, g, or t
  modified_base (568)..(568): a, c, t, g, unknown or other
  misc_feature (568)..(568): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttggccgggcgagtcaggttcgttttcggngctgttgcccttggtttacaaacggaaaaagggggacgacggccccgtaaggtcctcgtctcgtcgtagaaaccagacgtggaaggtacgacgtcccgtctaggttcagtcgccgacgtccgagggtggtcggggccggacgtccactcctacaccgtagtacgccgacctcggccggtcctagaacgtcttacgtcgacctaactttactttcgtgtcacgtactagtatctaagtcgtaccgtcccgttacgtacgttttcggccgtacgggaccaagtcgtaaggtaactacgaaacgtacgtgtcgtcgtacgaccaccgtntccgttctccttctacgttccgttcccgcctactcttagtattac

SEQ ID NO: 192850 - DNA, 613 bp, Homo sapiens
  misc_feature: GYAE6OF02IYXV7.44.23.C01.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (479)..(479): a, c, t, g, unknown or other
  misc_feature (479)..(479): n is a, c, g, or t
  modified_base (510)..(510): a, c, t, g, unknown or other
  misc_feature (510)..(510): n is a, c, g, or t
  modified_base (560)..(560): a, c, t, g, unknown or other
  misc_feature (560)..(560): n is a, c, g, or t
  modified_base (575)..(575): a, c, t, g, unknown or other
  misc_feature (575)..(575): n is a, c, g, or t
tcagacagtatatacacgaccggtgctcgatttagtacacgtgattagggagttgggggagtcagaccctgtcaggggacagcatggacatgaggtccccgctcagctcctggggctcctgctgctctggctcccgaggttcgagatgtgacagtcgagatcgacccagtcctccttccttcctgtcttnttcgtggttggngcagccgtcaccatcacgttcgccggnagtcgtaggttcgtttcgngctgtcgtctggttacaaagaaaggggnaccggtacccgtaaggtccgtcgtaccttcgtaccgtacgaaacctagtacgtagggtaagtacggacgtcccgtacgtaggtttccaggaccgctaacggtccgtagggtcggtacgggaccggtgtaccctacgtcaccgacgttatcggtaccgacgtccggaacgtccgtagacgtattccgtgtactattacgtttcngtcacgtatagtactgtatcggtactccgtnttacgtcggacgtacggaactgtacgttagaacacgtaagtatcggaacncgtcgaacttaccgntcgtacttgtaccgcttccgctctagttccatccttaa

SEQ ID NO: 192851 - DNA, 772 bp, Homo sapiens
  misc_feature: GYAE6OF02G3SO7.44.23.C01.1.454.CMB.1.raw
  modified_base (144)..(144): a, c, t, g, unknown or other
  misc_feature (144)..(144): n is a, c, g, or t
tcagacagtatatacacgaccggtgctcgatttagtacacgtgattagggattgggggagtcagaccctgtcaggggacagcatggacatgagggtccccgctcagctcctggggctcctgctgctctggctccaggttcgagntgtgacatcgagatcggaccagtctccttccttcctcgtcttcttcgtgttggaggtcagcgtcaccatcacgttgccgggcgacgtcgacggttcgttttcggcgtacgtgttcgccgttggttacgaaacggaaaaggggacacggaccctaaggtcctacgtctcgtaccgtacgaaacctaggaacgtagggtaaggtacgaccggttcccggtacgtacggttcacggttcgaccggtcgtaccggtaagggttgggtcggggcccggtaggtcccacgttctaccgaaccgtagttacggaccgtaccgtacggtaccgggccttagggaagttacttcgtaccgtactttaactttactttcgtagtacgtacgtacgtacgttactacgtagtttcgtaccgttacccgttccgttaccgttttccggacccggtaacggggtaccctaaacggtaccgttaaacgggtaacgttaacccgtaaagtaaccggttcgggtccgtaccggtaccgtaccggtaccttaacgttccgtttaacgttccgttaacccgttacccgtttaccccgttccccgttaaacccgttacgttacggtttaacgttaccttaaaccggg

SEQ ID NO: 192852 - DNA, 725 bp, Homo sapiens
  misc_feature: GYAE6OF02IW53Q.44.23.C01.1.454.CMB.1.raw
  modified_base (132)..(132): a, c, t, g, unknown or other
  misc_feature (132)..(132): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (508)..(508): a, c, t, g, unknown or other
  misc_feature (508)..(508): n is a, c, g, or t
tcagacagtatatacacgaccggtgctcgatttagtacacgtgattagggattgggggagtcagaccctgtcgaggggacagcagtggacatgacgggtccccgctcagctccgtgggcctcctgctgctcngcctcccaggttcgagatgtcgacatcgagatcgaaccctgttcctcctttccttccgtgtttcctttcttcgttcggttacggcgaccgacgtacaccatcgtacgttcggcgggcgtagtccgtaggttcgttttcgcgtcgttgttcncttaggtacaaggaaaaggggngtcgacccgttagcctcgtacgcgttcgtaacgaaacgtgtacggagtaaggcgtaccgtccgtacgtgtcgtagcgtacacggtcgtacggggtgggtacggcggtctacccgtactccgtaacaccgttgttacgaccgtaccgtaggttacccgagttccgtaaagttagtccgtacgtaaccgtttaagtttccgtttntaccgtacgacggtaccgtaagttcctacgttaggttacccgttaccggttacccctttaccggttaacgtttccggggacccgtgggaaacccgttagacccgtaagtaaacgttacccgaaagttcgtagtacgtcgtaacggcctaccgtatccgtacgttaccttacggttaccctccgtaaccgcttaaacctggtaactactacgttacgg

SEQ ID NO: 192853 - DNA, 791 bp, Homo sapiens
  misc_feature: GYAE6OF02HMWJG.44.23.C01.1.454.CMB.1.raw
  modified_base (780)..(780): a, c, t, g, unknown or other
  misc_feature (780)..(780): n is a, c, g, or t
tcagacagtatatacacgaccggtgctcgatttagtacacgtgattagggattgggggagtcagaccctgtcaggggacagcatggacatgagggtccccgctcagctccgtgggctcctgctgctctggctcccaggttcgagatgtgacatcgagatgaccaagtcctccttccttcctgttcttcttctgttggaggcagcgtacacctactcacgttcggccggcgtagtcgtacgggttcggttttggtcgcttggttcgtccgtttggtttaaccgaaaacggtaaaaacggggggacgtaaccgggtaaccccgttaacggtccccgttacgttaccgtacgtacggtaacgaaaacccgtacggtaacgtaacgggtaaacgggtaacggaccggttaccccgtacgtaacgggttactacggtcggtacctaggtccggtaggggttcgggtcggggaccggtacgtccgtacctcgtaccaacgtacgttacggacctaccgtcgggacccggtacctaagggaaacgtttcgttcgtacgtaaaccgtttaaccttttacgttttccgacgttacgaagtcgtaacgtatcgttaacgttacgttcccgtacccgtttatttaccggttcggaaccggtaacgggacctaaggtaccgtaacggaacttaaccgtaaaacggtcgtacgggttacgacgtccgtaacctacgtacgttcgttacgttaccgttactacccggtttccctaccgtaccttagtacccgtntaagtttaacc

SEQ ID NO: 192854 - DNA, 496 bp, Homo sapiens
  misc_feature: GYAE6OF01DZB1A.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccgaaggtgcagatcgaaacgaactgtaggctgctaaccg

SEQ ID NO: 192855 - DNA, 261 bp, Homo sapiens
  misc_feature: GYAE6OF01BWNV1.13.59.F04.1.454.CMB.1.raw
  modified_base (259)..(261): a, c, t, g, unknown or other
  misc_feature (259)..(261): n is a, c, g, or t
tcagtcacgtactacacgaccggtgctcgatttagtacacacacttagggattgggcggaaggtatagcagtggcacgtactactttgactactgggccagggaaccctggtcaccgtctcctcagcctccaccaagggcccatcggtcttcccctggcaccctcctccaagagcacctctggggcacagcggccctgggctgcctggtcaaggactacttcctagtacgtgactgagcgggctggcaaggcgcatagnnn

SEQ ID NO: 192856 - DNA, 490 bp, Homo sapiens
  misc_feature: GYAE6OF01EU30Q.13.59.F04.1.454.CMB.1.raw
  modified_base (225)..(225): a, c, t, g, unknown or other
  misc_feature (225)..(225): n is a, c, g, or t
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacactatttagcctggtatcagtcagaagccagggagagtccctaaattattgatctctgctgcgtcgcttgcaatcggggtccatctcggttcagtggcgtggatctaggacagaattcactctcacatcacaacctgcacctgaagatgttggaagttatactgtcagacctatacgtggtgcccgctcagttttccggacggtagggaccaaggtgactagatacgaaacgtactgtagctgctaaccg

SEQ ID NO: 192857 - DNA, 489 bp, Homo sapiens
  misc_feature: GYAE6OF01BUWJV.13.59.F04.1.454.CMB.1.raw
  modified_base (463)..(463): a, c, t, g, unknown or other
  misc_feature (463)..(463): n is a, c, g, or t
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtccatctcggttcagtggcggtggatctaggacagaattcactctcaccatcaccaaccctgcaccctgaagatgttggaagttattactgtcagacctatagtggtgccgctcattttcggcggagggaccaaggtgcngatcaaacgactgtaggctgctaccg

SEQ ID NO: 192858 - DNA, 505 bp, Homo sapiens
  misc_feature: GYAE6OF01AT8TG.13.59.F04.1.454.CMB.1.raw
  modified_base (389)..(389): a, c, t, g, unknown or other
  misc_feature (389)..(389): n is a, c, g, or t
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtcccatctcggttcagtggcgtggatctaggacagattcactctcacatcaccactgcaccctgaanatgtggaagttattactgtacagtacctatagtggtcgacccgtctctagtttccggacggagggtacccgaagggtcgcgagacgtacaaacgtaactaggtaggctgctacccg

SEQ ID NO: 192859 - DNA, 483 bp, Homo sapiens
  misc_feature: GYAE6OF01A9PO3.13.59.F04.1.454.CMB.1.raw
  modified_base (459)..(459): a, c, t, g, unknown or other
  misc_feature (459)..(459): n is a, c, g, or t
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatcaccaactgcaccctgaagatgttggaagttatactgtcagacctatagtgtgcccgctcatttcggcggagggaccaaggtgcngatcaaacgactgtagctgcaacc

SEQ ID NO: 192860 - DNA, 506 bp, Homo sapiens
  misc_feature: GYAE6OF01CPVWU.13.59.F04.1.454.CMB.1.raw
  modified_base (443)..(443): a, c, t, g, unknown or other
  misc_feature (443)..(443): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaaattattgatctctgctgcgtccgccttgcaatcgggggtcccatctcggttcagtggcggtggatcgtaggacagaattcgactctcaccatcaccaacctgccaccctgaagatgttaggaagttattactgtcagactatagtggtcggcccgntcgattttcggcggagggaccgaaggtgacagatacgaaacgtaacgtgtaggctgctacccg

SEQ ID NO: 192861 - DNA, 499 bp, Homo sapiens
  misc_feature: GYAE6OF01AXSWO.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggtagggaccgaagggtgcagactacaaacgtaactgtaggctgctaaccg

SEQ ID NO: 192862 - DNA, 493 bp, Homo sapiens
  misc_feature: GYAE6OF01CMD3Y.13.59.F04.1.454.CMB.1.raw
  modified_base (215)..(215): a, c, t, g, unknown or other
  misc_feature (215)..(215): n is a, c, g, or t
  modified_base (383)..(383): a, c, t, g, unknown or other
  misc_feature (383)..(383): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtnacttgccgggcagcacgacattaacactattagcctggtatcagcagaagccaggagagtcctaaattatgatctctgctgcgtccgcttgcaatcggggtccatctcgttcagtggcgtggatctaggacagaattcactctcacatcaccaactcgcaccctgaanatgtagaagttatactgtcagtacctatagtgtgccgtctctagtttcggacggagggaccgaaaggtggcacggaatacgaaacgtaaaccgtgtaggctggctaaccc

SEQ ID NO: 192863 - DNA, 490 bp, Homo sapiens
  misc_feature: GYAE6OF01BJQR8.13.59.F04.1.454.CMB.1.raw
  modified_base (440)..(440): a, c, t, g, unknown or other
  misc_feature (440)..(440): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgctccgccttgcaatcgggggtcccatctcggttcagtggcggtggatctaggacagaattcactctcaccatcaccaactcgcaccctgaagatgttggaagtttattactgtcagacctatagtggtggcccgctcntttcggcggagggaccaggtgcgagatacaaacgaactgaggctgcaccg

SEQ ID NO: 192864 - DNA, 587 bp, Homo sapiens
  misc_feature: GYAE6OF01D8YEY.13.59.F04.1.454.CMB.1.raw
  modified_base (229)..(229): a, c, t, g, unknown or other
  misc_feature (229)..(229): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacgttggccgggngagtcaacgacattaacactttatttagcctggtatcagcagaagccgagggagacgtacctaaattattgatctctgctgcgtccgccttgctaagtccggggtccagtcgtcggtcaggtggcggtgagtcgtaggacagtaattcgactctacactactccaacctaacctcgaccctaccctagaacgtagtttcggttaaggtaagttttaacttacgtcgttacctaacgtaaccctttagtacggttcgggtcggtcccgtcttcgtacgttttccgggacgggtaacgggtaccgtaagggtgacgtacggtactaaccgaaacgtaacgtggtacgcgtcgcctaaccg

SEQ ID NO: 192865 - DNA, 506 bp, Homo sapiens
  misc_feature: GYAE6OF01CLN4X.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatcgtaggacagaagttcactctcaccatcaccaacctgccaccctgaagatgttgaagttattactgtcagacctagtagtggtcggcccgctctagttttcggcggtagggaccgaaggtgacgagagtacaaacgtactagtggctgctaaccg

SEQ ID NO: 192866 - DNA, 503 bp, Homo sapiens
  misc_feature: GYAE6OF01EUZ3V.13.59.F04.1.454.CMB.1.raw
  modified_base (470)..(470): a, c, t, g, unknown or other
  misc_feature (470)..(470): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagagtcaccgtcacttgccgggcagtcacgacattaacacttattagcctggtatcagcagaagccagggagagtcccgtaaattattgatctctgctgcgtccgccttgctaacgtcggggtcccagtctcggttcgagtggcggtggatcgtaggacagaattcactctcacatcaccactgcacctgagatgttagtaattatactgtcagtacctagtagtggtcggaccctgtcctagtttcggcggaggaccgtagggtnacgagatacgaaacgtactgtaggctgctaccg

SEQ ID NO: 192867 - DNA, 492 bp, Homo sapiens
  misc_feature: GYAE6OF01DUIL1.13.59.F04.1.454.CMB.1.raw
  modified_base (226)..(226): a, c, t, g, unknown or other
  misc_feature (226)..(226): n is a, c, g, or t
  modified_base (486)..(486): a, c, t, g, unknown or other
  misc_feature (486)..(486): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctctgctgcgtccgcttgcaatcgggggtcccatctcggttcagtggcggtgatctaggacagaattcactctcaccatcaccaacctgcaccctgagatgttaggaagttattactgtcagacctatagtggtcggccgctcagttttcggcgggaggaccgaaggtgcagactacaaacgacgtagtgcngctacg

SEQ ID NO: 192868 - DNA, 582 bp, Homo sapiens
  misc_feature: GYAE6OF01B94YX.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccaggagagtacctaaattatgatctctgctgcgtccgcttgcaagtcggggtccatcgtcgtcagtggcggtgatctaggacagtatcactctcaccatcaccaactcgaccacctagaacgagttacgttaggtaacgttttaattacgttagtcgtaacgaacccgttaagttacgggttcgggttacggccccgttcgtacgttacgtttttaccggggacgggtaacggggaacccgtaaagggttacgacggtaaacgagttaacccgaaaacggtaacgttacggtagggtactcggacctaacccg

SEQ ID NO: 192869 - DNA, 574 bp, Homo sapiens
  misc_feature: GYAE6OF01A7ZVF.13.59.F04.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtnacgttgccgggcagtcacgacattaacacttattagctggtatcagcagaagccgagggagagtcctaaattatgatctctgctgcgtccgcgttgcgaacgtccggggtcccagtcgtcggttcgaggtggcggtggatcgtaggacagaacttcactctcaccactaccaacctaacctcgacccaccgtagaacgtataggttaggtaacgtttattacgttcgtacgtaacgtaccgttagtacggttcggttcggccccgttctaccgttacgtttccggggacgggtacgggaaccgtaagggtacgacgtaacggtactaaccgaaacgtacgtagtcggctcgcctaaccg

SEQ ID NO: 192870 - DNA, 411 bp, Homo sapiens
  misc_feature: GYAE6OF01B5LMG.13.59.F04.1.454.CMB.1.raw
  modified_base (405)..(411): a, c, t, g, unknown or other
  misc_feature (405)..(411): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactactcctagtacgtgactgagcgggctggcaagggcgcatagnnnnnnn

SEQ ID NO: 192871 - DNA, 409 bp, Homo sapiens
  misc_feature: GYAE6OF01BXWAW.13.59.F04.1.454.CMB.1.raw
  modified_base (406)..(409): a, c, t, g, unknown or other
  misc_feature (406)..(409): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcaatggtcatcgtctcttcagcctccaccaagggcccatcggtcttccccctggccgccctgctccaggagcacctccgagagcacagcggccctgggctgcctggtcaaggactacttcctagtacgtgactgagcgggctggcaaggcgcatagnnnn

SEQ ID NO: 192872 - DNA, 558 bp, Homo sapiens
  misc_feature: GYAE6OF01D73TC.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgcttgcaagtcggggtccatctcggttcagtggcggtggatcgtaggacagtaattcactctcaccatcaaccaacctcgaccaccctgaagtactggttaggtaagtttattaccgtagttaccaagtacctagtagttcgggtcggtcccgtcttacgtagttttccgggcggtaacgggtaccgtaaacgggtgacgaggaacgtacgaaaaaccggtaacgttaggtacgggactgccgtaacccg

SEQ ID NO: 192873 - DNA, 405 bp, Homo sapiens
  misc_feature: GYAE6OF01DFYS2.13.59.F04.1.454.CMB.1.raw
  modified_base (404)..(405): a, c, t, g, unknown or other
  misc_feature (404)..(405): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcaatggtcatcgtctcttcagcctccaccaaggcccatcggtcttccccctggcgccctgctccaggacgcacctccgagagcacagcggccctgggctgcctggtcaaggctacttcctagtacgtgactgagcgggctggcaaggcgcatagnn

SEQ ID NO: 192874 - DNA, 503 bp, Homo sapiens
  misc_feature: GYAE6OF01ATJD7.13.59.F04.1.454.CMB.1.raw
  modified_base (391)..(391): a, c, t, g, unknown or other
  misc_feature (391)..(391): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtcgccttgcaatcggggtccatctcggttcagtggcggtggatctaggacagaattcactctcacatcaccaacctgcaccctgaanatgtggaagttattactgtcagtacctagtagtggtaggcccgtctcgtagtttcgggacggtacgggaccgaggtgcgagatacgaaacgtaacgtgtaggctgctaaccg

SEQ ID NO: 192875 - DNA, 526 bp, Homo sapiens
  misc_feature: GYAE6OF01A762R.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttattagcctggtatcagcagaagccagggagagtcctaaattattgatctctgctgcgtccgtccttgcgtaacgtccgggggtacccagttcgtcggttcgagtcgggcggtggagtcgtaggacagtaattcactctcacatcgaccaactcgaccacctgaacgagtagttaggtaatttagtacttgtacagtactagtagtggtcgccgtctcgtacgtttcggacggaggtaccgaggtgacgagactacgaaacgtacgtgtagctgctaccg

SEQ ID NO: 192876 - DNA, 527 bp, Homo sapiens
  misc_feature: GYAE6OF01BHM2Z.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgctccgccttgcaagtcggggtcccatctcggttcaggtggcggtggatcgtaggacagattcactctcaccataccaccaacctcgccaccctgaacgatggttaggtaagttatttactgtcaagacccttagtagtgggtcgcccgtcttcgtagtttccggcgggtacgggtaccgaacgggtgacgagaactacgaaacgtaacgtgtaggtctgctaccg

SEQ ID NO: 192877 - DNA, 409 bp, Homo sapiens
  misc_feature: GYAE6OF01DWMJZ.13.59.F04.1.454.CMB.1.raw
  modified_base (406)..(409): a, c, t, g, unknown or other
  misc_feature (406)..(409): n is a, c, g, or t
tcagtcacgtactacacgaccggtgctcgatttagtacacacacttagggattggggaaatctatcatagtggtaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcatggtcatcgtctcttcagcctccaccaagggcccatcggtcttccccctggcgcccctgcctccaggagccacctccgagagcacagcggccctgggctgcctggtcaaggctacttcctagtacgtgactgagcggctggacaaggcgcatagnnnn

SEQ ID NO: 192878 - DNA, 535 bp, Homo sapiens
  misc_feature: GYAE6OF01D12GR.13.59.F04.1.454.CMB.1.raw
  modified_base (202)..(202): a, c, t, g, unknown or other
  misc_feature (202)..(202): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacttgccgggcgagtcaacgacattaacacttatttagccttggtatcagcagaagccagggagagtccctaaattattgatctctgctgcgtccgcttgcagtccggggtccatctcggttcagtggcggtggatcgtaggacagattcactctacaccactcaccaacctcgccaccctagaacgattcgttaggtaagtttattactgtcagtaccttagtagtggtcggacccgtcttcgtcgttttcgggcgggtacgggaccgtaagggtgacgtagactacgaaaacggtactaggtaggctggcctaaccg

SEQ ID NO: 192879 - DNA, 536 bp, Homo sapiens
  misc_feature: GYAE6OF01EINAW.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacacttatttagcctggtatcagcagaagccagggagagtaccctaaattattgatctctgctgcgtccgcctgcaagtcgggggtccagtctcggttcaggtggcggtggatcgtaggacagtaattcgactcgtcaccatcaaccaacctgaccaccctgaagtatgttaggtaagtttattactgtcagactagtagtggtcgcccgtctcgtacgttttcgggacgggtagggaccgtaaggtgacgtaagacgtaaccgaaacggtaacgtggtaggtcttgcctaacccg

SEQ ID NO: 192880 - DNA, 535 bp, Homo sapiens
  misc_feature: GYAE6OF01A5CNE.13.59.F04.1.454.CMB.1.raw
  modified_base (226)..(226): a, c, t, g, unknown or other
  misc_feature (226)..(226): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatcagcagaagccagggagagtaccctaaattattgatctctgctgcgtccgcttgcaagtccggggtcccatcgtcggtcaggtggcggtggattcgaggacagtactcactctcaccatcaccactgccacctgaagatggttaggtaagttacttactcgtactacgtactagttaggtcggtcggtcccgtactcgtagtttccggacgggtacgggtaccgaagggtgacgagacgtaacgaaaccggtacgtaggtggtcgtgtcctaaccg

SEQ ID NO: 192881 - DNA, 518 bp, Homo sapiens
  misc_feature: GYAE6OF01A1XK3.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaagtcgggggtcccatctcgtcagtggcggtggatcgtaggacagaagttcactctcaccatcaccaacctcgacaccctagaatatgttggtaagttacttactgtcagtacctagtagtggtacggcccgtctctagtttcggcggtacgggacctagggtgacgagacgtacaaaccgtactcgtaggcgtgcgtaaccg

SEQ ID NO: 192882 - DNA, 693 bp, Homo sapiens
  misc_feature: GYAE6OF01D9UGI.13.59.F04.1.454.CMB.1.raw
  modified_base (209)..(209): a, c, t, g, unknown or other
  misc_feature (209)..(209): n is a, c, g, or t
  modified_base (688)..(688): a, c, t, g, unknown or other
  misc_feature (688)..(688): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgaccctagtcctccactccctccctgtctgacatcgtgtagganacgagacgtacacctatctactcgccgaggcgagtcgagactaattaactaacttaatttaattaggtatcgaagtacaaacggtaaaccgtaacggtaaaccgtaccccgtaagtaccttccgtaagtactaccgtaacgtatacgtactaactaccgtaagtttaacggaaaccgtacgggttaccaagtaacgtaacggttagtacggtaagggtaaggttacggtacgtacgggtacggtaaacgttaacggttttactttttaaccgttacccaaaccttcgtaaccgtacgtacctaaccggtcgtacgtaccgtaacgtaccgttaaggtaacttagtacgttacgaaccttaaacgtatttaaccgttcgtacggtactacgtacgtaagttatacgtaacttactaccctacgtactaccgtaccgtacgtacgaacggtcgaacgtcgaagtaactaataacgacttgngtacg

SEQ ID NO: 192883 - DNA, 743 bp, Homo sapiens
  misc_feature: GYAE6OF01C99NQ.13.59.F04.1.454.CMB.1.raw
  modified_base (178)..(178): a, c, t, g, unknown or other
  misc_feature (178)..(178): n is a, c, g, or t
tcagtcacgtactacacgaccggtgctcgatttagtacacacacttagggattgggggcagaagtctctctcagtcaggacacagcatggacatgagggtccctgctcagcctcctgggactcctgctgctctggctcccagataccagatgtgacatccagatcgaccatcctaccnctccctcctgtctgactctcttcgtaggacacgaggtctaccgtaccgtccgttacgtccggggccggaggtacctacgaaccacttaaacttaaccttactttttagtaccgtccgttaggtactagacgccgaaaggaccgaccgggaggtaacgttacccggtttaaaccttaaatttcgttaacgtactccgttgtcgtcgtccgttcccggtacccttcgtcgggacctaacggggttcccggtaccttcgttccggttcgtacggtgggtcggtcggtaggacttacggaacgtacgaagttacctactaccttaccacctacctaacctaccgaaacctactcgaaccctacgtagtaacgttagtttaggttaacgttattttaacgcgtacgtaaaccgtcgttaaacggtcgttacgggtccggtacccgttccgtacgtttacggttccgggtaccggggtaacgggtaacgtaacgggtacgtactaacgggaaacctaaacgtaaccgggtaacgttacgggtacggtacgtccctaacgtcccgttaaccg

SEQ ID NO: 192884 - DNA, 686 bp, Homo sapiens
  misc_feature: GYAE6OF01C4EYI.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtctccacttccctccctgtctgacacttcgtcgtagggacacgagtacgttccaaccggtcacgttcggccgggactagtccaacgactaattaactactttaatttacgccttaggtactacagcaaggacgcgaagggacacgttacctaaagttacttgtactctcgtgcgttcgcgtccgtccttgacgtacgggtccgggtaccctagtccgttcgtacgagggtcggtccggtaggtactacggtaacggtacaaggttacttcctaacctcctacctactactacccaaaccctaccgtcaccgtaacccgtagaaagtcttagttaacgggttaactttcgtaagttcgacttaacggtacctttaggtacggttcggcggttccccgtagttacgggtttccgtttacggggacccgggtaagggtacccgtagggtacccgaggtaaacgtaacggtaaacctaaaccgggtacgagggtttacgacgtcggtaaccctaacgg

SEQ ID NO: 192885 - DNA, 549 bp, Homo sapiens
  misc_feature: GYAE6OF01E3B9I.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcagtcacgacattaacacttattagcctggtatcagcagaagccgagggagacgtaccctaaattattgatctactgctgcgtccgcctgcaacgtccggggtccagtcgtcggtcagtcggcggtgatcgtaggacagtacttcactctcaccataccaaccacctcgaccaccctagaagtagtaggttaggtaagtttacttactcgtactacgtacctagtaggtcggtcggtcccgtcgtcgtacgtttcgggaccgggtacgggtaccgtaaggtgacgagtactaacgaaacgtacgtggtacggctcgcgtaccg

SEQ ID NO: 192886 - DNA, 580 bp, Homo sapiens
  misc_feature: GYAE6OF01BJIW7.13.59.F04.1.454.CMB.1.raw
tcagtcacgtactacacgaccggtgctcgatttagtacacacacttagggatcgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttgccgggcgagtcacgacattaacactttattagccttggtatcagcagaagccgaagggagacgtaccctaaattattgacttctactgctgtccgtccgtccttgacctaacggtccggggtccagttccgtcggttcgaggtggcggtggactcgtaggactagtaacttcactctacacctatacccaaccacctcgacctacccgtagaacgtagttaggttaggtaagtttattacgtgtactacgtacctagtaggtcggtcgtcccgtcgttacgttacgtttcgggacgggtaacgggtaccgtaacgggtgacgaagacgtaacgaaacgtagtcggtagctcgctaaccg

SEQ ID NO: 192887 - DNA, 687 bp, Homo sapiens
  misc_feature: GYAE6OF01DCZZA.13.59.F04.1.454.CMB.1.raw
  modified_base (197)..(197): a, c, t, g, unknown or other
  misc_feature (197)..(197): n is a, c, g, or t
  modified_base (245)..(245): a, c, t, g, unknown or other
  misc_feature (245)..(245): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctcccttgtctgactnttcctcgttggaacacgagacgttccaccgtctacgttcgcccggggnaagtccgaacgaactaactttaaacctactttaatttagccttaggtactcagcagaacgccgaaggganacgtacctaaattntgatctngtctcgcgtccgtcttagacgtaacggttccggggtacctacgtcgttccggttcgacggttcgggacggttaggacgttacggtaggactacgtaacgttactacctccgtaccacctactacccaaaccctaaccttcgacctacccgtaggtaacgtacgtttaggtttaacggtaagttttacttacgttacgttacgaactaccgttaaggttcggttacgggtaccggtccccgtacgtttaccgttacggtttccggggaaccgggtacggtaaacgtacgggttagaaccggtagtaaccctaacgtaaaacgttcggtacggtagtccgtacgcttaacccg

SEQ ID NO: 192888 - DNA, 661 bp, Homo sapiens
  misc_feature: GYAE6OF01AO5AM.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgccatctcttggagacagagtcaccgtcacttgccgggcgagtcacgacattaacacttattagcctggtatcagcagaagccagggagagtccctaaattatgatctactgctgcgtccgtcctgcaacgtcggggtcccatcgtcggttcaggtcggtcggtggtactcgtaggacaggtaattccgactctacaccattcccgaaccaaccctcgacccacccttaggaaacgtacttacgggttaggttaaacgtttaactttaaccgtagttaccgtaacggttaacccttaagttaacggggttacgggtttacgggcccccgttacttaccggttaacggtttttaccggggccggggtaaacggggtaaacccggttaaggggtaccggagtaaccggtaaacgttaaccgtaaaaaccgggtaaaccggttcggttaaacgggccgttaggcccttaaacccgg

SEQ ID NO: 192889 - DNA, 638 bp, Homo sapiens
  misc_feature: GYAE6OF01A5HKV.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacgttggccgggcgacgtcacgacattaacacttattacgcctggtatcagcagaagccgagggagacgtacctaaattatgatctctgctgcgtccgtcctgacgtaacggtccgggggtccctacgtcgttcggttcgtacggttcgggtacgggtggtacgtacggtaacgggactaaggtaacttccgtaacttaccgtaccaacctacttacccaacccgtaacccgtccgaccctaacccgtaggtaaacgtagtttacggttaacggttaaacgtttacgttaaccgttcgtacgtaacgtaccgttaagttacgggttcgggtcggtcccgtcgttacgtacggtttcgggaccgggtaacggaccgtagggtgacgtaagacgtaacgaaacgtacgtaggtaggctgctaccg

SEQ ID NO: 192890 - DNA, 423 bp, Homo sapiens
  misc_feature: GYAE6OF01B5GKF.13.59.F04.1.454.CMB.1.raw
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (414)..(423): a, c, t, g, unknown or other
  misc_feature (414)..(423): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggctacttttgatatcgtggggccaagggtcaatggtcatcgtctcttcagcctcaccaaggcccatcggtccttccccgtggccnccctgcctccaggacncacctcgagacgcacgagcggcccgtgggctcgcctggtacaaggtactacttcctagtacgtgactgagcggctggcaaggcgacatagnnnnnnnnnn

SEQ ID NO: 192891 - DNA, 581 bp, Homo sapiens
  misc_feature: GYAE6OF01C000J.13.59.F04.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (411)..(411): a, c, t, g, unknown or other
  misc_feature (411)..(411): n is a, c, g, or t
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgaccagtctccatcctcctgtctgcatctctggancagagtccaccgtcacgttcggccgggnagtcacgaacacttaaacactttatttacgccttggtactcagcagaagccgaagggacgacgtacccttaaattattgagtctactgtctcgcgtccgtccttgaccacggtcggggtccctagtccgtcggttcgaggtggtcggtggtatcgtaggacagtacttcacgtctccacgtacnccaaccactgacccacctacgtaagtgtaggttacggtaatttacttacgtgtacagtaccttaggtagtacggtcggtcctcgtcgttacgtttcgggacggtacgggaacgtagggtcgacgtaagtacgtaaaccgaacgtacgtggtaggtacgtcgtcctaaccg

SEQ ID NO: 192892 - DNA, 773 bp, Homo sapiens
  misc_feature: GYAE6OF01CQIUN.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccagatgtgacatccagatgacccatctccatccctccctgtctgccgtctcgcggagacgagggtccaacctatacctaccgttggtccgggacaaacggttcaaaggaaacctagtttacgggaacctaaccgttacttttaaaaagtttgggttaacttaccgaaggaccgaaaggttaaggtaccggaacggggacctaaaacccggtaccccccggaaacccgttccttacgtaacgttaccgttaaaccggtaacctactaccctaactttgacccgtaagtacggtcgggtaactaccccgtaagttaccgaaaggtttccgaaggtacgaccgtaagtagtacgttaaccgttaggaaaacctaaggttaaccttttacccgacctacctacgtacgtaaggggtaccttacgacgtacctaggtaagttagtttacgtaccgtaactttaacgttattacgtaaccgtaacgtaagttaccgttacccttacccggttacccccggtacggttccgaaccggttacggaaccgtaacggtaggaaaccgtaagaacgtaaacggtaccgtaaggtccgacgtacgtactaccgattaccgttacttcgtcttaacccg

SEQ ID NO: 192893 - DNA, 520 bp, Homo sapiens
  misc_feature: GYAE6OF01EDT7Z.13.59.F04.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctcatcctccctgtctgcatctcttggagactagngtcaccgtcacttgccggnagtcacgacattaacacttattagcctggtatcagcagaacgccgagggagagtaccctaaattattgatctctgctgcgtcgcttgcaagtcgggtccatcgtcgtcagtcggcggtgatgagacagtaatcactcacaccatccacactgccaccgtgantgtggtaagttatntgtcagactagtgtaggtcgccgtctcttcgtttcgggacggtacgggaaccgtagggtgacgtaagtaccgtaaccgaaaacggtaaaccgttggtacgggtctcgtacccgtaaccc

SEQ ID NO: 192894 - DNA, 520 bp, Homo sapiens
  misc_feature: GYAE6OF01DZ8BW.13.59.F04.1.454.CMB.1.raw
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttggagacagagtcaccgtcacttgccgggcgagtcacgacattaacacttatttagccttggtatcagcagaagccagggagagtccctaaattattgatctctgctgcgtccgcttgcagtcggggtccatctcgttnagtgcggtgatcgtagganagtatcactctacacatccaccaactcgaccacctgaacgntgttggaagtttattactgtcagtactatggtcgtcggcccgtctacgttacgtttcgggacggtagggacccgaagggttgacgagacgtaccaaaacggtactaggtggtctgcctaacccg

SEQ ID NO: 192895 - DNA, 571 bp, Homo sapiens
  misc_feature: GYAE6OF01AOHBW.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacgttgccgggcgagtcacgacattaacacttatttagcctggtatcagcagaagccagggagagtccctaaattattgatctctgctgcgtccgccttgctaagtccgggggtcccatcgtcggttcagtggcggtggatcgtaggacaggtaattcactctcaccatcccaccaacctcgaccacccctagaacgtagttggtttaggtaaacgttttacttaccttgttaccaacgtacccttaagttacgggttggtccgggtcccgtccttcgtacgtttcgggacggtacgggaccgacggtcgtagggagacgtacgaacgtacgtaacgtggtcggtcgttggacccg

SEQ ID NO: 192896 - DNA, 589 bp, Homo sapiens
  misc_feature: GYAE6OF01E39MK.13.59.F04.1.454.CMB.1.raw
  modified_base (200)..(200): a, c, t, g, unknown or other
  misc_feature (200)..(200): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctctgganacagagtcaccgtcacttgccgggcagtcacgacattaacacttattagcctggtatcagcagaagccgagggagacgtaccctaaattattagattctctgctcgcgtccgccttgcaagtccggggtcccagtcctcggttcaggtcgggcggtggactcgtaggacagtaacttcactctccaccactccaaccaacctcgacctaccccgtaggaaagtagttcggtttaggtaacgttttattacgtcgttactaacggtacccttaagttaggtcgggtaccggccccgttcgtcgttagtttccggggaccggacggggtaacccgaggttcgacgagaactaaccgtaaaaccgtaacgtcggtaggcttcgcctaacccg

SEQ ID NO: 192897 - DNA, 534 bp, Homo sapiens
  misc_feature: GYAE6OF01B2PRL.13.59.F04.1.454.CMB.1.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (453)..(453): a, c, t, g, unknown or other
  misc_feature (453)..(453): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtccaccgtcacttgccgggtcgagtcacgacattaacacttattagcctgtatcagcagaagccagggagagtccctaaattattgatctctgctgcgtccgcttgctagtcggggtcccagtctcggtcaggtggcggtggatcgtaggacagtacttcactctcaccactcacctaccncgccacctgaagtagtagttagtaagttacttacgtgtacacgtactagtaggtggtcggccgtntccgtacgtttcggcggtaacgggacgtaacggtgacgtagtaacgtacgaaacgtacgtcggtaggcgtggcctaacccg

SEQ ID NO: 192898 - DNA, 624 bp, Homo sapiens
  misc_feature: GYAE6OF01DNP80.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatccctccctgtctgcatctcgttggagacagacgtccaaccgtcacgttggcccggggcgagtccacgactaattaactactttatttacgccttggtatcagcagaacgccgaaggggacgacgttacccttaaaatttattgtactctctgctcgtccgtccgtaccttgaccgtaacggttccgggggtccctagttccgttcggttcgtaggtcggggtcgggttagacgttacggtaaggaacgtaagtaactttccaacttcctaccaacctactacccaaccaaccgtcgacccaccctagaacgtattgttaggtaacttattactgtacaacgtaccgtagtacggtcggtacgcccgtctaccgttacggtttccgggacggtacgggacgtagggtgactagactaacgaaacgtacgtggtcgcttgccgtacc

SEQ ID NO: 192899 - DNA, 577 bp, Homo sapiens
  misc_feature: GYAE6OF01C75WX.13.59.F04.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (405)..(405): a, c, t, g, unknown or other
  misc_feature (405)..(405): n is a, c, g, or t
  modified_base (490)..(490): a, c, t, g, unknown or other
  misc_feature (490)..(490): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatgaccccagtcctccatccctcctgtctgcatctcttgganacagagtcaccgtcacgttcggccgggngagtccaacgaccaattaaactactttaatttaacgccgttaggtatcagccaagaacgccgaggagacgtacctaaattattgatctctgcttgcgtccgctgtacgacggttcggggcccagtcgtgtcgaggtggtcggtgagtcgaggtacagtactcactctcactanacaccaactcgacaccgtagaagacttagtaggtaagttattacgttagtacaacgtactaacgtaggtacggttcggacccgtntcgttacgttttcggggacggaacgggtaccggtaaggttacgacgtaagacgtaacgaaacgtacgtagtaggcgttagcgtaacc

SEQ ID NO: 192900 - DNA, 658 bp, Homo sapiens
  misc_feature: GYAE6OF01D2IBZ.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacactttatttagcctggtatcagcagaagccgagggagagtccctaaattattgatctcttgctgcgtccgtccttgcgtacgtccgggggtcccagtcctcggttcaggtcggtcggtggactcgtaggacaagtaattcactctaccacacttccaacctaaccctgaccctacccgtagaaacgtacttacggttaggtaaacgtttatttaacgttacgttactaacgtaaccgtttaagttacgggttcgggttacgggtccccgtacgttccgttaacggttttttaccggggaccggggtaaaccggggtaacccggtaaaggggtttaccggaccgtaaaggtaacgttaaccgaaaaaaccggttaacggttaccggttagggtaccgttcgggaaccttaaaccccgg

SEQ ID NO: 192901 - DNA, 611 bp, Homo sapiens
  misc_feature: GYAE6OF01C8EHV.13.59.F04.1.454.CMB.1.raw
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
tcagtcacgtactacacgaccggtgctcgatttagtacacacacttagggagttgggggcagaagtctctctcagtcaggacacagcatggacatgagggtccctgctcagctccgtgggactcctgctgctctggctcccaggtgccagattgtgccatccagatgacccagtctccatccctccctntctgcattctagtaggacgacagatccaccatcacttggccgggntagnaggcattagaaatgatttaggctggtatacagacaagaaaccgaaggaaacgcccctaagcctaccgtgtatctaacgatgactaatccaaagtttacggaaaccgtacggggtacccaagtaccgtaaggttcgaaggtggaaagtggatagtagggtaacagtttactttttacttaccacctaattcacgtacaggccctagcagctaaggaatntattagacctaaanattaacgttctaggtacagtacaagttatgtaacttacgtacctacccgattccgtaacccgtttacggaacccggtaaaggaacccgtacgaaaccggtaggaaacgttaaacgttaaacccggtaagttcggtaacggg

SEQ ID NO: 192902 - DNA, 734 bp, Homo sapiens
  misc_feature: GYAE6OF01DJSJ6.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtctcatccctccctgtctgcatctcttggagacagagtcaccgtcacgttggccgggcgagtccagacattaacacttatttacgcctggtatcagcagagccgagggagagtaccttaaattattgacttctcgtgtctcggtccgtcccgtcctttgcgtaaacggttccggggggtaccctaagttccgttccgggttttacacgggttcggggtccggggttggtacgttaccggttaaggaacctaagggtaacttacctaccttccgtaccaacctactacccgtaacccaaaccttcgaccctacccgtagaaacgtacgttaggtttaaggttaaagtttactttacgttacggtacgtaacgtaacccgtttaagttacgggttcgggttaccgggttacccccgtctttaccggtttaaccggtttttccgggggaacccgggggtaacggggtaaaccccggtaaaggggttcgaccgtaacggaaacttaaacccggaaaaccggttaaaacggttcggtacgggtaccgttacgggccgttaaaccccg

SEQ ID NO: 192903 - DNA, 551 bp, Homo sapiens
  misc_feature: GYAE6OF01DWVPI.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgttgctctggctcccagataccagatgtgacatccagatgacccagtctccatcctccctgtctgcatctcttgganacagagtcaccgtcacgttgccgggcgagtcacgacattaacacttatttagcctggtatcagcagaagccagggagagtacccttaaattattgatctctgctgcgtccgccttgcaacgtcggggtcccagtcgtcggttcaggtggcggtggatctaggacagaagttcactctcaccataccacccaacctcgcgaccctgaacgattgtaggtaagtttattactgtacagtacctagtaggtggtacggtcccgtctacgtagttttccgggcggtacgggtaaccaagggtcgacgaagactaaccgaaaacgaacgtcggtacggactcggccaaccgtacg

SEQ ID NO: 192904 - DNA, 677 bp, Homo sapiens
  misc_feature: GYAE6OF01C8NEH.13.59.F04.1.454.CMB.1.raw
  modified_base (238)..(238): a, c, t, g, unknown or other
  misc_feature (238)..(238): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccagatgtgacatccagatcgacccagtcctccactcccgtccctgtcctgcatctctggagacagagtccaccgtcacgttcgggccgggngagtccgagaactacttaactacttacgtttacgtaccgttggtatcgagcacgaacggccgtaagggggacgtaacggttaccccttaaaatttacgttagtacttctcgttcgtcgtcgccggtccgtccgttgaccgtaacgtccgggggtccctacgttccggttccggttacgtacggtcgggtacgggtggtacgtacgtaggaacgtagtacgttactaccgtactaccacctactaccacctacctacgaccacccgtagacgtatggttacggtaattacttacgttagtacgtaacgtaacgtagtacggttcgggtccggtacccgtcgtccgtttaccgggtttaccgggcgggtaaccgggacggtaaggtcggacgacggtaactaacgtaaacgtaacgtcgggttcggactcggacctaaccg

SEQ ID NO: 192905 - DNA, 610 bp, Homo sapiens
  misc_feature: GYAE6OF01BMDHL.13.59.F04.1.454.CMB.1.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
  modified_base (591)..(591): a, c, t, g, unknown or other
  misc_feature (591)..(591): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatcctccctgtctgcatctcttgganacagagtccaccgtcacgttggccgggcgagtcacgactattaactacttatttacgccgtggtactcagtcagaacgcgagggagacgttacctaaattatgatctcgtgctcgccgtccgtctgctacgtccggggtcctacgtcgtcgtcgngtggcggtgacgtcgtacgacgtagtaacttcactctaccacctactaccaaccctacctcgacccgactagtaacgtagttaggttaggtaacgtttacttacgttcgtacgtaacgtaccgttagttacggtacggtccggtacccgtcgttacgttcggtttaccgggtaccgggtacgggtaacgtacgggtacgacggaagtaacgtaaccgaacgtaacgttacggnggtcgtcgtccgtaacccg

SEQ ID NO: 192906 - DNA, 583 bp, Homo sapiens
  misc_feature: GYAE6OF01D4HTE.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagacgtcaccgtcacttggccggcgagtccacgacattaactacttatttacgcctagtatcagacagaagccgagggagacgtaccctaaattatgatctctgctcgccgtccgtcctttgaccgtaacggtccggggtaccctacgttccgtcgggtttcgagggttcggcgggttaggacgttacgtaaggactaagtaacgtttcaacttcctaccacactccaaccactcgacaccctagatagtgttgtaagtttattcgtgtacagtactagttagtcggtcgtccgtactacgtttcggtacggaccggtaacggacgtacggtacgacgaacgaccgtaacaaacggtacgtaggacggtctcgccttacg

SEQ ID NO: 192907 - DNA, 713 bp, Homo sapiens
  misc_feature: GYAE6OF01ACCJR.13.59.F04.1.454.CMB.1.raw
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagtcacgtactacacgaccggtgctcgatttagtacacacacttagggattgggggcagaagtctctctcagtcaggacacagcatggacatgagggtccctgctcagctcctggggctcctgctgctctggctcccaggtgccagatgtgccatccagatcgacccagtcctccatccctccctgtctgctatctgtaggagacagacgtcaccatcacttggccgggnaagtcgagggcattagaatgtatttaggctggtatcgagacacgaaccgagggaaacncccctaagctcgtagatcgtagtggtcnctactacctaaggtttaaaacggtcgggtaccctaagttacgtaacggttcgaggcggtacgtagggtcgaagttccgtagggaccaacgtaacggtacctttactacgtttccgtaccaacccttaatacccgtaacggtcccgtaaccggtcccgttacggaccgtacggtacccggttaaggtaacgttttaacgttttccggtaaacctttaaccgtttttaacgttaaccgtttacggttaaacccttaacgtaaaccgttacctaaccttaaaccgttaacgttaccgttaccgggtacgggttaccggttaccggaacccggtaacgggtaaccgtaagggtaaacgtaaacgtacgtaaacggtacgttcggtcgggtcctaaccgg

SEQ ID NO: 192908 - DNA, 705 bp, Homo sapiens
  misc_feature: GYAE6OF01C4737.13.59.F04.1.454.CMB.1.raw
tcagtcacgtactacacgaccggtgctcgatttagtacacacacttagggattggggggcagaagtctctctcagtcaggacacagcatggacatgagggtccctgctcagctcctgggactcctgctgctctggctcccagataccagatgtgacatccagatgacccagtctccatcctcctgtctgcattctctggagacagagtccaccgtcacttcggccgggacgagtccgaacgaacctaattaaacctaacttatttacgccttaggtatcaagcaagaacggccgaaggggacgaacgttaccctaaaagtttcttagacttctcgtagtctcgtccgtccgtccttgacgtaacggttccgggggtccctaagttccgttaccgggttacgtagggtcgggtcgggtagggtacgttacgtaacgggtaactaaacggttaacttaccgtaccgttcctacctaaccctaaactacccctaaaccctaacccttacggaccctaaccccgtaagaaacgttagttacggtttaggtaacgttttaacttacgttgtaactaacgttaaccgttaagtacggttgggtccgtcccgtacgttacgttacggtttcgggacgggtaacgggtaccgtaagggtacggagaacgtaacgtaacaaacggttaacgtaggtggtacgtgacccgtaacg

SEQ ID NO: 192909 - DNA, 591 bp, Homo sapiens
  misc_feature: GYAE6OF01EKFOZ.13.59.F04.1.454.CMB.1.raw
  modified_base (380)..(380): a, c, t, g, unknown or other
  misc_feature (380)..(380): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcgttggagacagacgtcaccgtcacgttgccgggcagtcacgacattaacacttattagcctggtatcagcagaagccagggagagtacctaaattacttgatctctgctgccgtccgtcttcgacaacgtccggggtcctatcgtcggttcaggtcggcggtggatcgtagacagacttcactcncacactccaaccacctcaccacccgtagaagataggttacggtaatttacttactcgtacaagtaacccttgtaaggttcggtcggcccgtctaccgttagttttaccgggacgggtaacgggtacccggtaaaggggttcgacgtaacgtaacgtaacccgtaaaacggtaaaccgttggtaaccgggtcgttaccggaccgtaaacccg

SEQ ID NO: 192910 - DNA, 542 bp, Homo sapiens
  misc_feature: GYAE6OF01CIA8P.13.59.F04.1.454.CMB.1.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
  modified_base (448)..(448): a, c, t, g, unknown or other
  misc_feature (448)..(448): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtccctaaattattgatctntgctgcgtccgcttgcagtcggggtccatctcggtcagtggcgtgatcgtaggacagaattcactctcacatcaaccaacctgccaccctagaacgtntacggttggtaatttattacttgtctagtacctagtagtacggtcggccccgnttcgtagtttttccgggacgggtacggggaccgtaacgggtgacgtaggtaacgtaccgaaaacgtaacgttggtaggcttggaccgtaacccg

SEQ ID NO: 192911 - DNA, 930 bp, Homo sapiens
  misc_feature: GYAE6OF01C3EF4.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcattctcttggaagacagacgtaccaccgtctacgttcggcccgggacgacgtccaacgaactaacttaaactacgtttatttacgccttggtatcagacgtaagaacgccgtaagggacgtaacggtacccttaaaattaagttagtacttcttacgtcggtcgttcggtccgtcccggtcccttcgaccgttaaacggttcccggggggtaccctaacgttccggtttccgggtttacggagggttcggggtacggggttcgggtaacggtttccggtaagggaacgtaaacgttaacgttacctaacccttacccttacctaaccctaaccttaaccccgtaaacccgtaaacccgtttaccggtaaccctaaccccccgtaaggtaaacgggttaacggttacgggtttttaaacggttaaacggttttaacgtttaaccgttacggtttaaccgtaaaccggtttaaaccccgtttaaaggtttaaccggggtttacgggggttaccccggttacccccgggttacgtttaacccgggtttaaccggtttttttacccggggggaaccccggggttaaaccgggggtaaaaccccgggttaaacgggggttacccggtaaaccgggtaaaacgggttaaaccggtaaaaccggttaaaaaaccccggggttaaaccggtttaacggggttaccggggtaaacccggtttacccggtaacccggtttaaaaccccgg

SEQ ID NO: 192912 - DNA, 818 bp, Homo sapiens
  misc_feature: GYAE6OF01EHHGY.13.59.F04.1.454.CMB.1.raw
  modified_base (338)..(338): a, c, t, g, unknown or other
  misc_feature (338)..(338): n is a, c, g, or t
tcagtcacgtactacacgaccggtgctcgatttagtacacacacttagggattgggggggagaggagcccagcactgggattccgaggtatttccattcggtgatcagcactgaacacagaggactcaccatggtagttttggctgagcttgggttttccttattactattttaaaggtgtccagtgtgaggtgctaggttgggtggagttcgtgggagggaggtcgtttgggtcccgacggggtcccgggggggtccctggacgaccttctcagtggtcgccggtcctcgtgggcctccgaccgtacaaccaccaactacatgagcgtcgggtcccnccgacggcctaccggaaggggaaggacggggccgggtaggttcgggttacctacgtaggttttattttagtcggttaccggtacggtcgaccctaacgtacttaccgtaccgacgtacggtacccgtccgggtagggaccgggggtcccgttacacccgtactcccgtaccgaagaacgtaacctaagttaacccgaaacggtaaccgtacgggttatttaacttaccttaacgtaaaacgtccggtaaaccgtacccggtaggaacgggtacggttaccggaacggtaacccgacccgggtaccgttacgtttaacgttacgtgggttaacgaacgtaaagtacgtacggacgaagggaccgggaccccgggtaaccccggttaagggtccggggtaccggttaggggttcggggttacgggttttcttacggtttcggacggttcgggccgggttaccggggccggtaaaccccgggg

SEQ ID NO: 192913 - DNA, 631 bp, Homo sapiens
  misc_feature: GYAE6OF01B5914.13.59.F04.1.454.CMB.1.raw
  modified_base (203)..(203): a, c, t, g, unknown or other
  misc_feature (203)..(203): n is a, c, g, or t
  modified_base (335)..(335): a, c, t, g, unknown or other
  misc_feature (335)..(335): n is a, c, g, or t
  modified_base (403)..(403): a, c, t, g, unknown or other
  misc_feature (403)..(403): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctcctgtctggcatctcttgganacagacgtccaccgtcacgttggcccgggcgagtccacgacaattaactactttatttaacgcctggtatcagccagaacgccgaagggagtacgtaccctaaattagttgtactctctgctcgtccgtccnccttgccgtaagtccgggggtccagtcgtcggtcaggtcgggcggtgagtcgtaggactagtacttcncgttccacacactacccaaccctacctcgacctacccgtagtaaacgtgttacggtttaaggtaacttttaagtttaccgtaggtactaacgtaccttagttaacggtcgggttcggaccccgtgttaccgttacggtttaccggggcgggtaacgggaccgtagggtaccgacggtaacgtaacgtaacccgaaacggtaacttgggacgccgttggcccttaaccg

SEQ ID NO: 192914 - DNA, 707 bp, Homo sapiens
  misc_feature: GYAE6OF01CFP3L.13.59.F04.1.454.CMB.1.raw
  modified_base (152)..(152): a, c, t, g, unknown or other
  misc_feature (152)..(152): n is a, c, g, or t
  modified_base (212)..(212): a, c, t, g, unknown or other
  misc_feature (212)..(212): n is a, c, g, or t
  modified_base (413)..(413): a, c, t, g, unknown or other
  misc_feature (413)..(413): n is a, c, g, or t
tcagtcacgtactacacgaccggtgctcgatttagtacacacacttagggattgggggcagaagtctctctcagtcaggacacagcatggacatgagggtccctgctcagctcctggactcctgctgctctggcctccagataccagatgtnacatccagatcgacccagtcctccactccctccctgtctcgactacttcgtcgttagganacaggacttcaacccgtctaccgttcggaccggggactacggccaacgtactaattaacctactttattacgccgtgtaactcagcaaggaacgccggtaagggactaacgttaaccttaaaattatacgtctctctcgcgtccgtccgttccgtctaggaccgtaacggtccgggtaccctagttccgttcggttaccgngggtcgggtggtacgagtacggtaacggaactagttaccttacgaccttactaccaactactaaccctaacccgtaacctcgaaccgtaacctaacggagttaacggttagtttaagggtaactttacttacgtacgtaccgaattaccggtagtaccgggttggtacccgacccgttcttacgttacgggttaccggaccggggtaaacgggtaaccgtagggacgaacggtaaacgaaaccgtaaccggtaaaccggtaccggttaggtaccggacctacgacccttaaccg

SEQ ID NO: 192915 - DNA, 762 bp, Homo sapiens
  misc_feature: GYAE6OF01E3H8B.13.59.F04.1.454.CMB.1.raw
  modified_base (158)..(158): a, c, t, g, unknown or other
  misc_feature (158)..(158): n is a, c, g, or t
  modified_base (177)..(177): a, c, t, g, unknown or other
  misc_feature (177)..(177): n is a, c, g, or t
tcagtcacgtactacacgaccggtgctcgatttagtacacacacttagggattgggggcagaagtctctctcagtcaggacacagcatggacatgagggtccctgctcagctcctgggacctcctgctgctcgtggcctcccagataccagtatggtnacatccaagatcgaacccngtcctccactcccttcccgtgtcctgactactcgttcgttaggggaacacaggtacttccgaacccgttctacgttcggggcccggggtacgaacggttccaacggtaactaactttaaactaaccgttttaactttaacgtaccgttaggtactaccgaagacgaaggaaacggacccggaagggaacgtaaccggttaacccttaaaatttacttacggtacttacgtcgttcgtcgttccgtccggtcccgtcgttacggtaccgtaacggtccccggggtacctacgttaccgtcggttacgtcgggtcgggtcgggtacgtacgtacgtaagggaactacggtaaccttccgacttaccgtacctacctactaacccaacccgtaacgtcctaacccgtaaccgtaggtaacgttaagttacggttaaggttaatttaacgtagttacggtacgtaacgttaaccgtaggttaggtaccgggttccgtacccgtctttacggtacggttcgggaacgggtacggtaacgtaggtacgacgtaataccggaacaaacggtacgtacgtaggctgccttacg

SEQ ID NO: 192916 - DNA, 624 bp, Homo sapiens
  misc_feature: GYAE6OF01CLDS1.13.59.F04.1.454.CMB.1.raw
  modified_base (203)..(203): a, c, t, g, unknown or other
  misc_feature (203)..(203): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcgttgganacagacgtcaccggtctacttcggccgggcagtcacgactattaacacttattaacgcctggtatcagcagacgcgagggacgtagtacctaaattatagtactctctgctcgtccgtccgtccttgaccgtaacggtccgggggtcctagtccgtcggttacgaggtcggtcggtaggtactacgtaaggacaagtaattccacgttctaccacctactaccaacctaacctacgccctaacccgtagtaacgtacgttagttacggtaagtttacttacttagtacgtaacgtaccgtaatcgggttaggtacgtcccgtacttcgtaacggtttccgggaccgggtagggaacccgtaagggtcgacgtaacggaacgtaaccgaaacgtacgtaggtccggactcgaacgtaacccg

SEQ ID NO: 192917 - DNA, 833 bp, Homo sapiens
  misc_feature: GYAE6OF01CJH93.13.59.F04.1.454.CMB.1.raw
tcagtcacgtactacacgaccggtgctcgatttagtacacacacttagggattgggggcagaagtctctctcagtcaggacacagcatggacatgagggtccctgctcagctccgtgggacctcctgctgctcgtggctcccagactaccagatgagacatccagatcgacccagtctaccactccctcctgtcctgcctatccttcgttggacagacgagtccgaccgtcctacgttcgggccgggacgtacggtaccaacggtaacctaactttaaacctaactttaactttaacggtccgttaggttactacgaaggaccgaagaacggacccggtaaggggaacgttaacgttaaccctttaaaagtttacgttacgtaacttcgttcgtcgccggttcgcccggttcccgccgttacggtaccgttaacgggttcccggggtaccctacggttccggtaccggtttacgacgggttcgggtcgggtacgtacgtttacgggtaacgaacgttaaccggttacctttaccgtaacccgttaccctacccgtaacctaacccgttaacccccgtaaccctaacccgttaccgaacccgttaacccggtaacgttaaacgggtacgttttacgggttaacggtttaagttttaaaccgttacgttaccggtttaaccaaccggttacgtttaaggtaccgggttccggtccggttaccccgtgttacccggtacggtttaccgggaccgggtaacggaccgggtaacgtggaacctaacgtaccgtaaacaacggtaacggttcggtaaccggacttcggaaaccttaccg

SEQ ID NO: 192918 - DNA, 833 bp, Homo sapiens
  misc_feature: GYAE6OF01C4GM3.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctctggagacagagtccaccgtctacgttcggccgggacgagtccaacgtactacttaaactaaacttaattttaaattggtaataccgaagacaaacgaaaccaggtaaaacgccccgtaaagtcctacctagactactaccgtatcgactactaccgtaagtttacggaaaaccgtacggggtaccctagttaccgtaaaggtttacgaaggttagggtaaacggttggtaacgttaccggtagggggtaaacttaggtttaaactttttttaacccgtttaccgtaacccgtaagtttacccgaacggtaccgtaaccggtcccttacggtaccgtaagtaccccgttaggaaacgttaagttacgttaacggaacctaaacttaagtttaaccgtttaacgtacggtaacgaacggttaaccgtaaagggtttacgtaacgttaaacgtttaaccgtttccccgtaaaccccgttacgttaacccccgtaaacccccgggtttaccgggaaacccgggtaaaaccggggtaacccctaaaccgggtaacccggttaaaggggtaaaaccgtttaaaaccgttaaaaacccgggtacgtttaccggggtacggttacccgtaacgttaaacccccgg

SEQ ID NO: 192919 - DNA, 771 bp, Homo sapiens
  misc_feature: GYAE6OF01D6QPF.13.59.F04.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
tcagtcacgtactacacgaccggtgctcgatttagtacacacacttaggattgggggcgagaagtcctctctcagtcaggacactagcagtggacatgagggtccctgctcagctcctggactcctgctgctctggcttcccagtataccagtatgtgacatccagatgacccagtctccgatcctccgtagtctgcatctcgttggganaccagacgtccaccgttcacgttggccgggntacgtcacgtacacttaacgtacttatacgtccttggtatcagacagaacgtccgaagggacgacggttaccttaaagttacgttacggacttcgtcttacggtcttgggtccggtccggtcgttcggaacgtaacggttcccgggggttaccctaacgttacggttccggtttacggaaacgggtcggggtaccgggttacgggtaacgttacggttaaccggggaaccttaacgggttaaaccttttcctaaccgtttacccttaccgaacccgttaacccgtaccctaaaccccgtaaacccgtcgtaaacccgtaccccgtaagttaaacccgtagttacggtttaacggtaacttttaacgttacgttacgttaacgtaaccgtaacgttaacggtacgttacggggtaccggtaaccgtccgttaccgttacggtttaccgggaacggggtaccggaacgtacggtcggactacggaactaccggaaaccgttagtacggtacggtaccgtccgtcgtaacccg

SEQ ID NO: 192920 - DNA, 613 bp, Homo sapiens
  misc_feature: GYAE6OF01BZ5RX.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtccaccgtcacttgccgggcagtcacgacattaacactttatttagcctggtatcagcagaagccagggagacgtccgtaaattattgactctctgtcgtgacgtccgtccttgcgtaagtccgggggtcccagtcgtcgttcgagtggcggtggatcgtaggacagtacttcactcctcgaaccatcccaacccgtacctcgcctaacccgtagtaacgtacgttaggttacggtaaaggtttactttacgtgtaacctacggtaacccgttagtaacgggttcgggttcgggaccccgttgttaccgttacggttttaccggggaccgggtaacggggtaccgtaagggtcgacgtaacggtacaaccgtaaacgtagtcggttacggccttcgaaccgtaccg

SEQ ID NO: 192921 - DNA, 731 bp, Homo sapiens
  misc_feature: GYAE6OF01CSG1Z.13.59.F04.1.454.CMB.1.raw
  modified_base (180)..(180): a, c, t, g, unknown or other
  misc_feature (180)..(180): n is a, c, g, or t
  modified_base (195)..(196): a, c, t, g, unknown or other
  misc_feature (195)..(196): n is a, c, g, or t
  modified_base (211)..(211): a, c, t, g, unknown or other
  misc_feature (211)..(211): n is a, c, g, or t
  modified_base (444)..(444): a, c, t, g, unknown or other
  misc_feature (444)..(444): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctacccagactaccagatgtgacatccagatcgacccagtctaccnctccctcccgtgtcnncattctcgttagganacgagacgtccaccgttctaccgttcgggcccgggagtacgtaccaacgaactaactttaaacttacctttaatttaccgtccgttaggttaatccgagaccgaaggaaacggaccggaagggacgtaacggttaacccttaaaatttgttacgtacttctcgttgccgttcggtccgtccgtccgttcgacgtacggttaccggggtccctacgttcggttccggtttacgnggggttcggtacggggttgtagtacgtaaggaccgtaagtaacgttcctaactcctacctaccgtaacctacccttaaaccacccgtcgtaaccgacccgtagtaaacgttgttacggtttaggttaactttaacttacgtcgtaaccaagttaccgttacgggtagtccgggttaccgtccgttacgtcgggttttacttacggggacgggtaacggaacggtacgggcgaacgtacgaacgtaaacccgtgtaaaccggtttggaacgtcgtcgtccgttaaccg

SEQ ID NO: 192922 - DNA, 639 bp, Homo sapiens
  misc_feature: GYAE6OF01BV5WO.13.59.F04.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagtcacgtactacacgaccggtgctcgatttagtacacacacttagggattgggggcagaagtctctctcagtcaggacacagcatggacatgagggtccctgctcagctcctggactcctgctgctctggctcccagataccagatgtgacatccagatgacccagtctccagtcctccctgtctgcatctctganacagngtcacgtcacttggccggtcagtcanacataacacttattagctagtatcagcagtacgccgaggganacgtacctaaattatgattctntcgctgcgtccncttgactaacgtccggggtccatccgtggttccgaaggtcggcggtgacgtcgtaaggacaagtaacttcaccgtacctacgaccgtatacccaacccaacgtccgaccacccgttagaaacgtacttaggttaggtaaactttacgttaaccgttgttaacgaaaccgttaaccgtaagttacggtacggttccggaccccgtcgttaccgttaaccggttttcggaccggggttaacgggaaacccggttacgggtacgaccggttaaacgaacgtaaaccgaaacccggttaaacgttacggtaccgggtactacggaaccccgtaaacg

SEQ ID NO: 192923 - DNA, 780 bp, Homo sapiens
  misc_feature: GYAE6OF01AWR7W.13.59.F04.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagtcacgtactacacgaccggtgctcgatttagtacacacacttagggattgggggcagaagtctctctcagtcaggacacagcatggacatgagggtccctgctcagctctgggactcctgctgctctggctccagataccagatgtgactagtccagatcgacccagtcctccatccctcctgtctgcatctcttagganacagacgtccaccgttcacgttcggaccggcgagtccacgactaatactacttattacgctaggtatcgagacgtagaacgccgagggacgtaacgtacctaaattntacgacttctcgtcgtactcgtaccgtccgtaccgtacgtaccgtaacggtccgggggtaccctacgtccgttcggttacgtacgggttacgggtacggttacgggtaacgtacggttaagggaacgtaacgttaaccgtttacctacccttacgtacctaaccctaaccgttacccaaacccgttaaaccgtccgtaacccgtaaccgttaacggtaaacgttacgtttaacgggttaacgtttaacggtttaacgtttaaccgtagttaaccgtaaccgttacgtacggttaacggtttccggtacccgggtacccgttacgttacggtttaccgggtttaccgggaacgggtaaccgggttaaacccggtagggttacccgaaccgggttaaagaacccggttaaacggtaaaacccgggttacgttacgggttaacccgggttcaaccccgtacgtaaaccccgg

SEQ ID NO: 192924 - DNA, 472 bp, Homo sapiens
  misc_feature: GYAE6OF01BI9X6.13.59.F04.1.454.CMB.1.raw
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (445)..(472): a, c, t, g, unknown or other
  misc_feature (445)..(472): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcggcggggctacttttgatatcgtggggaccaagggtcaatggtcatcgtctcttcagccctccaccgaacgggcccatccggtcccttcccccctgggcccnccctggcctccgagggacnccacccgtccgagacgcacaggccggccctgggctcggcctggtcaaggacctactctagtacgtagactggacggcgggcttagggcgaacgggcgacgtataggnnnnnnnnnnnnnnnnnnnnnnnnnnnn

SEQ ID NO: 192925 - DNA, 790 bp, Homo sapiens
  misc_feature: GYAE6OF01A2K6P.13.59.F04.1.454.CMB.1.raw
  modified_base (196)..(196): a, c, t, g, unknown or other
  misc_feature (196)..(196): n is a, c, g, or t
tcagtcacgtactacacgaccggtgctcgatttagtacacacacttagggattgggggcagaagtctctctcagtcaggacacagcatggacatgagggtccctgctcagctccgtgggactcctgctgctcgtggctcccagactaccagatgtagacatccagatcgacccagtctccatcccgtccctgtctnctacttctcgtaggacgtacgagtacgtccaccgtctcgtcgggccggcgtactccgaacgaactaacttaactaacttttacttacgtcgtagttactcgacgtacgaagaacgtacccggaaggacgaccgttaacccgttaaattaacgttcgtacttcgttctcgtcgtcggtcccgttccgtccgtacgaccggtacggtccggggttcctacgttccgtacggttcgtacgggtcgggtacggtcgggtattacggtaaacgacgtaacgttaacgttaccgtaccttaccgtaacctaccgtaacctacccctaaccccgtaacctacccggtaacccgtaaccgttacggtaaacgttaacgggtttaacgggttaagttaacgggttttaacttacggtttaactacggtaaccgttaacgttacgggttacgggttaccggtacccggtacccgttaccgtttaccggttaccggttaaccgggggtaaccggaaccggggttaccggtacgggttacggacgtaacgaacggttaaccgaaaccgttacggttacgggtaccgtacgtaccggtcttaacccg

SEQ ID NO: 192926 - DNA, 798 bp, Homo sapiens
  misc_feature: GYAE6OF01C6K6D.13.59.F04.1.454.CMB.1.raw
  modified_base (459)..(459): a, c, t, g, unknown or other
  misc_feature (459)..(459): n is a, c, g, or t
tcagtcacgtactacacgaccggtgctcgatttagtacacacacttagggattgggggcagaagtctctctcagtcaggacacagcatggacatgagggtccctgctcagctccgtgggactcctgctgctctggcctcccagataccagatcgtagacatcagactcgacccagtcctacctactccctccgtgtcttcactcttccgtcgttagggaacacgaaggtctacctacccggttctacgttccgggaccggggactaacggtccaaacgtaaccttaaacgttaaccttactttacgtttaacgccgttacggaccataccgacgacggaaacggaacggccggtaaggaacgttaaaccgttaaccgttaaaactttagtcgtacttcctcgtacgggtcctacggtccgttacccgtcgttacgaccgtaaccggttccgggtacccngtttccgtacggtaccgtagggtcgggacgttagtaacggtcgtaaacggacttacgtaactccctacctaccttaccaaccgtacttaacccgaaccccttaaccgacggtaaccctaccgggttaacaaagttacggtttaaccggtttaaggtaacgttttaactaacggtttaccaacggtaacccttacggtttaacgtaccgggttacgggtccctacccggttacttccgttacgggttaccgggtaagggaacccgggttaacgaaggttacgacgtaacgtaacgaaacccgtaacgtacggtaccgttacgcccggttaactaacccgg

SEQ ID NO: 192927 - DNA, 729 bp, Homo sapiens
  misc_feature: GYAE6OF01CQCTB.13.59.F04.1.454.CMB.1.raw
  modified_base (154)..(154): a, c, t, g, unknown or other
  misc_feature (154)..(154): n is a, c, g, or t
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (712)..(712): a, c, t, g, unknown or other
  misc_feature (712)..(712): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatggtnacatccagatcgaccagtctccactccctcctgtctgacntcgtctgganacagtacgtcctaccgtcacgttcggccgggcgatcaacgactaacttaacctacttaagtttacgccttaggtactcgaacgacgaacggaaacggacccggtaaggggaacgtaaccgtttaacccgtaaaattttacgttacgtaacttcttcgtcgtcgttccggaccgttcccgtacgttcgaccggtaacggtccggggtaccttacggttccgtttcggtttacgaggttcgggtcggtagtacgttacggtagtaacgaagttacttactaccttactaccaccctaactaccctaaacctacctacggacctaacccgtaggtaaaccgtaggtttacggttaagttaacgtttaataccgtaacgttaccaacggttacctttaagggtcggtcggttcccgggccctattaccggttaacgggtttcgaaccggggtacgggacgtagggttacggacgtaaagtaacccgttaacgaacggttaaccgtcgggtanccgtaagcccttaacgg

SEQ ID NO: 192928 - DNA, 773 bp, Homo sapiens
  misc_feature: GYAE6OF01D0LCI.13.59.F04.1.454.CMB.1.raw
  modified_base (115)..(115): a, c, t, g, unknown or other
  misc_feature (115)..(115): n is a, c, g, or t
  modified_base (155)..(155): a, c, t, g, unknown or other
  misc_feature (155)..(155): n is a, c, g, or t
  modified_base (496)..(496): a, c, t, g, unknown or other
  misc_feature (496)..(496): n is a, c, g, or t
tcagtcacgtactacacgaccggtgctcgatttagtacacacacttagggattgggggcagaagtctctctcagtcaggacacagcatggacatgagggtccctgctcagctccngggacctcctgctgctctggctcccagataccagatggtnacatccagtactcgaacccagtccctccacgttccctcctgtctcgctacttccttagttcggaacgacgaaggacttccgtaccccgtcgtaccgttccgggacccggggacgtacgaccgaaccggtaactaacttaaactaacttttaacttacggtacccgttaggtaactacgacggacgaacggaacggaccggaacggggtacgtaacggttaccccttaaaagtttacgtttacggacttccgttctcggtcgttcggcccgtttacccgtccgttacggacctaacgggttcccggggttaccaacgttcccgttacggtttcgtaacgggnggttaccgggtgggtacgtaccgtaaggaacgtaacgtacgttacctactaccgtacctacctacctaacctaaccctaccgacaccccggtaaccctaaggtaacgtaggtttgttaacgggttaactttaacttacgtataaccgacgtaacgttacggtagttccgggtacggtcccgtacttcgtacggtttacggaccgggtacggaccggtacgtacggtagaaccgtaacgtaacgaaacgtacgttacggagtcgtaacgcgtaacccg

SEQ ID NO: 192929 - DNA, 791 bp, Homo sapiens
  misc_feature: GYAE6OF01EZXHG.13.59.F04.1.454.CMB.1.raw
tcagtcacgtactacacgaccggtgctcgatttagtacacacacttagggattgggggcagaagtctctctcagtcaggacacagcatggacatgagggtccctgctcagctccgtgggactcctgctgctctggctccagactacagatgcgacatccagatcgacccagtcctccactccctcctgtctgctactcctagttaggacgacacggtacgttaccgaccgttcgtacgttcgggacccggggacgtaacggtccaaacggtactaactttaaaccttaactttaacgtttacgtaccgttaggtactacgacgtacgaacggaacgaccggagggaacgtaaccggttaaccttaaagttagttacgactcgttatacgtcgttcgaccggttcccgtcgttacggaccggttaaccggtccggggtacctacgttccggtcgggtttacgcgggtcggggtcgggttagacttcgggtaaacgtaacggtacgtaacttcgaacccgtttcctaacccgtaaccttacgtaccccgtaaaccctaacccggttcgaccccgtaaccgtaggaacggttaccgtttaagggttaaccgttaagtttaccgttaacgtaccggttaacgtaaccgtaaccggttagttcggggtaccggtccggtacccgtattaccggtttcgggtaccggggacggtaacgggtaaccgtagggtaccgacggtaaagtaccgtaaacggtaaacctcgggttacgacggtacgttaaccgcgttaaccc

SEQ ID NO: 192930 - DNA, 712 bp, Homo sapiens
  misc_feature: GYAE6OF01CJISP.13.59.F04.1.454.CMB.1.raw
  modified_base (105)..(105): a, c, t, g, unknown or other
  misc_feature (105)..(105): n is a, c, g, or t
  modified_base (109)..(109): a, c, t, g, unknown or other
  misc_feature (109)..(109): n is a, c, g, or t
  modified_base (126)..(126): a, c, t, g, unknown or other
  misc_feature (126)..(126): n is a, c, g, or t
  modified_base (134)..(134): a, c, t, g, unknown or other
  misc_feature (134)..(134): n is a, c, g, or t
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagtcacgtactacacgaccggtgctcgatttagtacacacacttagggattgggggcagaagtctctctcagtcaggacacagcatggacatgacgggtcccngctnagctccgtggacctccngctgctcngcctcccagactaccagcgtagcaactntcgaagtntccaaccctntccacctgtcccctcctgtctntccgtatcctggtaggatcgagtcgcctaccgcgttcggcgaccgggatgtaacccaagtctaaaacttaccttactttaagttttccccgaggtttacgtatcccggaagtacggaaggaccccggtttanacgggggtttaacaaaaccgttctttaaatnttccggcngttcggaactttccggacncttaacgtcccaaggttcgcccgttacggntcgttcgagtacgngtcgtanaggtntacggagtacttactagtactacctactaccctaccgtacctacccgtaacgcctaaccgtactacgtaagtacgtgttacgtaagttacgttaacgttactaacgttaacgtacggtttaacgtcggtacggtccggtctaaccggtcgttaaccggtaccggttaccggtaacgggtaaccggtaacggtaccggttaagaacggttaacgaaacggttacgtaacgttaccggtaacgtacgtacggttaacgtcgtaacg

SEQ ID NO: 192931 - DNA, 738 bp, Homo sapiens
  misc_feature: GYAE6OF01BEPTO.13.59.F04.1.454.CMB.1.raw
tcagtcacgtactacacgaccggtgctcgatttagtacacacacttagggattgggggcagaagtctctctcagtcaggacacagcatggacatgagggtccctgctcagctccgtgggacctcctgctgctctcggctcccagataccagatcgtgacatccagatcgacccagtcctccactccctcccgtgtctgacatcgtagtacggagacgagacgtccacctatacctacttacggtacgacggaccggtacgtaccgaaggaactaattaaaacctaactttaaattttaaagttggtactacaacggtacaaacgaaaaccgtaacggtaaaccgacccctaagtcccttaccgtagtactacgtacgagtacactacttaaccgtaagtttaacggaaaccggtacggttacctaaggttaacgtaacgggttacaacgggttaagggtaaggttacggtacgtcgggtaaggttaactacgtttaactttttaccttaccctaacgtacgttaacgacgtacgtaccgtaccggtcggaacctacggacctaaggaaccgttattacgtaaccgaactaacttaagtttaacgttactaggtaccgatacgaatagtaacgtactacccgtacctacccgacgtaaccgttacccgcggtaacccgaacgggtaccgacggaaccgtaacggtaacgtaaaccgttaaaggaccgttgggacggtac

SEQ ID NO: 192932 - DNA, 591 bp, Homo sapiens
  misc_feature: GYAE6OF01BMFYN.13.59.F04.1.454.CMB.1.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (414)..(414): a, c, t, g, unknown or other
  misc_feature (414)..(414): n is a, c, g, or t
  modified_base (473)..(473): a, c, t, g, unknown or other
  misc_feature (473)..(473): n is a, c, g, or t
tcagtcacgtactacacgaccggtgctcgatttagtacacacacttagggattgggggtagaagtctctctcagtcaggacacagcatggacatgagggtccctgctcagctcctgggactcctgctgctctggctcccagataccagatgtgacagtccagatcgacccagtcctccattccctcccgtgtctgcatcctcttggagacagtacgtccaccgtcacgttggccgggcagtccaacggactaattaacgtacttttactttacgccgttggtatacagcgaagaagccgaaggtacgacgtaccttaaagttnttacgatcgtctgtctggacctccgtcttgacgtaggtccgggtccattcgtcgtancggtggacggtgtatcgtaggacaagtacttacnctactcacactaccgaccactacgccaccgataagtactgttaacgtattacttaactntacaacgtaccttaagtggtcggtacgccggtactcgtacggtttcggacgggtacggtaccgtaggctagaacggtataaccggtaaactacgtgtacggtcacggctacgttaccg

SEQ ID NO: 192933 - DNA, 729 bp, Homo sapiens
  misc_feature: GYAE6OF01DKYE0.13.59.F04.1.454.CMB.1.raw
  modified_base (188)..(188): a, c, t, g, unknown or other
  misc_feature (188)..(188): n is a, c, g, or t
  modified_base (383)..(383): a, c, t, g, unknown or other
  misc_feature (383)..(383): n is a, c, g, or t
tcagtcacgtactacacgaccggtgctcgatttagtacacacacttagggattgggggcagaagtctctctcagtcaggacacagcatggacatgagggtccctgactcagctccgtgggactcctgctgctctggcctcccagtaactaccagtattgagactaatcccgaggtactcgaacccgtnttcctaccgacttccccttcccgtgtcctcgacctattcgtgtacgggataagtacgactccaccgttaccgtacggttcggcccggggactacggtccaaagtaaccttaacttaaccttattacgttacgtccgttaggtactcgaactcggaagaacggccggaaaggggtaccacttaccgttaattagtntacctgttcctggtacctcggtaccgtcccgtacgtgaaccggttacgggggtcccgtccttaacggttccggtttacggttacggcggggtcggttagggactttaccgaggtaccggtaatccgtaacttccgtaactcctaccactacccgtaccaaccgtaccgaccgttaccaccgtaatggtacgttagttacgttaactttcgtctacgtacgtacgtaattacgggtcgtacggtaccgcgttactacggttacggtagggacccgggtaggtaccggtagcgaacgtacgtaaccgtaacggaaccgttagacgggttaccgactccgtcgttaacg

SEQ ID NO: 192934 - DNA, 748 bp, Homo sapiens
  misc_feature: GYAE6OF01B4TCY.13.59.F04.1.454.CMB.1.raw
  modified_base (157)..(157): a, c, t, g, unknown or other
  misc_feature (157)..(157): n is a, c, g, or t
  modified_base (204)..(204): a, c, t, g, unknown or other
  misc_feature (204)..(204): n is a, c, g, or t
  modified_base (386)..(386): a, c, t, g, unknown or other
  misc_feature (386)..(386): n is a, c, g, or t
  modified_base (688)..(688): a, c, t, g, unknown or other
  misc_feature (688)..(688): n is a, c, g, or t
tcagtcacgtactacacgaccggtgctcgatttagtacacacacttagggattgggggcagaagtctctctcagtcaggacacagcatggacatgagggtccctgctcagcctccgtgggctcctgctgctctggcctcccagactaccagtatgtnacatccgagatcgaccccagttcctccaactcccctcccgttgtctnacctcttcttccgttaggaacgacagtcgtaccaccgttccacgttcgggcccgggacgtcgtaccgacgaactaactttaaaccttaacttttacttttacgtccgttaggtactcgagccgaagaacgccggaagggtacgtacgttaaccctttaagtttacttacgtctttaccgttntccggttccgtcggtccccgttccgtccgtttgaccggttacggtcccggggtccctgttccgttcggtcgtgggtcggtcggtgtactcggagtacacgttatccgtactcctaccgactacccttacccaacctaacccgtcctacccgtaaccgtacggtaagtagttttagggttaccgtttaagttacttccgtagtaccgtaacgttacgtaaggttcgggtccggtaccgtccccgttattccccgggtttaggtttaacccgggcggggtaaccggtaacggtccgggttaacncggtaaacgaacccgttaacgtaaccgggttcgtccggtgaccggttcccgtaatcccgg

SEQ ID NO: 192935 - DNA, 667 bp, Homo sapiens
  misc_feature: GYAE6OF01AVEBU.13.59.F04.1.454.CMB.1.raw
  modified_base (159)..(159): a, c, t, g, unknown or other
  misc_feature (159)..(159): n is a, c, g, or t
  modified_base (410)..(410): a, c, t, g, unknown or other
  misc_feature (410)..(410): n is a, c, g, or t
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
tcagtcacgtactacacgaccggtgctcgatttagtacacacacttagggattgggggcagaagtctctctcagtcaggacacagcatggacagtggacgggtccctgctcagctccgtgggactctgctgctctggcctccagataccagtatggtanaactatcagactcgacctagtcctcctacttcccgtccttgtctcgtctcgttcttcggtaggaagtacgtacgtacgtcctaccgtacgtccggttcgggccgggtacgtacgacctaacgtaactaactttactaatttacttacgccttaggtactagacgacgtagacgacggaggtacgtactaacttaatagttctctactcgtcgcgtctccgtacgtcgtacgcggtaacggtccgggtaccncgttaccgtgtcgtaggtcggtggtacgtacgttacggagacgtactctacgtactcgtacctacgtaccaccctaacccgtaccgtaccgtaacccacgtaagtaagtcgttacgttacggttatttactacgtacgtactaaccgtacgttcgtacgggtcgacggttacctcggttacggttacgggtcggtaacggtacggtagtcggtanacggtaanacgtaaagtcggtaacncgggtancggctactcg

SEQ ID NO: 192936 - DNA, 807 bp, Homo sapiens
  misc_feature: GYAE6OF01A6O94.13.59.F04.1.454.CMB.1.raw
  modified_base (156)..(156): a, c, t, g, unknown or other
  misc_feature (156)..(156): n is a, c, g, or t
  modified_base (191)..(191): a, c, t, g, unknown or other
  misc_feature (191)..(191): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacntccagatcgacccagtcctccactccctcctgtcngcatctcgtagagacagagtccacgtctacgttcggccgggtacgagtcaacgactaacttaactactttaattacgccgttgtactaccagacgtaagaacggccgaaggggacgtaacgttaaccctaaaagtttcgttacggtacttccgttctacggtcttccggtaccggttccgtccgttacgtaccggtaaccggttcccggggggttaaccctacgttaccggtttacgggttacccgtaaggggtcgggtacccgggtttaggtaaccgttacggtaaacgggtacttaacgggtaactttccctaacttacccgtaacgtaacccctaacttaacccccgaaacccgttaaccgtaccggtaacccctaacccggttaaaggaacggtttaacttagggttaacggtttaaacgtttagttaaccgttagtaccgttaaaccgtcgttaagttcccgggttaagggtcccgttacccgttagttaccggttacggtttaccgggacgggtaaaccgggtacggttaacggacggaaccgtaaaggtaaccgtaaaccgtaaacggtaacgttcgggttacgtaccggtaacgcccttaaacccggg

SEQ ID NO: 192937 - DNA, 771 bp, Homo sapiens
  misc_feature: GYAE6OF01A90JR.13.59.F04.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagactaccagatgtgacatccagatcgacccagttcctccatccctccctgctgcctactcgtactagggacacgtagtactcctaccgtcgtaccgttcgggaccgggngacgtccacgaacttaactaaacgttacttacgtttacgccgttaggttaacngtaacgaccgaagaccgtacgggaggtactactaacccgttaaattacgtgacgttcgttacgtggtaccgtccgtcgtacgttacggcgtacgggtcccggtactacgttcggtacgttcggaggttagggccggttagtaaccggtacgttaaacggggacctttaaacgttacgtacccgtacctcctaaccctaccgtaacctaacccgtaaccccgaaccttccggaaccgtaacccgtagggtaacgttacgggtttaacgttaggtttaacttccgtaacgttaccgtaacgttaaaccgttacggtaacggttaccgggttaccgtccccgggtacttaacggttaccggggttaaccggttaccggggacggtaaacgggtacccgtaaggtaccgtacgtaaacggtaccggtaaaccgggtactagggtaccgttcgacccgtcgacgttaaccttcg

SEQ ID NO: 192938 - DNA, 746 bp, Homo sapiens
  misc_feature: GYAE6OF01A2YB1.13.59.F04.1.454.CMB.1.raw
  modified_base (325)..(325): a, c, t, g, unknown or other
  misc_feature (325)..(325): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctcgtcggctacccagactaccagtatgtagacatccaagactacgacccctagtcctccactccctccctgtctagcctatctcgtaggacgacgagacttccgaccgtacgtccgttcggacccggggtcacggtacaaccgaacttaacttaaccttaacgtttacgttaacgccgttaggtactacgacgtanaacggaacggaccggagggggaactaaccggttaacccttaaagtttagtcgtactcgtaccgttgccgttccggtcccgtaccgttccgtacgtaccgtaacgggttcccgggtaccctacggttccgttacggtacgtgggtcggacggttggaacgttaaccggtgaaacgtacgtaacgttcctaaaaaccgtcctacctaacctaccgtaccctaacccgtaccctaccgtaccctaccgtaacgtaacgtaacgttacggttacggttaacgtttacgttacgtacgtaccgtacgttacgtacggttacggtcggttccgtaccgtcgtacgttacggtcggtacggtacggtacggtacgtacgagtacgtaacgtaacgtaaccgtacggttacgacgtcgtcgtcgtaccg

SEQ ID NO: 192939 - DNA, 697 bp, Homo sapiens
  misc_feature: GYAE6OF01EWL93.13.59.F04.1.454.CMB.1.raw
  modified_base (211)..(211): a, c, t, g, unknown or other
  misc_feature (211)..(211): n is a, c, g, or t
  modified_base (401)..(401): a, c, t, g, unknown or other
  misc_feature (401)..(401): n is a, c, g, or t
  modified_base (635)..(635): a, c, t, g, unknown or other
  misc_feature (635)..(635): n is a, c, g, or t
  modified_base (677)..(677): a, c, t, g, unknown or other
  misc_feature (677)..(677): n is a, c, g, or t
  modified_base (683)..(683): a, c, t, g, unknown or other
  misc_feature (683)..(683): n is a, c, g, or t
tcagtcacgtactacacgaccggtgctcgatttagtacacacacttagggattggggcagaagtctctctcagtcaggacacagcactggacatgagggtccctgcgtcagctcctgggactcctagctgctctggctcccagataccagatcgtgacactccagactgaccccagtctccactcctaccctgtctgctactctcttgganacagtactccaccgtctacgttcggccggtagactcgacgactaattaacctagttacttacgtcctaggtactcgaagtccgaagtacggccgtaggacggtaaccgttacccgttaaagttaacttcgtaactcgtcgttcgtaccgttcggtcctccgtcttaacgcgtaaccggtccgggtaaccncgttaccgttcggtatcgggcggtcggtaggtctaacggtgtaacgtacgtaacgttctaaccctcgtacctacctacgttaccccaacctacccgtcgttaacccgacccgtaggaacgtttacgtacggtttaaggtaccctttagtaccgttacgactaaccgtccgttaaggcggttcggtaccgtcccgtcttaacggttcggttaccgggacgggtacggtaaccggnggacccgtagtaaacgtaaccaaccgtaacgccggttaacgngtaccnccgtcgtaacccgg

SEQ ID NO: 192940 - DNA, 833 bp, Homo sapiens
  misc_feature: GYAE6OF01C7FUM.13.59.F04.1.454.CMB.1.raw
  modified_base (138)..(138): a, c, t, g, unknown or other
  misc_feature (138)..(138): n is a, c, g, or t
  modified_base (159)..(159): a, c, t, g, unknown or other
  misc_feature (159)..(159): n is a, c, g, or t
tcagtcacgtactacacgaccggtgctcgatttagtacacacacttagggattgggggcagaagtctctctcagtcaggacacagcatggacatgagggtccctgctcagctccgtggactctgctgctctgctccanataccagatgtgacatccganatcgacccagtcctccactccctccctgtctgctacttccttcgttaggacgacgacggtacgtcctaccgtctaccgttcggggcccgggctacgtaccgaacgaaccttaaacttaaacttacgttttacgtttacggtacccgttaggttactacggacgacgtaaggaccggaccgggaaggggtaaccgtaacggtttaaccctttaaaaggttacgttaacggtaccttttccgtcgttacgtcccggttccgtcccggtacctccgtaggtaccgtccgggttaccccggggttcctacgttccgttaaacgggttcgtacggggtcggtaacgggttcggtacgtacgtacggtacgtaacgttatcccgtactaccctacgtaacccgctaacccgtaaccctactaccggtaccctaccgtaggtaacgttagttacggtttaacggtttacgttaacttaccggttacgtaccgttaacgttaacgtttcgggttacggtccggggttccgtacccgtttacggtttaccgttaccgggggttaacccgggggtaaccgggacgggttaaaaccgggttcgggacgtaaaccggtaaccgttaaccgtaaaacggtacccgggttaaacggttcgggtactaaccggtcccggacccttaacg

SEQ ID NO: 192941 - DNA, 685 bp, Homo sapiens
  misc_feature: GYAE6OF01BDUA5.13.59.F04.1.454.CMB.1.raw
  modified_base (160)..(160): a, c, t, g, unknown or other
  misc_feature (160)..(160): n is a, c, g, or t
  modified_base (670)..(670): a, c, t, g, unknown or other
  misc_feature (670)..(670): n is a, c, g, or t
tcagtcacgtactacacgaccggtgctcgatttagtacacacacttagggattgggggcagaagtctctctcagtcaggacacagcatggacatgagggtccctgctcagctccgtgggactcctgctgctcgtggcctcccagactaccagatgtgacntccagatcgaccagtcctccactcctccctgtctgcacttccttcgtacggaagacgagtctaccgtaccgttctacgttcggcccggggtcgacgtaccacgtaactaacttaactactttacttacgccgttaggactcgacgacacgacgacggagggtactaacgttacctaaattgtagtacttcctcgtgtcgtggtacccgtccgtcgtgacgtacgggtccggacctacgttccggttggtcgtagggtcggtcggtggtacttaggacgtacgtaacttctccttactcctacacctacaaccctaacccacgtacgaccctaccgtaataacggtgtttaacggttagtttacggtttactccgtataacgtactacgttagggtcggttacgggtcccttcgaatttcgggttccgggttaccgggggagttaaccgggtaacgtacgggtcaaacggtccgtaaaacgtaccgtaaacgggtacgtcgtaacgggtcncccggttactaaccg

SEQ ID NO: 192942 - DNA, 727 bp, Homo sapiens
  misc_feature: GYAE6OF01BMX50.13.59.F04.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (550)..(550): a, c, t, g, unknown or other
  misc_feature (550)..(550): n is a, c, g, or t
tcagtcacgtactacacgaccggtgctcgatttagtacacacacttagggattgggggcagaagtctctctcagtcaggacacagcatggacatgagggtccctgctcagcctccgtggggcctcctgctcgcttcgtcggcctcccgaggtcgaccgaagtcgttgtcgaccagtcccgagtaccgtccgacccagttccctcctacctcccttcctggtccngactattcgtaggtaggacatagacnccaaccgttccgtacgtcggaccggtanagtaccgaggtactagtaaagtaacgttgtacgttaggcgttagtagaccgtagaaccgaaaacgggaccggaaaccgggacctcccgttaacgtntttaccgtacgtnttaggttcttacgtccgatttacccctaacgtttccgtaaggtacccggtaaccgggttcgtaacctacgtaacgtaggtccgagggcgttacgagggtccgtaggtgtaacgggtaactagttacctcgtaacctcctaactaactacgacgtacgctacgngtacccggctaccgtatgtttaacctacgttactaccgtttaattacgttaccgtaacgtaacacgtaaactctaaaccgtacgttaccgtaccggttaccggtggtaacccggtaacggaaccggtaacggtactaaagggaaactaccgtaacgggagttacggcgttgaacccg

SEQ ID NO: 192943 - DNA, 909 bp, Homo sapiens
  misc_feature: GYAE6OF01EFIGE.13.59.F04.1.454.CMB.1.raw
  modified_base (189)..(189): a, c, t, g, unknown or other
  misc_feature (189)..(189): n is a, c, g, or t
  modified_base (231)..(231): a, c, t, g, unknown or other
  misc_feature (231)..(231): n is a, c, g, or t
tcagtcacgtactacacgaccggtgctcgattttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcngcatctcgttggagacagacgtcaccgtcacgttggccgggngaacgtcgaacgactacttaactactttaattacgaccttaggtatacgagacaagaacgtccggaaggggtaacggtaacgttaacccgtttaaaattttaagtttcggtaactttccggttctttacggtacccgttcggtacccggttccccggttaccgtttaccggtaaaccgtttaaacgggtttaccccgggggggtttacccccgtaacggttttacccgtttaaccgggggttttccggttaaacggggtttcgggggtaccggggttaacgggtaaacgtttacccggttaaaaacgggtaaaccgtaaacggttaaaccgtttaacccgtaccttaaccccgtaacccgttaacctaacccggtaacccctaaaccccgttaacccgttacgtaaccccctaaccggttaacggtaaacggttacgtttaacggggtttaacggttaaagtttttaacgttaacccgtttaacgggtaccgtaaacggttaacggttacggtaacgggtttaccgggtaccggtacccggttaccggtttaaccgtttaacgggttttacccgggaccgggtaaccggggtaaccggtaaacgggtacgtaccggaagtaaacccgtaaacgaaaccggtaacggttaccggtacggtacgtaccgtacctaaccgg

SEQ ID NO: 192944 - DNA, 492 bp, Homo sapiens
  misc_feature: GYAE6OF02FIL3Q.13.59.F04.1.454.CMB.1.raw
tcagtcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacactatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagtttattactgttcagaccctatagtggtgcccgctcattttcggcgagggaccaagggtgcagatcaaacgactgtggctgctaaccg

SEQ ID NO: 192945 - DNA, 506 bp, Homo sapiens
  misc_feature: GYAE6OF02JFZRW.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacacttatttagcctggtatcagcagaagccagggagagtccctaaattattgatctctgctgcgtccgcttgcaagtcgggggtcccatctcggttcagtggcggtgatctaggacagaattcactctcaccatcaccaacctcgccaccctgaagatgttggaagtttattactgtcagtacctagtagtggtcgccgctcgtagtttcggcggagggtaccgaaggtcgacgagatacgaaacgtacgtgtaggctgacaccg

SEQ ID NO: 192946 - DNA, 508 bp, Homo sapiens
  misc_feature: GYAE6OF02HZUMN.13.59.F04.1.454.CMB.1.raw
  modified_base (382)..(382): a, c, t, g, unknown or other
  misc_feature (382)..(382): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagaggtccctaaattattgatctctgctgcgtccgccttgcaatcggggtccatctcggttcagtggcgtggatctaggacagaattcactctcaccatcaccaaccngccaccctgaagatgttggaagtttattactgtcagacctatagtggtggcccgctctattttcgggacggtagggaccgaaggttcgcaaggtactacgaaacgaacgttgtaggctgctaaccg

SEQ ID NO: 192947 - DNA, 492 bp, Homo sapiens
  misc_feature: GYAE6OF02JSXPZ.13.59.F04.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
  modified_base (432)..(432): a, c, t, g, unknown or other
  misc_feature (432)..(432): n is a, c, g, or t
tcagtcacgtactacacgaccggtgctcgatttagtacacacacttaggattgttcagaagtctctctcagtcagacacagcatgacatgaggtccctgctcagctcctggacctcctgctgctctggctcccagataccagatgtgacatccagatgaccccagtctccatccctccctgtctgcatctctgggnacngagtcaccgtcacttgccgggcgagtcacgacattaacacttatttagccttggtatcagcaganccgaggggagatcctaaaattattgatctctgctgcgtccgccttgcaatcgggggtcccatctcggttcaggtggcggtggatctagggacagaattcactctcaccatcaccaacctgcaccctgagatgtggacttatactgtcagacctatagtggtgggcccngtctattttcgggcggagggacccaaagggtgacagatacaaacgactgtggcagcaacc

SEQ ID NO: 192948 - DNA, 496 bp, Homo sapiens
  misc_feature: GYAE6OF02GOS3C.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagtttattactgtcagtacctatagtggtgcccgcttcattttcggcggtagggaccgaaggtgacagatcaaacgactgtggctgctaccg

SEQ ID NO: 192949 - DNA, 515 bp, Homo sapiens
  misc_feature: GYAE6OF02JFYGY.13.59.F04.1.454.CMB.1.raw
  modified_base (225)..(225): a, c, t, g, unknown or other
  misc_feature (225)..(225): n is a, c, g, or t
  modified_base (471)..(471): a, c, t, g, unknown or other
  misc_feature (471)..(471): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacttgccgggnagtcacgacattaacacttatttagcctggtatcagcagaagccagggagagtccctaaattattgatctactgctgcgtccgcttgcaatcggggtcccatctcggttcagtcggcgtgatcgtaggacagatcgactctcaccatcacaacctgcacctgaacatcgttaggattatacttgtctagtactattagtaggtcgacccgtctcaagttttcggccgggtaggtaccgaacgggtntacgagtactacgtaaacgtacgtgtaggaccgttgaccaaccg

SEQ ID NO: 192950 - DNA, 485 bp, Homo sapiens
  misc_feature: GYAE6OF02GO0LU.13.59.F04.1.454.CMB.1.raw
  modified_base (462)..(462): a, c, t, g, unknown or other
  misc_feature (462)..(462): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaatcgggggtcccatctcggttcagtggcgtggatcgtaggacagaattcactctcacatcaccaacctgcaccctgaagatgttggaagttatactgtcagacctatagtgtggcccgctcatttcggcggaggaccgaaggtgacngatcaacgactgtgctgctaccg

SEQ ID NO: 192951 - DNA, 502 bp, Homo sapiens
  misc_feature: GYAE6OF02HBVSW.13.59.F04.1.454.CMB.1.raw
  modified_base (437)..(437): a, c, t, g, unknown or other
  misc_feature (437)..(437): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtcgccttgcaatcgggggtcccatctcggttcagtggcggtgatctaggacagaattcactctcaccattcaccaacctgccaccctgaacgatcgttggaagttattactgtcagacctatagtgtgccgntcatttcggcggtaggaccgtaaggtcgcgtagactcgaaacgtacgtgtaggcttgactacccg

SEQ ID NO: 192952 - DNA, 526 bp, Homo sapiens
  misc_feature: GYAE6OF02IGP7H.13.59.F04.1.454.CMB.1.raw
  modified_base (346)..(346): a, c, t, g, unknown or other
  misc_feature (346)..(346): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgcccgggcgagtcacgacattaacacttatttagcctggtatcagcagaagccagggagacgtaccctaaattattgatctctgctgcgtccgccttgcaagtcgggggtccatctcgttcagtggnggtgatcgtaggacagaattcactctcacatcaccaacctgccaccctgaacgtatcgttagaagttattactgtcaagacctaagttggtggtcggtcccgtctccgtagttttcgggcggagggacccgaagggtgacgtagagtaccaaacgtacgtacgtggactacggctaaccg

SEQ ID NO: 192953 - DNA, 509 bp, Homo sapiens
  misc_feature: GYAE6OF02I6NTX.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccagtctcggttcaggtggcggtggatctaggacagaattcactctcaccatcaccaacctcgaccaccctgaagatgttggaagttatactgtcagacctaatgtggtcgcccgtctctagttttcggcgggagggaccgaagggtgacgagtatacgaacgaacgtgtggctcgctaaccg

SEQ ID NO: 192954 - DNA, 523 bp, Homo sapiens
  misc_feature: GYAE6OF02I077X.13.59.F04.1.454.CMB.1.raw
  modified_base (302)..(302): a, c, t, g, unknown or other
  misc_feature (302)..(302): n is a, c, g, or t
  modified_base (431)..(431): a, c, t, g, unknown or other
  misc_feature (431)..(431): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctctgatctatggtncatccaagtttaaaagtgggtacccatcaaggttcagcggcagtggatcgtggcacagacttcattctcaccatcagcagcctgcacgcctagaagtattttcgactaactttattactgttacctaanaacgtaactcaactaattacttccgtaggtacggttcggaccgaagggtaaccaagggtagaaacgtacgaaacgtacgtaggtagctacgg

SEQ ID NO: 192955 - DNA, 493 bp, Homo sapiens
  misc_feature: GYAE6OF02F1VJM.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcactatcagcagcctgcagcctgaagatatgcaacatattactgtcagcagtatgataatctccatcacctcgaccaagggtaccacgactaggagtaacttaacgaactgtggccttgaccc

SEQ ID NO: 192956 - DNA, 548 bp, Homo sapiens
  misc_feature: GYAE6OF02GZ6MA.13.59.F04.1.454.CMB.1.raw
tcagtcacgtactacacgaccggtgctcgatttagtacacacacttagggattgggggggagaggagcccagcactgggattccgaggtatttccattcggtgatcagcactgaacacagaggactcaccatggagttttggctgagctgggttttccttattactattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtctcttttattatagtagtggtagtacatactcgcagactccgtgaggggccattccaccatcctccagagacaattccaagaacacgtctgtttcttacaaatgaacagcctagagacgccgatcgacacggccgtgtacttacgtgtgcgagagagtcggggcccaacgtacgttacacgctagtcggacgtcgtacggggaccaagggacccg

SEQ ID NO: 192957 - DNA, 492 bp, Homo sapiens
  misc_feature: GYAE6OF02ISL4Y.13.59.F04.1.454.CMB.1.raw
  modified_base (226)..(226): a, c, t, g, unknown or other
  misc_feature (226)..(226): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggnagtcacgacattaacacttatttagcctggtatcagcagaagccagggagagtcccctaaattattgatctctgctgcgtccgccttgcaatcgggggtcccatctcggttcagtggcggtggatctaggacagaattcactctcaccatcaccaacctgcaccctgaagatgttaggaagtttatactgtcagacctatagtgtgccgctcattttcggcggagggtaccgaaggtgcagatacaacgactgtggctgctaaccg

SEQ ID NO: 192958 - DNA, 412 bp, Homo sapiens
  misc_feature: GYAE6OF02GEHIH.13.59.F04.1.454.CMB.1.raw
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (406)..(412): a, c, t, g, unknown or other
  misc_feature (406)..(412): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcaatggtcatcgtctcttcagcctccaccaagggccccatcggtcttccccctggcgccctgctccaggagcacctccgagagcacagcggccctgggctgcctggtcaaggctacttcctagtacgtnactgacgcgggctggcaaggcncatagnnnnnnn

SEQ ID NO: 192959 - DNA, 554 bp, Homo sapiens
  misc_feature: GYAE6OF02H7B91.13.59.F04.1.454.CMB.1.raw
  modified_base (227)..(227): a, c, t, g, unknown or other
  misc_feature (227)..(227): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtcctgcatctcttggagacagagtcaccgtcacttgccgggnagtcaagacattaacacttattagcctggtatcagacagaacgccagggagagtacccttaaatattgatctctgctgcgtccgcttgcatcggggtccatcgtcgtcagtggcggtgatcagacagatcactctcaccgatcaccaactcgaccaccctagaacgtagtacgtttaggaacgtttattaaccttggtacacggtacttagtaacggttggtaccgtccggtcctctaacgttttcgggacgggtaacgggtaacccaaggggttacgacgtacgaagtaacgaaaccgtacgttggtacggcttacggctaacccg

SEQ ID NO: 192960 - DNA, 506 bp, Homo sapiens
  misc_feature: GYAE6OF02IURBT.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcagtcacgacattaacacttattagcctggtatcagcagaagccagggagagtccctaaattattgatctctgctgcgtccgccttgcaatcggggtccatctcggttcagtggcgtgatctaggacagattcactctcacatcaccaacctgccaccctgaagtatacgttagaagttattactgtcagtacctatagtgtcgtccgctctagttttcggcggtacgggaccgaaggttcgacgtagactacgaaacgtactggtggactcgctaacccg

SEQ ID NO: 192961 - DNA, 481 bp, Homo sapiens
  misc_feature: GYAE6OF02JT3NP.13.59.F04.1.454.CMB.1.raw
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (460)..(462): a, c, t, g, unknown or other
  misc_feature (460)..(462): n is a, c, g, or t
  modified_base (465)..(465): a, c, t, g, unknown or other
  misc_feature (465)..(465): n is a, c, g, or t
  modified_base (467)..(481): a, c, t, g, unknown or other
  misc_feature (467)..(481): n is a, c, g, or t
tcagtcacgtactacacgaccggtgctcgatttagtacacacacttaggattgggaaagtactatcatagtggtaccacctactacagcccgtccctcaactagtcgcgtcaccatatcagtggacgagtccaagaaccagttctccctgagcctgacctctgtcgaccgccgcggactccggccctatacttctgtgcgagagntcgagatgtgtcatcggcggggnacttttggatatcgtgggggcctaaggggtcaagtggtcatcgtctgttcagcctccacgaagggcccatcgggttctccccctggcgccctgactccnggacgccaccgtccgagcncgacacggccgggtcccctggggccgtgcccgtgggtccaaagggtccctaacgtttccaacgggttatcggacctggagccgggacctgggaccaagggccgctaaagcgtgnnngtnannnnnnnnnnnnnnn

SEQ ID NO: 192962 - DNA, 508 bp, Homo sapiens
  misc_feature: GYAE6OF02GST23.13.59.F04.1.454.CMB.1.raw
  modified_base (358)..(358): a, c, t, g, unknown or other
  misc_feature (358)..(358): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtccatctcggtcagtggcggtgatctaggcagatnactctcacatcaccaactcgccaccctagacgtatgttgaagtttatactgtcagtacctatagtggtcgtccgctctacgtttcggcgggtacggaccgaaggtcgcgtaagacttacgaacgaacgttgtacggcttacgctaacccg

SEQ ID NO: 192963 - DNA, 504 bp, Homo sapiens
  misc_feature: GYAE6OF02HJ140.13.59.F04.1.454.CMB.1.raw
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcacctgaagatgttggaagtttattactgtcagacctatagtgtggcccgntctatttcggnggtacgggacctaagggngcgagatacgaaacgtaacgtgtacggcttggctaaccg

SEQ ID NO: 192964 - DNA, 536 bp, Homo sapiens
  misc_feature: GYAE6OF02GP6O6.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatcgtaggcagaattcactctcaccactacaccaacctgccaccctgaacgattgttaggtaagtttattacgttgtctacgtacctataggtggtcggcccgtctcgtacgttttccgggcgggtacgggtaccgaagggtcgacgtaggaactacgaaacgacgtggtacggcgtacgctaaccg

SEQ ID NO: 192965 - DNA, 507 bp, Homo sapiens
  misc_feature: GYAE6OF02F03OW.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaatattgatctctgctgcgtcgcttgcaatcgggggtccatctcggttcagtggcggtgatctaggacagaattcactctcacatcaccaactgcaccctgaagatgtggaatttattactgtacagacctagtagtggtcgcccgcttctacgttttcggcggacgggtaccgaagggtcgacgaagactacgaacgtaacgtggtcggactgcctaaccg

SEQ ID NO: 192966 - DNA, 702 bp, Homo sapiens
  misc_feature: GYAE6OF02H03LD.13.59.F04.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccactcctccctgtctgcattctcgttgganacagagtccaccgtcacgttcggccgggntacgtacacgactaacttaactactttattacgcctggtatcgagcagaacgacgagggacgtacgttaccttaattattgtatctcgtgtcgtcgtccgtccgtccgttcgacgtaacggtcccggggtacctacgtccgttacggttcgacggtcgggtcggtagtacgtacgtacggacgtagtaacgttcaccttctacctacctactaccaacctaccctacgtacccgaaccgttaggaaacgttagttacgggttaaggttaaacgtttacgtttaccgtacgttaaccgtaacgttaccgttaaggttacgggttcgggtacccggtcccgttaccgtttacgttacgggtttaccgggaccggggtaacggtaaccggtaagggttacgaacggtaacgtaaccgttaaccgtaaaccggttcgtaccgggttaccggtaccgtacgacccttaacgg

SEQ ID NO: 192967 - DNA, 557 bp, Homo sapiens
  misc_feature: GYAE6OF02JMN68.13.59.F04.1.454.CMB.1.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
tcagtcacgtactacacgaccggtgctcgatttagtacacacacttagggattgggggcagaagtctctctcagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaatgatttagctggtatcagcagaaaccgagggaaacgcccctaagcctcttagatctatggtnctatactaagtttaaaagtcgggtccatactaaggtcagcgacagtgtatcgtggacanagtacttacgattcctcacctatcagcagcctncacgtctagtaagtacttttagaccttaattattactactactacaagtactactaactaattacaccgttagggtacgtaccggaaccggtaacggtaaccgaagggttaacgtaacgttaacctaaaccgggtaacttcggtacggactcggtaacccg

SEQ ID NO: 192968 - DNA, 517 bp, Homo sapiens
  misc_feature: GYAE6OF02H6DH3.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtccatctggttcagtggcggtggatcgtaggacagattcactctcaccatcaccaacctgcaccctgaagatgttagaagttattactgtctagacctagttagtggttacggccgtctactagttttccgcgggtagggtaccgaaggttagcgtaagacgtacaaacgtaacgtgtaggactgcctaaccg

SEQ ID NO: 192969 - DNA, 498 bp, Homo sapiens
  misc_feature: GYAE6OF02G6N2O.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccagggagagtcccgtaaattattgatctctgctgcgtccgccttgcaatcggggtccatctcggttcagtggcggtgatctaggacagatcactctcaccatcaccaacctgccaccctgaagatagttggaagttattactgtacagtacctatagtggtcgcccgctactagtttcggcgagggaccgaaggtagcgagactacgaaacgactgtggactgctaaccg

SEQ ID NO: 192970 - DNA, 537 bp, Homo sapiens
  misc_feature: GYAE6OF02F8A33.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttattagcctggtatcagcagaagccagggagagtccctaaattattgatctctgctgcgtccgccttgcaacgtcggggtcccatctcggttcagtggcggtggatctaggacagaattcactctcaccatccaccaacctcgccacccctgaagattgttaggaagttattactgtacagacctatagtggtcggcccgtctctacgttttcgggcgggtacgggtaaccgtaagggtcgacgaacgagtaccgaaacggtaacttggtacgggtcctacggactaacccg

SEQ ID NO: 192971 - DNA, 556 bp, Homo sapiens
  misc_feature: GYAE6OF02HE6R5.13.59.F04.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcagtcacgacattaacacttatttagcctggtatcagcagaagccagggagagtcccgtaaattacttgatcgtctgctgcgtccgccttgcaatcggggtccatctcggttcagtggcggtgatctaggacagtaagttcactcncaccatacaccaaacctgccaccctagaagacttaggtttcggaaagtttattaccgtgtctaacgtaccttagtaagtggttacggcccgacttcgtagttttccgggacggtacgggacccggtaaaggttcgcgtaacgtagtaacgaaacgtaacgtggtacggcgttcgacttaacccg

SEQ ID NO: 192972 - DNA, 557 bp, Homo sapiens
  misc_feature: GYAE6OF02GQX5C.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtccaccgtcacttgccgggcagtcacgacattaacacttattagcctggtatcagcagaagccgagggagacgtaccctaaattattgatctactgctgcgtccgcttgctacgtcggggtccagtctcggttcagtggcggtgatcgtaggacagtaactcactctacgaccactaccaacctaacctcgaccaccctagaacgtacgttggttacgtaagtttacttacgtgtacgtaacgtaccgttataggttacggtcgtccgtcttacgttcgtttcggacgggacggtaccggaaggtacgacgaagtacgtaaccaagtacgtgtcgtacgtcgaccgtacg

SEQ ID NO: 192973 - DNA, 664 bp, Homo sapiens
  misc_feature: GYAE6OF02IYAWH.13.59.F04.1.454.CMB.1.raw
  modified_base (226)..(226): a, c, t, g, unknown or other
  misc_feature (226)..(226): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgactataacacttattagcctggtatcagcagaagccaggagagtcctaaattattgatctctgctgcgtaccgtcttcgcaacgtcgggggtccctagtcgttacggttcacggtcgggcggtgggtacttacgtaggactaaggaacttacgtaactcctacgacctaatccctaaccaaacccgttcgaccacccttagaacgtattaggtttacggtaagtttattaaccgttagtaccgtaacgtaaccgttaacgttaaggttcggggtacggtaccccggttacgttaccgttaaacgtttttccgggggacgggttaaccggggaacccgttaaaggggttaccgacggtaacggtaaccgtaacggtaaaaaccggttaacgttaccgggttacgggtaccgttacggacccttaaacccgg

SEQ ID NO: 192974 - DNA, 526 bp, Homo sapiens
  misc_feature: GYAE6OF02JGYCT.13.59.F04.1.454.CMB.1.raw
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggaacagagtcaccgtcacttgccgggcagtcacgacattaacacttattagcctggtatcagcagaagccagggagagtccctaaattattagatctctgctgcgtccgccttgcaagtcggggtcccatctcggttcaggtggcggtggatcgtaggacagaacttcactctcaccataccaccacctcgccacccngaagnttgttaggaagttatactgtacagtacctagtaagtggtcggcccgtntctacgttttcggcggacggaccgaaggttcgacgaagtacgtacgaaacgacgtgtacggacttcgaccgtaaccg

SEQ ID NO: 192975 - DNA, 699 bp, Homo sapiens
  misc_feature: GYAE6OF02IV13M.13.59.F04.1.454.CMB.1.raw
  modified_base (202)..(202): a, c, t, g, unknown or other
  misc_feature (202)..(202): n is a, c, g, or t
tcagtcacgtactacacgaccggtgctcgatttagtacacacacttagggattgggcgcagaagtctctctcagtcaggacacagcatggacatgagggtccctgctcagctcctgggactcctgctgctctggctcccagataccagatgtgacatccagatgacccagtctccatccctccctgtctgcatctcttgganacagagtcaccgtcacttggccgggcagtcaggacattaacaactatttaaattggtatcagcaagaaaccaaggtaaacgcccctaagcctcctagatactacgatcgctaatcctaaagtttacggaaaacgtacgggggttacccaagttaccgtaaacggtttcgaaggttacgggaaaggttcggaacgttcgggtagggtaacgtaaggttaacttttttttaacccgttcaaaccccgtaattaccaacggaccgtaacggtcccgtacgtaccgacggttacccgtaggtaaaacgtatttaacgttcgaaacctaaacgttaaagtttactttaaacttcggttaaccgaagtacgttaagttacttaagtaaacttaacgttcccgtaccgttattacccgtaaccgtttaccgggaaccggtaaacggaccctaacggacgtaacggaacgtaacgttaaaacgtacggtagttacggactaccgg

SEQ ID NO: 192976 - DNA, 673 bp, Homo sapiens
  misc_feature: GYAE6OF02IN4TY.13.59.F04.1.454.CMB.1.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagngtcaccgtcacttggccgggngagtcacgacattaacacttattagcctggtatctagacagaacgccgagggagtacgtaccctaaattattgatctctgctgcgtccgccttcgcaacggtccgggggtccctagttccgttcggtttacgaggtcgggtcggttggacgttcgtacggactagtaacttacacgtactaccacccgtaactacccaaccctaacccgttacgaccctacccgtaggtaacgtacgttagggttaacggtaaacgtttactttaacggttagttaccgtaacgttaacccgtttaagttacgggttcgggttaccgggtaccccgtgttaacccgtttacggttttaccggggaccggggtaacgggtacccggtaagggtcggaccgtaaggtacttaaccggaaaccggtacgtcgggtacggccgttacggtacctaacccg

SEQ ID NO: 192977 - DNA, 416 bp, Homo sapiens
  misc_feature: GYAE6OF02IF9PD.13.59.F04.1.454.CMB.1.raw
  modified_base (406)..(416): a, c, t, g, unknown or other
  misc_feature (406)..(416): n is a, c, g, or t
tcagtcacgtactacacgaccggtgctcgatttagtacacacacttagggattggggaaatctatcatagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcaatggtcatcgtctcttcagcctccaccaagggcccatcggtcttccccctggccgccctgctccaggagcacctccgagagcacagccggcctgggctgcctggtcaaggactactcctagtacgtgactgagcgggctggcaagggcgcatagnnnnnnnnnnn

SEQ ID NO: 192978 - DNA, 506 bp, Homo sapiens
  misc_feature: GYAE6OF02H14UX.13.59.F04.1.454.CMB.1.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (440)..(440): a, c, t, g, unknown or other
  misc_feature (440)..(440): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagaggtccctaaattattgatctctgctgcgtccgccttgcaagtcggggtcccatctcggttcagtggcggtgatcgtaggacagaatcactctcaccatcaccaacctncacctgaagnttgttagtaattatactgtacagacctagtagtggtcggcccgntctagttttcggcggtaacgggcgaaggtcgcgagtacacgaacgaacgtgtagcgtagctaaccg

SEQ ID NO: 192979 - DNA, 520 bp, Homo sapiens
  misc_feature: GYAE6OF02GW1SG.13.59.F04.1.454.CMB.1.raw
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttatttagcctggtatcagcagaagccagggagagtccctaaattacttgaatctctgctgcgtccgccttgcaatcgggggtccatctcggttcagtggcgtggatcgtaggacagaatcacgtctcaccatcaccaactgcaccnganatgttgaagttattactgtcagtacctataggtagtcggtacccgcttctacgttttccgggacggtacgggaccaagggtcgcgaacgagtaccaaacgaacgttggtacgcgttcggctaacccg

SEQ ID NO: 192980 - DNA, 606 bp, Homo sapiens
  misc_feature: GYAE6OF02I1OFV.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctggggctcctgctgctctggctctcaggtgccagatgtgacatccagatcgacccagtctccatcctccctgtctgcatctgtaggagacagagtcaccatcacttgccaggcgagtcaggacattaacaacttaatttaaatggtatcagcagaaaccaggtaaacgcccgtaagctcctgatctacgatgctatcctaagtttggaaacacggggtacccatcgtaaggttcaggtggaagtgagtcgtaggacagtacttttacttcactatcgagcagtctcgcacgccgttagaagtatacgttagacctaaacgtattaacgttaccgttagtaacctaaacgttacggtaaccttttaaaggttacccggtttaacccgtaccgtttaccgttaccgggttttaccgggaccgggtaacgggtaaccgtaaaggggtagaacggtaacgtacgaaacggttaacgtggtacggtcgtacgacccg

SEQ ID NO: 192981 - DNA, 569 bp, Homo sapiens
  misc_feature: GYAE6OF02IFH0V.13.59.F04.1.454.CMB.1.raw
  modified_base (225)..(225): a, c, t, g, unknown or other
  misc_feature (225)..(225): n is a, c, g, or t
  modified_base (552)..(552): a, c, t, g, unknown or other
  misc_feature (552)..(552): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctcttggagacagatcaccgtcacttgccggnagtcacgacattaacacttatttagcctggtactcagcagaagccagggagacgtaccttaattattgatctctagtctgccgtccgtccttgactaacgtccgggggtccctagtccgtcggtttacaggtgggcgggtggtatcgtaggacagtaattcgactctccaccgactacaccaaccctgccctacccgagaagtagttcggttagaaacgtttactttacctgttacagtactagttaaggtggtccggcccgtccttcgtacgtttcggcgggtagggtacccgaagggtgacgaagtacgacgaacgtacgtaggnggcttacggctaacccg

SEQ ID NO: 192982 - DNA, 511 bp, Homo sapiens
  misc_feature: GYAE6OF02HGGOU.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatccaccaacctgccaccctgaagatgttaggaagttattactgtcagacctagtagtggtcgcccgctcgtagttttccggcggtagggaccgaaggtcgcgtaagatcgaaggcgaacgtggtcggtctgtaccg

SEQ ID NO: 192983 - DNA, 657 bp, Homo sapiens
  misc_feature: GYAE6OF02HXNVO.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctcgggacgtcctcgctgtctcctggcgtcccacgataccagatgtgacatcacgatagcccacgtctccactcctcccctgtctgcactcttcttaggagacagagtccaccgtcacttcggtccgggcgagtcgacgacacttaactaacttatttagtcctggttatactagctagaacgccgagggaagacgttaccccgtaaatttaagttgaagttcctactcgacgttcgtccggttccgtacccttggacgtaaacggttcccggggggttcccctattccgttccgggtttcgtaggtcgggtcgggtaggacttccgttaggaacagtaacgttccacttcctcctaaccgacctaccaaccctaacctaccgcctaaccctagtaacgtacgttacgttcggtaagttacttacgtgttactacgtaccgttataggtcggtccggtcccgtctacgttcgtttcggcgggtaacggaccggtaaggtcgacgaagtactaacggaactacgtagtcggtactcgactaaccg

SEQ ID NO: 192984 - DNA, 507 bp, Homo sapiens
  misc_feature: GYAE6OF02IUQA4.13.59.F04.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (354)..(354): a, c, t, g, unknown or other
  misc_feature (354)..(354): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctctgganacagagtccaccgtcacgttggccgggnagtcacgacattaacacttatttagcctggtatcagcagaagccagggagacgtaccctaaattattagatctctgctgccgtccgcttcgctaacgtcggggtcccacgtctcggttcgagtcggnggtgatcgtaggacagtaatcactctacacactacaccaacctcgcacctagagtatgtgtaattntactntntacacgtatagtgcgtccgntcgtgtttcggcgtaggacgtaggnganagaactagaacgacgtgtggtctagactaccg

SEQ ID NO: 192985 - DNA, 736 bp, Homo sapiens
  misc_feature: GYAE6OF02F379Z.13.59.F04.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (677)..(677): a, c, t, g, unknown or other
  misc_feature (677)..(677): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgaccagtctcatcctcctgtctgctatctcttgganacagacgtccaccgtnacgttcggccgggtcgacgtccacgactacttaaacgactttaacgtttacgccgttaggttaactcgagccgaagaacggacccgtaaggggaagtacgttacccttaaaagtttacttagtaactctacttaggctggtccgtccggtcctttcgccgtaaacggtcccgggggtccctacgttccgttcgggtttacgagggttcggggtcgggttaggtaacggttcggttaacggtaacgtaaggttaaacgtttccgtaaccgtttccaccgaacccgtaacctaccctaacccgtaacctccgtaacccacccggttacgaacgtagtttacgggttaccgttaaagtttactttaccgttacgtacgtaacgtaccgttaaggttacggttcgggtaccggtcccttacggttgttaccgttttcggggaccgggtacgggaccgttaacgggngtaaccgaaggtaacgttaacgaaacgtacggttaggtccggacgttccaccgtaaccg

SEQ ID NO: 192986 - DNA, 536 bp, Homo sapiens
  misc_feature: GYAE6OF02FUJ38.13.59.F04.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaccgtcacttggccgggcgagtcacgacattaacacttatttagcctggtatcagcagaagccagggagagtaccctaaattattagattctactgctgcgtccgccttgcagtcggggtccagtctcggtcagtcggcgtgatcgtaggacagattcactctcacntccaaccacctcgccacctgaagtatagttaggtaagtttattactgtacagtaccttagtacggtggtcgccctctacgtacgtttcggacggtacgggaccgtaagggtcgacgacgtacgtaccgaaacgtacgtaggtcggtcgtagacctaaccg

SEQ ID NO: 192987 - DNA, 590 bp, Homo sapiens
  misc_feature: GYAE6OF02JQW82.13.59.F04.1.454.CMB.1.raw
  modified_base (226)..(226): a, c, t, g, unknown or other
  misc_feature (226)..(226): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggngagtcacgacattaacacttattagcctggtatctagcagaagccagggagagtccctaaattactgatcgtctgctgccgtccgccttgccgaagtccgggggtcccagtcctcggtttcgaggtggcggtggatcgaggtacagtactcacgtctacaccactccacctaacctcgacctaccctagaaacgtagttagttacggtaaagtttacttacgttacgttacgtaacgtacctaagttacggtcggtacggtcccgtaccgttacgtacgtttaccggcgggtaacgggtaccggtaacggtacgtactacgtaactaccgtaacgtacgtaggtacggtcgtacgacgtaaccg

SEQ ID NO: 192988 - DNA, 561 bp, Homo sapiens
  misc_feature: GYAE6OF02GSTCS.13.59.F04.1.454.CMB.1.raw
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtccaccgtcacttggccgggcagtccacgacattaacacttatttaagcctggtatcagacagaagccagggagacgtacccgtaaattattgatctctgctgccgtccgcttgcaagtcggggccatcgtgtcngtggcgtgatcgaggcagatcnctcncacactacaccgaacctcgacaccctagaaacgattcgtttaggtaaagtttgttaacttacggtctaacggtaccctaagttagtgggtccggtcccgtcttacgtacgttttcgggacggtaccgggaaccgtaaggttcgacgaacgtactaaccgaaacgacgttggtacggtacgtgaccgttaaccc

SEQ ID NO: 192989 - DNA, 789 bp, Homo sapiens
  misc_feature: GYAE6OF02GNIQC.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctccagataccagatgtgacatccagatcgacccagtctccatcctccctgtctgctacttctcgttggaagacagtacgtccaccgtctaacgttcggaccgggcgtacgtaccaacgaactaacttaaacctactttacgtttacgtaccgttaggtactacgaagaccgaagaaacggccggaaggggtaacgtaaccggttaaccctttaaaagttgttacggtacttccgttcgtcgtcgtcggtcccgtaccgtccgttccggacgtaaccggttccgggggtaccctacgttccgttacggtttcgtacgggttcgggtcgggtacgtacgtacggtacggactaagtacgtactaccgtctaccaaccactacccgaacctaaacctccgaaccctacccgttaagtaacgtacgtttaggttaacggttaacgtttaactttacgtaacgttacgtaaccgttaacgtttaacggtacggttcgggtaccggtcccgttacgttaccggttacggttttacccggggacgggttaacggggtaacccgggtaacgggttcccggaacggttaaacggtaccgttaaaccggtaaaccggttacggttacggttacccggtaacggttacccgtacgttaaccccgg

SEQ ID NO: 192990 - DNA, 627 bp, Homo sapiens
  misc_feature: GYAE6OF02IKB8H.13.59.F04.1.454.CMB.1.raw
  modified_base (160)..(160): a, c, t, g, unknown or other
  misc_feature (160)..(160): n is a, c, g, or t
  modified_base (501)..(501): a, c, t, g, unknown or other
  misc_feature (501)..(501): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccgagatgtgacanccgagatcgacccagtctaccactccctccgtgctgctactctcttggacgacagacgttcaccggttcacggttggccgggactagtaccacgtaacctattaaactacttattacgcctaggtaactcgacacgaacgtaagaccgagggacgtaacgtacctaaagttattcgactctgtcgcgtcgtcgtcctcgtcgacgtacggtccgggtccagttccggttacgtctacgggtggccggtagtaccgtagtaaggacctaagtactacgtactctacgactactaccaacgacgtacaccgatacgaagtactagtagtattacacgttatanaccgttactaggtacgtcggtacgcccgtagttaccgtcggttacgggacggtacggtacgtaaacgggctacgacgtaacctaacgtaaaaccgtaggtacgtagggtaccttacgtactaaccg

SEQ ID NO: 192991 - DNA, 545 bp, Homo sapiens
  misc_feature: GYAE6OF02GQS1E.13.59.F04.1.454.CMB.1.raw
  modified_base (225)..(225): a, c, t, g, unknown or other
  misc_feature (225)..(225): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacgtcacttgccgggnagtcacgacattaacacttattagcctggtatcagcagaagccgaggagacgtaccctaaattattgatctctgctcgcgtccgccttgctaagtccggggtcctatcttcggtctaggtggtcggtgatcgtaggacagtattcactctcaccatccacaacctgacccacctagaagtatgttaggtaacgtttatacttcgtctaggtacctagtacggtggttacgcccgtctacgttacgtttcgggaccggagggtaaccggaaggtagcgaacgtactacgaaacgtacgtacgtaggttcgaccgtactacg

SEQ ID NO: 192992 - DNA, 768 bp, Homo sapiens
  misc_feature: GYAE6OF02JR24Z.13.59.F04.1.454.CMB.1.raw
  modified_base (130)..(130): a, c, t, g, unknown or other
  misc_feature (130)..(130): n is a, c, g, or t
  modified_base (146)..(146): a, c, t, g, unknown or other
  misc_feature (146)..(146): n is a, c, g, or t
  modified_base (722)..(722): a, c, t, g, unknown or other
  misc_feature (722)..(722): n is a, c, g, or t
  modified_base (757)..(757): a, c, t, g, unknown or other
  misc_feature (757)..(757): n is a, c, g, or t
tcagtcacgtactacacgaccggtgctcgatttagtacacacacttaggattggggcgagaagtctctctcagtcaggacacagcatggacatgagggtccctgctcagctcctgggactcctgctgctntggctcccagataccngatgtgacatccagactgaccctagtctccatccgtcccttagtctagcattcctcgttggaacgacgtacgagtcccaaccggtcacgttcggaccgggcgtagtccaacgactaacgttaacctacgtttacttaacgccttaggtactacgtacgcgaagaaccggtacgaagggtacggaaccggttacccttaaaattacggttagtaccgttacgttaccgttacgcgttaccggttaccgtcccggtaaccgttcgtaccgtacggttacccgggggtacccttacggtccgtttaccggtttaccgacggtttaccggacgggttacgggttagtacccggttaaagggtacgtaacgttacgttaccgtacctacctcgtaacccgtaccttaccgtaaaccgtaaaccgttccgaccctacccggtaagtaaacccggtagttaccgggttagttaaacgttacgttaaccgtttacgtacgttaacaccggtttaacttcgggtaccggttacccggtcccgtagttaccgttacgtttcgggacgtacggtaccgtaggttacnccgttaaggacttacgtaacgcggttgacgtacgngtaccctaacg

SEQ ID NO: 192993 - DNA, 514 bp, Homo sapiens
  misc_feature: GYAE6OF02IBKPD.13.59.F04.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (433)..(433): a, c, t, g, unknown or other
  misc_feature (433)..(433): n is a, c, g, or t
  modified_base (486)..(486): a, c, t, g, unknown or other
  misc_feature (486)..(486): n is a, c, g, or t
  modified_base (489)..(514): a, c, t, g, unknown or other
  misc_feature (489)..(514): n is a, c, g, or t
tcagtcacgtactacacgaccggtgctcgatttagtacacacacttagggattggggaaagtctatcatagtggtaccacctactacagcccgtccctcaatagtcgcgtcaccatatcagtgacgagtccaagaaccagttctccctgagcctgacctctgtgaccgccgcggactcggccctatacttctgtgcgagagatcgagatgngtcatcggcggggnacttttgatatcgtggggccaagggtgatggtcatcgtctcttcagcctaccaccgaagggccctagtccggtcctttcccccctgggcctacccccttgccctccgaagggcaccaacccgttccggagaacgccacgacgccggttcccgtggggctcggaacccgtcgggtacaacggtacctttagtccccgtttagtacccgngtaaccgtgaacggggcggaaccgtgggacaacgggcgacaagtttgcagccnagnnnnnnnnnnnnnnnnnnnnnnnnnn

SEQ ID NO: 192994 - DNA, 708 bp, Homo sapiens
  misc_feature: GYAE6OF02FGSRP.13.59.F04.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (502)..(502): a, c, t, g, unknown or other
  misc_feature (502)..(502): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatcctnttgganacagagtccaccgtcacgttggcccgggcgagtcgagggcatagaaatgtattaggctggtatcagcaagaaccgagggaaacncccctaagcttatacgattctagtggtgctactaccgtaaagtttaaaacgggtcggggtaccctaagtccgtaagggttccgaaggcccggtacaacgggtggtaacttccggtacgggacctaacgtacgtaacctttactacgtcctaccgaaccctagttaccacgtaccgtaacgtcccgtagaccgtaacgtcccgttagtaaacgtttntttaccggactttaaaccgttttacgtaccggtttacgttacctaaaacgtaacgttaaccttaccaaaacggttaactttaccgtaccggtttacggggtacccgttaaccgggtaacccggtaaaccgggtaccggttaaaggggtaacaaaaccgttaccggaaaaacgttaccggtggttaccggtaccgttcgaaaccccg

SEQ ID NO: 192995 - DNA, 710 bp, Homo sapiens
  misc_feature: GYAE6OF02HVDRG.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagactcaccgtcacgttcggccggcgagtccacgactaacttaacaactttattacgcctggtactcagcaagaacgccgaaggggacgtacgttacccttaaaattattagtaacttctcttacgcgtgtccggttccgtccgtttagacgtaacggtccgggggttaccctacttccggttacggtttcgtacggtcggggtcgggttggtacgtacggtaacggtaacgtaacggttaactttccgtacttcccttaccaacccgtactacccaaccctaaacccgtccgaccctaaccgtagtaacggtacttacgggttttaagggttaaacgttttacttacgtttacgtcgtaaaccgtacccgtttaagttacgggttacgggttccggtaccccgtcgtactttacgggtttcgggacggtaacgggaacccggtagggttcggacgtagtaaccgtaaccgaacggttacggtggtacgtacgtacggacctaaccg

SEQ ID NO: 192996 - DNA, 673 bp, Homo sapiens
  misc_feature: GYAE6OF02H5USR.13.59.F04.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccagatgtcgacatccagatcgaccctagtcctccactcctccctgtctgcattctcgttgganacgagacgtcaccgtcacgttcggaccgggngtacgtcacgactaatactacttattagctgtactcgagcgagaacgtccgaggtactagtaccttaaagttctagactctntgcgttcgccgtccgtctcgcgtaacggtccgggtaccacgttccgtacgttccgaggtgggtaccgtagtcgttaacgtaggaactagtacttcgactccgacctacgtacaccaactacgtaccgacctacgtacggtaagttagtcgttaacggttaaactttcgttaccgttacgttacccgtaaacgttaccgtaaacgttcggtccggttacccggttacccgtacgtttaccgttaaccggtttccggggaacggggtaaccgtaacggtaacgggtacgaacgtactaaacgtaaaccgtaacggttaacgttcgggtacgttacgaccgtacgttaacccg

SEQ ID NO: 192997 - DNA, 579 bp, Homo sapiens
  misc_feature: GYAE6OF02HGOKY.13.59.F04.1.454.CMB.1.raw
  modified_base (201)..(201): a, c, t, g, unknown or other
  misc_feature (201)..(201): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttgganacagagtcaaccgtcacgttcggccgggcgacgtccaacgacaacttaacactttattacgcctggtatcagcgaagaacgccgagggacgaggtaccctaaattattgatctctgtctcgtcgtcgccttgcaacgtcggggtccatcgtcgtcgagtcggcggtgatcgtagacagtaactctactctacactactaccaccaacctcgaccaccctacgaacgtagttagttagggtaatttacgtcttacgtactacgtactattaggtcggtcgtcccgtcgtcgtacgttttcgggacggtaacgggaccgtaagggtcgactaaggtaacgtacgaaacgtaccgtaggtcggtacgtacgacctaacccg

SEQ ID NO: 192998 - DNA, 735 bp, Homo sapiens
  misc_feature: GYAE6OF02HR1V7.13.59.F04.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatcctccctgtctgacntctcttggagacagagtcaccgtcacttcggccggngtacgtcacgacattaactattacttagtctggtatcagcagaagccgagggacgacgtacccttaaaatttattagtactcttcgtcgtacttcgggtccgttcccgtccgttcggaccgtaaacggttccccggggggtaccctaacgttcccggtttccggtttaccggtacgggtttcggggtacggggttacggtacggttacggtaaacggtaacgtaagtaacgtttaccgtaccttcccgttaaccacccctaactacccgaaaccctaacccggtaccgtaaccccgtaaccgtaacggttaacgtaggttacgggttttaaggggttaaacgttttaacgtttaaccgtttacgggttaacctaacggttaaccgttaacgttcggttacggggttccggtacccggtcttaccgtcgggttttccgggacgggtacgggaccggtacggtacgacaaggactacgaacgtaggtcggttggcgtcgaccgtaacg

SEQ ID NO: 192999 - DNA, 700 bp, Homo sapiens
  misc_feature: GYAE6OF02JCSRO.13.59.F04.1.454.CMB.1.raw
tcagtcacgtactacacgaccggtgctcgatttagtacacacacttagggattgggggcgagaagtctctctcagtcaggacacagcatggacatgagggtccctgctcagctcctgggactcctgctgctctggcctcccagataccagatgtgacatccagatgacccagtctccatccctccctgtctacgctacttctcgttggagacagtacgtccaccgtcacttggccggcagtccacgacattaacacttattagcctggtatcagtacagtaagccgtaagggagtacgtacccgttaaattacttagactctctacgctcgtccgtccgtccgttagacgtacgtccgggggtccctaagtcccgttacggttaccgtaggtcgggtcgggtacggtactttccggtaaggtacgaacgttaacgttaccgtaccttacctccgtaacctacgtacctaacccgtaacctaccgaccctaacccgtacgaaacgtagttacggttacggtaacgtttaacttacgttacgttaccgtacgtaacctaacggttacgtaacgggttccgtaacccgtccgttaaccgttacgtttttccgggacgggttaacgggtaccggtaacgggtcggtacgtacggtaacgtaacgtaacggtaacgtacggtacggtccgtacggtacctaaccg

SEQ ID NO: 193000 - DNA, 617 bp, Homo sapiens
  misc_feature: GYAE6OF02JLYHH.13.59.F04.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatccctccctgtctgcatctnttgganacagacgtcaccgtcacgttcggccgggntagtcaacgactattaactacttatttacgcttggtatcgagacagaacnccgaggagacgtacctaattatagatctctgtctcgccgtccgtctacgcgtacggtccggggtacctagttccgttcggtcgtaggtcggtcggtcgtagtcggtaacgtactaagtactacactcctacgacctactaccaaccctacgtacgaccctaaccgtagtaacgtacgttagttacgttaagttacttacgtacgtacacgttaccgtagttacgtcgggtaccgtccgtcttacgttggttaccgggcggtaacgggtacgtaaggtacgacgtaacgtaacgttaaccgaacgttcggtaggtccggtactaccggacctaaccg

SEQ ID NO: 193001 - DNA, 751 bp, Homo sapiens
  misc_feature: GYAE6OF02GTT8A.13.59.F04.1.454.CMB.1.raw
  modified_base (228)..(228): a, c, t, g, unknown or other
  misc_feature (228)..(228): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgaccctagtctccatcctccctgtcctgcatctcttggagacagatcaccgtcacgttgccgggntagtccgacacattaacactttaattacgcctaggtatcgtagcagaagccgaggacgacgtaccctaaattatgattctctagcgtgtccgtaccgtccttcgacctaacgttccgggggtcctacgtcgttcggtttcgaagggttcggtcggggttacggtacgttaccgtaacgggtaaccgtaaggtaacgtttaccgtacccgttacgtttacccaacccggtaactaccccaaacccgtaaccctaccggtacccgaaccccgttaaggtaacgtacgtttaacgggtttacggttaaacggtttatttaaaccggtcgttaccgtaacgtaaccgtttaacggttacggttacgggttcccgggaccccggttacgtttacccgtttaacgggtttcccgggtacggggttaaccgggtacccggtaaagggttaccgacgggttaacggtaaaccttacggtaaaaaccggttcgttaaccggtttgggtaaccgttccggaacgttaaccccg

SEQ ID NO: 193002 - DNA, 795 bp, Homo sapiens
  misc_feature: GYAE6OF02IN8PV.13.59.F04.1.454.CMB.1.raw
  modified_base (758)..(758): a, c, t, g, unknown or other
  misc_feature (758)..(758): n is a, c, g, or t
tcagtcacgtactacacgaccggtgctcgattttagtacacacacttagggattgggggggcagaagtctctctcagtcaggacacagcatggacatgaggggtcccctgctacagtcctccggtgggacctccgtcgtctgtcgtctcggacgtcccgagaataccgagaactgtcgacatccgacgactcgaccctatcctcctattcccttcctgtcttcgctacgtctacgtaggaactacagtactacctaccgttcgtaccggttcggaccgggtacgtaacgtacaacgttaacgttaatttaaacctttaatttaagttacgccgtaggtacaacgaacggacgaaacgaacccgtacgaacgggtacttaacggtaaccctttaaattcgttacggacttacctgttaccgacgtttcgaccggttaaccggtcgtaccgaacgttaacgggttcccggggtaacctaggttaccggttcggttacggtagggttacgggtacgggttaggtacttaacggtaacggttaacctaacggtttaaacttcccgtaacgttaccttaaccgaaaccctaccgtaaaccctaacccgtaaccttaccggaaccgttaaccgtaacggttaacgtaacgttacggttttaacgtaactttaacgtacgttacgtaacgttaacgttaccgtagttaacggtcggtaccgtaccgtcgtaacgttacggttacgacggtacgacgtagtacganacgtacgtacgacgtacgcgtacgtctacgtactacg

SEQ ID NO: 193003 - DNA, 671 bp, Homo sapiens
  misc_feature: GYAE6OF02GS1DM.13.59.F04.1.454.CMB.1.raw
  modified_base (515)..(515): a, c, t, g, unknown or other
  misc_feature (515)..(515): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcatctcttggacaccagactccaaccgtcaccttggcccgggagagttccgaacgacctattaaacctactttaacgtttacggccttcggtattcccgaagccgaaggaacgacccggaagggggtacgtacgtacccctttaaaattctttagaactttcctcgtcgtctcgtaccgttccgtccttgaccgtaacggtccggggtccacgttccgttcgtacgacggtcggacggtcgtacgtacgtacgtaactagtacttacctacgtccctaccgaacctacttacccaacctacggtacaccgtaccgtagaacgtntaggttactaagttctatcgttacaacttacgtagttcggtcggtccgaccgttcttacgttacgggttaccgacggggtaacggtaccggtagtacggaccgtacgtaaccgtaaacgacggttaacgacggttacggcccttacggactacccg

SEQ ID NO: 193004 - DNA, 772 bp, Homo sapiens
  misc_feature: GYAE6OF02FK89N.13.59.F04.1.454.CMB.1.raw
  modified_base (228)..(228): a, c, t, g, unknown or other
  misc_feature (228)..(228): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcacccgtcacttggccgggngagtcacgacattaacacttatttagcctggtatcagcagaagccagggagacgtacctaaattattgatctctgctgccgtccgtccttcgacgtaacgtccgggggtccctacgtccgttcggttcgacggttcggggtcgggtacgggtaacgttcggtaacgggtacgtaaacgggtaacttttaccgtaccttaccgtaccctaaccctactaacccctaaacccgtaacccgttccggtacccctaacccccgttaacggaaacggtacgtttaacgggttttaacggggttaaacttttaacgttttaaccgttacggtttaaccgaaccggttaaccctttaacgttaaacgggtttcggggttcccgggtacccgttcccgttaccggtttaaccgggtttttcccggggaccggggtaacgggggtaaccccggtaaacggggttacggtacccggtaaacgtaaccgtaaaccggaaaccggttaacgggttaccgggttacgggtacccgtttacgggacccttaaccccgg

SEQ ID NO: 193005 - DNA, 797 bp, Homo sapiens
  misc_feature: GYAE6OF02GG6VN.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctctacaggtgccagatggtgacatccagatcgacccagtcctccagtcctccctgtctagcattctggtaaggcgacagacgtccacctatccagttcggacccgggactaaggtccgagggtaccaagtttaacggaaatggtaagttttacggacttagggttactacaggtaccgtaaaacggaaaaccggtaaggggaaacccgtaccccgtaaaggtccttacgttaggacttacgttaacgttgggtacgtactacgttaccgttaaaaggtttaaaacggtccggggtaccctaagtaccgttaacgggttacaagggtcggacgtaaggtacggtactcggttaccgggactaccgaagttaaccttcgtacgttccgtacctaaccgaattccgaacgtcgtaaccgtcgtaacgtacggtaccgtaccgttaggtaaaccgttttacgtttaacgccgtttaaaacctttacgtttaaaccgtcgttaacctaaacggtaaacttaccgttaactaaactttaacgttcctaacgggttacccgggtaacgggtttaccaacccggggtaaacgggttacccggtaaaaggggttaccggtaaaacccttaacgggtaaacccgtaacgggttacggtacggtaaaccccgg

SEQ ID NO: 193006 - DNA, 804 bp, Homo sapiens
  misc_feature: GYAE6OF02IVKWJ.13.59.F04.1.454.CMB.1.raw
tcagtcacgtactacacgaccggtgctcgatttagtacacacacttagggattgggggcagaagtctctctcagtcaggacacagcatggacatgagggtccctgctcagctccgtgggactcctgctgctctggcctcccagactaccagatgtgacatccagatcgaacccagtcctccattccctcccgtgtcctagcacttcgtccgttagggacacaggtacgttcaccgttcacgttcggcccgggagagtcgaacactaattaactactttattacgctacgtaatcagtacaagaagaccgaggacgtaacgtaccgtaaattagtgacgttactcttgacgtcgtcgtccccgtcttacgacgtaccggtacccggggttcctaacgttcggttacggttacgtacggttcgggtacgggttacgtacgttacgtacgggaaacgtaacggtacgtttacctaccgttacctaccgtaaccctaacctaccgtaaacccctaaaccgttcgaaccccgttacccgtaacggtaaggtacgggttttacggttaaggttaaaccggttttaatttaaacccggtttactaaccgttaaaccgtaaccgtttaaaggttaccgggttaccgggttacccggtacccgtttacgtttaacccggtttacgggtttacccggggaaccggggtaaccgggtaaaccccgggttaacggtaccggtaaccggtaacgttaaaccgtaacccggttaaacggtacgggttcggttacggtaccgtaccggtaccctaaccg

SEQ ID NO: 193007 - DNA, 723 bp, Homo sapiens
  misc_feature: GYAE6OF02G3PTF.13.59.F04.1.454.CMB.1.raw
  modified_base (159)..(159): a, c, t, g, unknown or other
  misc_feature (159)..(159): n is a, c, g, or t
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
tcagtcacgtactacacgaccggtgctcgatttagtacacacacttagggattgggggcagaagtctctctcacgtcaggacacagcatggacatgagggtccctgctcagctcctgggactcctgctgctcgtggcctcccagactaccagtactgtnacatcccagatcggacccagtcctccactccctcccgtgtctgcncttcgtgtaggatcagtacgcaccgtcactggccggagcgtcaacgactaattaacctactttagttacggtcctaggttatcacggacaaggaacnccgggaagggtcaaccggttacccttaaaattcttaggtaattccttcgtcggcttcgtccggtcccgcgtttacgcgtaacggtccgggtcccngttcccgtagttcagggtccgggnggtacgagttaccgaagggactaaggtaacttccgttctaccctacttcaacttaccctaccgtaaccctaaccggtccctaacccgtacccgttaagtaaccggttagttagggtttaaccgtttaaggtttaactacgttatacccgttaaacgtaaccttaggttacgggtccgtccgggtccggtcctttaacggttcccgggtttagggacccggggtaacgggtaaccgtaaacggggtcgtaacgaggtttaacccgacggtaacccggtaagtccgggaggttaccacgtacccg

SEQ ID NO: 193008 - DNA, 707 bp, Homo sapiens
  misc_feature: GYAE6OF02GLU2P.13.59.F04.1.454.CMB.1.raw
  modified_base (159)..(159): a, c, t, g, unknown or other
  misc_feature (159)..(159): n is a, c, g, or t
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (403)..(403): a, c, t, g, unknown or other
  misc_feature (403)..(403): n is a, c, g, or t
  modified_base (562)..(562): a, c, t, g, unknown or other
  misc_feature (562)..(562): n is a, c, g, or t
  modified_base (600)..(600): a, c, t, g, unknown or other
  misc_feature (600)..(600): n is a, c, g, or t
tcagtcacgtactacacgaccggtgctcgatttagtacacacacttagggattgggggcagaagtctctctcagtcaggacacagcatggacatgagggtccctgcctcagctcctgggactcctgctgctctggcctcccagataccagatgtgaacntccagntcgacccagttccnccagtccctccctgtcctagcctatctcgttgggaacacaggtactccaaccgtctacgttcggccgggatacgtccaacgactaacttaaccgtactttattaacgccgttaggtatacgagcacggaacgcgaaggacgtaccgttaacctaaatttactagtatccttcgtcgactcggccgttaccgtccttcgaccgtacggttcccggggtaaccctnttccggttcggttacgtcgggttcgggtccggtagggtacgtacgtaaggtaccaaagttaacttccctactacctaccctaacgacctacccgaaacccgtaaccgccttacccgacctttacgggaacgtttaacgttgggtttaacggtaactttntacgtcggtaactacgtacgtacgttaggtcgggtccnccgtacgttcgttacggttccgggagggtaaccggaccggtaaggtaccacgttaacgacggtaaccaacggtacgttaccggcgggtctaccggtaccctaaccgg

SEQ ID NO: 193009 - DNA, 712 bp, Homo sapiens
  misc_feature: GYAE6OF02JAQO0.13.59.F04.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagactgacccagtcctccattcctccctgtctgcattctcttgganacngtagtccaccgtcacttcggccgggcgagtccacgacattaaacctacttattttagccgtaggtattaccagactacggaaacgtcccgaagggggacgtaacgttaccccttaaaagtttattaggaacttctacttgtccctaggtccggtcccgtccgtttacggaccgtaacggttcccggggggtaccctaacgttccgttaccgggtttacgacgggtttcggggtaccgggttggggtaacttacggtaacggtaaccaaggtaacctttaccgaacctttacctacgaaccctactaccgaacctaccgtcgaccctacccgtagaaacgtattcggttagtaacgttacttactgttacgacgtaccgtacgtaaggtcgggttacgtacccgtcttaccgtgttttaccgggcgggttaacggtaaccgaagggttccacgtaagtaacgttaaccgaaacgtacggttagttcgggtacctcgacctaaccg

SEQ ID NO: 193010 - DNA, 702 bp, Homo sapiens
  misc_feature: GYAE6OF02FF8TQ.13.59.F04.1.454.CMB.1.raw
  modified_base (215)..(215): a, c, t, g, unknown or other
  misc_feature (215)..(215): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagcagagtccaccgtnacttgccggcgagtcatgacattacacttattagcctggtatcagcagaagccgagggagagtcctaaattctgtaatctctgctgtccgtccgccttcgcgaacgtccgggggtaccctagttccgtcggttaccgaaggtcgggtcgggtacgggtacttacggttaagggacaacggtaactttaccgaccttccgtcgtaaacccctacgtaccctaaaccccgtaaacccttaccggaacctaccccgttaaggaacgttaacgtttacggtaggggtttaaaacgtttttaacgtttaaacggtttcgttaacccgtacgggttaaccccttaaggtttaacggttccggggttaccgggtaccccgtacgtttacccgttacggtttttccggggaaccgggtacggggtaaacccgtaggggtacgtacggtaacgaacgttacgaaaccgtaacgtgggtacgtcgtacgtaaccccg

SEQ ID NO: 193011 - DNA, 901 bp, Homo sapiens
  misc_feature: GYAE6OF02FXX4D.13.59.F04.1.454.CMB.1.raw
  modified_base (199)..(199): a, c, t, g, unknown or other
  misc_feature (199)..(199): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctctgganacagacgtccaccgtcacttggccgggacgacgtcaacgactaattaacactttatttacgcctaggtatcagcacgaacgcccgaggggacgaacggttaccctaaaatttacgttaggtaacttccttcgttacggtcttcggtaccggttaccccggtccctttacggacctaaaccgggttcccgggggggttacccctaacggttccgttaccggggtttacgtaacgggttcgggtaccgggggttagggtacgttaccggtaacgggtaaccgtaagggttaaaccttttccggtaaaccctttacccgttaacccgaaacccgttaacttaccccggtaaaacccctaaacccggttaccggtaacccctaacccccggttaaggtaaaccggtaagttttacggggtttaaacgggttaaaacgtttttaacggtttaacccggtttacgttaaccggtaaacggttaaccccgtttaaggttaaacggggtttccggggtttaacccgggcccccgttaaccggttttacccgtttaaccgggttttttacccgggggtacccgggggttaaccggggtaaacccgggttaacggggttaccggtaaccgggtaacggttaaccgttaaacccggaaacggttaaccgggttacgggtaccgggtaccggtttaccgggaccttaaccccgg

SEQ ID NO: 193012 - DNA, 726 bp, Homo sapiens
  misc_feature: GYAE6OF02GW10H.13.59.F04.1.454.CMB.1.raw
  modified_base (202)..(202): a, c, t, g, unknown or other
  misc_feature (202)..(202): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatcctccctgtctgcatctcttgganacagacgtcaccgtcacgttggccgggcgagtcacgactattaactacttattagcctggtatcagcagacaccgagggagacgtacccttaaattagttgatctctgcgttcgtccggtccgtccgttcgacgtaacggtcccgggggtaccctagtttcccgttccgggtttacgacgggtttacggggtccggggttaggtacgttaccggttaaacggggaccgtaacggttaaaccgtttcctaaaccgtttcctacccgaaccctacttacccaacccctaaccgttccgacccgtaaccccgtaggtaacgtagtttacggttaaggttaacgttttagttacgttcggtacgtaaccgttaccttagttacgggttcgggtccgggttcccgttcgttccgtttacggtttaccggggaccgggttaacgggaccggttaagggcgtacggtaacgtaaccgttaacccggtaaacgtacggttacgggttaggaccgtcggtacccttaacccgg

SEQ ID NO: 193013 - DNA, 626 bp, Homo sapiens
  misc_feature: GYAE6OF02JC5A7.13.59.F04.1.454.CMB.1.raw
  modified_base (547)..(547): a, c, t, g, unknown or other
  misc_feature (547)..(547): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccagatgtgacatccagatcgaccctagtctccatcctccctgtcctgcattctcgttggagtacagacgtccaccgtctacgttcggccgggcgacgtcacgactattaacacttattacgctaggtatcagacagacgcgaagggacgtacgtacctaaagttgtagtatctctcgctcgccgtaccgtcgttacgacgtaacggtccgggggtaccctacgttcggttccggtttacgcgggtcgggtacgggtggtaacgttcggtaacgggtaactaaggttaactactaccgtctactaaccgacttaccgaaccctacctacgaccaccgtagaagtcttaggtaacgtacgttattacgtgtacgtaatacctagtggtacggtcgacccgtntacgtgtttccgggagggtacggtacgtaaggtcgacgaacgtacgtaaatacggtacgtggtcgtactagacctacgg

SEQ ID NO: 193014 - DNA, 760 bp, Homo sapiens
  misc_feature: GYAE6OF02FK1CN.13.59.F04.1.454.CMB.1.raw
tcagtcacgtactacacgaccggtgctcgatttagtacacacacttagggattgggggcagaagtctctctcagtcaggacacagcatggacatgaggtccctgctcagctcctgggactcctgctgctctggctcccagataccagatgtgacatccagatcgacccagtctccactccctccctgtctgcacttcgtctggagacagacgtccaccgtcgacgttcggccgggctacgtcaacgactaacttaacctactttactttacgccttaggttactacgacgaccgtaaggaacgaccgaaggggacttacggttaaccttaaaagttgttagactttccgtactcggtcgttccgtcccggttacccgttccgttacggaaccgttaaccggggttcccggggttaccctagtttaccccggtttacgggttacctaacggggtttccgggtcgggtttacggtaacgttaccggttaacggaaccgtaacggttaactttcccggaaacttccctaccgaacctacctacccgtaaaccctacctcggacccacgttagtaacgtagtttacgtaagttaacgtttactacggttactaccgtaacttacgttaagttcgggttacgtccgtacccgttacgttcgtttaacgtttccggggacgggtaaccggtaaccggttaaggtaccgtagtaacggtacctaaccggttaacgtccgttacggtacggtctacggtaccctaccg

SEQ ID NO: 193015 - DNA, 631 bp, Homo sapiens
  misc_feature: GYAE6OF02FL49V.13.59.F04.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (436)..(436): a, c, t, g, unknown or other
  misc_feature (436)..(436): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctccatccctccctgtctgcatctcttgganacagagtccaccgtcacgttcggccgggcgacgtaccacgaacaattaacactttaactttagccttggtatcagcagagccgaagggngagtaccctaaagttacttgacttcgtctgctgcggtcccgtccgttgtaccgaacggttccgggggtccagttccgttcggttcgacggttcgggtcggtcgtacgtcggtaaggacctagtaacgttcactccgtctaaccnctacccgtaacccaaccgtacgaccctaccgtagaaacgttgttacggttaggttaaagtttacttacgttacgtactacgtaccttaggttacggtacggttcgcccgttacgtcgttacgtttcggggacggacggtaccgtaaggtcgtacgagtactaacggaacgtagttaggcggcgttcgacctaccg

SEQ ID NO: 193016 - DNA, 768 bp, Homo sapiens
  misc_feature: GYAE6OF02I91D1.13.59.F04.1.454.CMB.1.raw
  modified_base (408)..(408): a, c, t, g, unknown or other
  misc_feature (408)..(408): n is a, c, g, or t
tcagtcacgtactacacgaccggtgctcgatttagtacacacacttagggattgggggcagaagtctctctcagtcaggacacagcatggacatgagggtccctgctcagctccgtgggactcctgctgctctggctcccagataccagatgtgacatccagatgacccagtcctccactcctccctgtctgcattcttcgttgggaacgacagtagtccacccgtcacgttcggccgggcgagtcacgactattaaacacgtttatttagccttaggtctcgagcgaagaacgcggaggggacgtacgttaccttaaatttgttagtactcttcgtcggcttcggtcctccggtcccttggaccgtaaccgggtcccgggggtcccttacgtccgttaccgggtttnacggggttcgggtcgggttaggtacgtacggtaagggaaactaggttaaccttcctaaccttccctaccgtaaccctactacccctaaaccctacccgtacaacccctacccgtaaggtaagtactttaggggttaaacgttaaagtttttaccgtacgttacgggtacctaaaccgtttaccgttaagtttacggggttccgggtacccggttcccggttaccgtttaccgttttaacccggggttttaccggggacgggggtaaacggggacccggttaacggggtactaaccggggacgtaaacttaacggtaaaaccgtacgggtttaggccggttacccgtcggaacccttacgg

SEQ ID NO: 193017 - DNA, 550 bp, Homo sapiens
  misc_feature: GYAE6OF02GC0DG.13.59.F04.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (381)..(381): a, c, t, g, unknown or other
  misc_feature (381)..(381): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtcctcatccctccctgtctgctatctcgttgganacagatccaccgtcacttggcccgggnagtcacgacattacacttattacgctggtatcagcagaanccgagggtagacgtacctaattatgactctctgctgccgtccgcttgcctacgtccggggtcctagtccgtcggtcaggtggcggtgtactcgtagacagtactcactcnccacataccaccactcaccaccgtagaagtacgtagttaggtaacttatcgtagtactacgacttagttaggtcgttcggcctcgttacgtcgtttcgggacggtacgggacgtaggtacggtacgacgtaataaccgaacgtacgttggtcggcgtacgacgtaaccg

SEQ ID NO: 193018 - DNA, 770 bp, Homo sapiens
  misc_feature: GYAE6OF02GST26.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgactctggctccagataccagatgtgacatccagactgacccagtcctccacttcccgtccctagtctgactattccttcgttggaacactaacggtacgtacccgaccgttctacgttcgggccgggtacgtacgtccaacggactaactttaaaccgtaccttttaagtttaacgtcccgttaggttaacgttaccacggaccgtaaacggaaacgcccggtaaagggggacgtaaccggttaaccccttaaaagtttagttacgaacttccgtctagtccgttcggtccgttcccgttaccgtttaggaccgtaaacgggttcccgggggtaccttacggttccgttacggttacccgaggttcggggacggtaggtactacggtaggaacgtagtacttcgaccttcgacctaactactacccgacctaccgtcgaccctacccgtaggaactacggttaggttagtaacgtttagttacctcggtacctaagtaccgttagttcggtcgggtaccgtccgttacgttacgttcgggtttacggaccggggtaacgtaccggttaacggtacgacggtaacctaacgtttaacccggaaacgttccggtaggtacccgtacggttccgaacccttacgg

SEQ ID NO: 193019 - DNA, 637 bp, Homo sapiens
  misc_feature: GYAE6OF02GRU44.13.59.F04.1.454.CMB.1.raw
  modified_base (189)..(189): a, c, t, g, unknown or other
  misc_feature (189)..(189): n is a, c, g, or t
  modified_base (278)..(278): a, c, t, g, unknown or other
  misc_feature (278)..(278): n is a, c, g, or t
  modified_base (370)..(370): a, c, t, g, unknown or other
  misc_feature (370)..(370): n is a, c, g, or t
  modified_base (552)..(552): a, c, t, g, unknown or other
  misc_feature (552)..(552): n is a, c, g, or t
  modified_base (584)..(584): a, c, t, g, unknown or other
  misc_feature (584)..(584): n is a, c, g, or t
  modified_base (630)..(630): a, c, t, g, unknown or other
  misc_feature (630)..(630): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatgacccagtctcatccctcctgtctncatctcgttggagaccagagtccgacgtcacttcggccgggcgacgtcaacgactaattaacctatttacttagccttaggtatcaganacgaacgccgagggacgacgtaccctaattacttgatctctgtctcgtcgtccgccttcgccgtaagtccgggtccagttccgttccggttnaggttggcggtgtgcgtaaggactaaggtacttcgtacctcctaccgaccctacgtaaccctaacccaccgtaccgaccctaacccggtaggttaaaccgtgttacggttagttaaacggttttagtaccgttgtacccgtaagtaccgtttaacgtagggttccgggtaccgtccccggtnttacggtttcgttcggggccggacggtaacgnggtacgtacgacgtaaccgacaacggtacgtcggtacgtcgtaccnctaaccg

SEQ ID NO: 193020 - DNA, 666 bp, Homo sapiens
  misc_feature: GYAE6OF02FZ149.13.59.F04.1.454.CMB.1.raw
  modified_base (131)..(131): a, c, t, g, unknown or other
  misc_feature (131)..(131): n is a, c, g, or t
  modified_base (163)..(163): a, c, t, g, unknown or other
  misc_feature (163)..(163): n is a, c, g, or t
  modified_base (415)..(415): a, c, t, g, unknown or other
  misc_feature (415)..(415): n is a, c, g, or t
  modified_base (659)..(659): a, c, t, g, unknown or other
  misc_feature (659)..(659): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctntggctcccagactaccagatgtgacatccagntcgacccagtctccactcctcccgtgtctacgctatcctcttcgggaacaccaggacgtaccaccgtctacttcggcccgggatacgtcaccgtactaataacctacttattacgccgttgtaactcgtagctaaagacgaccgagggagtacgtaaccttaaattagtcgtactctacgtgtcgtcggtaccgttcctccgttacgtacgtaacggtttcccggggacctacggttcgttccgggttaacngggttcgggaggttacgtacgttaaccggtagggactaaacggtactttacgactccttaccgacaacttcccaacacctcgacctccgagtaacgtattaggttacgtaactttcgttacgtacgtacagttaccgtaagtacgttcggacccgtccgttacgttcgtaccgggtttcggcggggaaccgtcggtacgagtaccgtagaaccttaacggtaaccgtagtcggtacgtcgtacncgtaacc

SEQ ID NO: 193021 - DNA, 739 bp, Homo sapiens
  misc_feature: GYAE6OF02JMRP2.13.59.F04.1.454.CMB.1.raw
tcagtcacgtactacacgaccggtgctcgatttagtacacacacttaggattgggggcagaagtctctctcagtcaggacacagcatggacatgagggtccctgctcagctcctgggactcctgctgctctggctcccagactaccagatgtgacatccagtatcgacccagtctccatccctccctagtctgcattccttcgttgggaacgacctagacgtcctacccggtctacgttcggccgggactagtccaacgtactaacttaacctacttacgttaacgtcccgttaggtatcgacgtacgaaggtaacgaccgaaggggtaacgtacgttaaccccttaaaagtttacgttaacgtacgtaccgttcgtgtaccgtcggtcccgtccggtcccgttacggtaccgtaacggttcccgggggtaccctacggttcccgttacgggtttctaacggggttcggtcgggtacgggtacgttaccggtaacggtacgtaagtaaccgtttaccgtaaccgttccttaccgaacctaccgttacccaaccgtaaccgtacgtacccgtaaccgtagtaacgtagttacgttacgtaagtttaacttacgtcgtaccgtaacgtacgttagttacggtcggtccgtccgtacgttcgtacgttcgggacgtacggacgtaacggtcacgtaacgtacgtaaccgtaacggtagtcgtacggtactactaccgtaacg

SEQ ID NO: 193022 - DNA, 738 bp, Homo sapiens
  misc_feature: GYAE6OF02F5VYK.13.59.F04.1.454.CMB.1.raw
  modified_base (131)..(131): a, c, t, g, unknown or other
  misc_feature (131)..(131): n is a, c, g, or t
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
tcagtcacgtactacacgaccggtgctcgatttagtacacacacttagggattgggggcagaagtctctctcagtcaggacacagcatggacatgagggtccctgctcagctccgtggactcctgctgctntggcctccagataccngtatgtgacatccagatcgaaccctgtcctcctatccctccctgtctgactnttctcgttggaancaggtacttccaccgtctacgttcggccgggtctaagtccacgaactaacgttaaacctactttagttacgaccgttaggtaactcgagtaccaaggaacgaccggtaaggggtaacgtacgttaacccgttaaatttcttaacggtacttccgtctccggaccttcgggtccgttccgtccgttacggacccgtacggttacccggggtcccgttaacgttccggtttaccggtctaacggggtcgggtcgggttacgtacggtcgttaaacgggactaacgtaccgttaccactaccgtacaccgtactacccgtaacctaccggtactacccgtaccgtaacggtagtacgttaccgtttaaagtacgtttacgttacgtcgtaacgaccgttaacgtcggttacggtacggttccggcccttacggttccgttacggttccgggacgggtaaccgtcggtaagggacctaggaaccttagtaacccggaacgttacggtacggtacgtacgtcctagtaccc

SEQ ID NO: 193023 - DNA, 859 bp, Homo sapiens
  misc_feature: GYAE6OF02IMW3W.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagataccagatgtgacatccagatcgacccagtcctccactcctccctgtctgctattcgtcgttaggagaaccagtacgtccgtaaccgttcctacgttcgggcccgggacgtacgtaccaacgtaactaacttaaactacttttaattaccgtccgtaggttactcgaagacgaagaacggccgaaggggacgtaaccgttaacccttaaaagttagttacgtactcgttacgtacgtcgttcggtaccggttacccgttccgttaccgacgggtaaccgggttcccggggtaccctagttcccggttacgggtttccgtacgggttcggggtcgggttacggtattaccgggtaacggtaacgtaacgttaaccttacccgtaaccgttccctaaccctaacctaacccgttaaccctaaaaccccgtaacccgtaccgttaaccccgtaacccgttaaggtaaacggtttacgttaagggttttaaccggttaagttttaccgttacggttaacggttacccgttaaacgtacccgtttaaggttcggttaccggttaccccggttcccggttaccgtttaaccgggtttacggttttaaccgggggaccggtaaaccggggtacgtaaacggggtaccgtacggaaccgttaacgttaaacccgtaaacggttaccggtcgggtaacccgttacgtacccgacccgttaacccg

SEQ ID NO: 193024 - DNA, 837 bp, Homo sapiens
  misc_feature: GYAE6OF02HOOJ6.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggcctcccagactaccaggatggtgacatccagatacgacccagtcctccattccctcctgtctgctacttctcttgggacacgagtacgtaccgaccgttactacggttcggcccggggactacgtacaccgaactacttaactactttaactttacgaccgttaggttactcgtacgacgaagaacgtaccggaaggggacgtacggttaacccgttaaaagttagttacgtacttaccttacgttacggactcggtccggttcccgttccgtttacggacgtaaccgggttcccggggggttaccctacgttaccggttccggtttacggtacgggttcgggtaacggggttaggtaacgttacggtaacgggtaacctaaggtaccttaccgacttacccgtcctaacccgtactaacccaaacccgtaccgaccgtaccctacccgtaagggttaacttaacgggttaggttttaaacggtagttttaacctttaccgtacggttaccgtaaccgttaacggttaaccgttacggggttaacgggtccggttacccgttaccgttacgggttttcgggttaccggggggacggtaacggggttacccggtaacgggtccggtaaccgtaaacggtaccggttaaaccgaacgggttaaccggttagggtacccggttacgtacccgggttacctaaccgg

SEQ ID NO: 193025 - DNA, 838 bp, Homo sapiens
  misc_feature: GYAE6OF02F7ZW3.13.59.F04.1.454.CMB.1.raw
  modified_base (207)..(207): a, c, t, g, unknown or other
  misc_feature (207)..(207): n is a, c, g, or t
  modified_base (820)..(820): a, c, t, g, unknown or other
  misc_feature (820)..(820): n is a, c, g, or t
  modified_base (822)..(823): a, c, t, g, unknown or other
  misc_feature (822)..(823): n is a, c, g, or t
  modified_base (825)..(826): a, c, t, g, unknown or other
  misc_feature (825)..(826): n is a, c, g, or t
  modified_base (830)..(830): a, c, t, g, unknown or other
  misc_feature (830)..(830): n is a, c, g, or t
  modified_base (832)..(832): a, c, t, g, unknown or other
  misc_feature (832)..(832): n is a, c, g, or t
  modified_base (835)..(836): a, c, t, g, unknown or other
  misc_feature (835)..(836): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtcctccatcccgtccctgtctgaccattctgtgganacagtactcaccgtctacgttcggccgggtacagtccgaacgactaatttaaaccgtactttaatttacggccttaggtaactcgaagacaacggaacgccggtaagggacgtaccgtaacccttaaattacgttagacttcttacgtgtcgtcgtaccgtccgtcgttcgacgtaacggtccggggtacctacgttccgttacggttgacggtcgggtcggtacgtacgtcgtaaggactaaggtaccttcgtaccttaccgacctacccgtaactacccgtaaaccctccgtacccgtacccgtacccgtaaaggttaacggtacgttttacgggttaaacgggtttaaacgtttaacgttttaccgtaaaccggttaccgttaaacccgggtttaacgtttaaacggggttacccggggttttaaccgggggtacccccgtttaaacccggggttttacccccgtttttaacggggttttttaaaacccccgggggggttttttttacccccgggggggggaaaacccggggggggttttaaaaacccccccgggggggggggttttaaaaaaaacccccgggggttttccccggggggggggggttttnannannagtngncgnntc

SEQ ID NO: 193026 - DNA, 683 bp, Homo sapiens
  misc_feature: GYAE6OF02JEQ90.13.59.F04.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtagacatccaggaatcgaacccngtctccatccctccctgtctagcatctcttgganacagctccaccgtncttcggccgggtcagtcacgactataacacttattacgcctaggtatcgagacgagaacgccgagggaactacggttaaccctaaatttagtacggtattcgttctcgcttcggtccgttcccggtacttcgtaccggtaaccggttccgggggtaccctacgttccgttcggttacgtacggttgggcggtggtactacggtagaactagtacttccactacctaccgacctacctaccccgaaccgtacctccggaaccctacccgtagaaacgtacgtaaggttaacgggttaattaacgttaccggtgttaaccgtaacgtaacgtttacggtgggttaaccggtccgggtcctcggttacgttcgggttaaccgggcgggaacggtacggtaacggtcgtaacgacgaaccgtaacgtaaacggtcgttaacggtcgggaacttcggacccttaac

SEQ ID NO: 193027 - DNA, 746 bp, Homo sapiens
  misc_feature: GYAE6OF02HWEXF.13.59.F04.1.454.CMB.1.raw
  modified_base (125)..(125): a, c, t, g, unknown or other
  misc_feature (125)..(125): n is a, c, g, or t
tcagtcacgtactacacgaccggtgctcgatttagtacacacacttagggattgggggcagaagtctctctcagtcaggacacagcatggacatgagggtccctgctcagctctggactctgctnctctggctcccagactaccagattgtcgacatccagactacgacccagtcctccatccctcccttgtctcgacatcttcgttaggatacgagacgtccaccgttcacgttcggccgggtacgacgtcgacgactaacttaacgtaactttattacgtccgttaggtactacgaacgtacaacggaacgaccggtaacgggtaacgtaccgttaacccttaaaagtttacgttacgtaacttccttacttcgtcgttccggtccggttacccgtaccgttcgtaccgtaaccgggttcccggggtacctacggttcgttacggttacgtaggtccgggtacgggtacgttaacgtccggtaaggtaaccgtaagtactttacgacctactaccgtaactaccttacccaaccgtaacgaccaccgtacccgtaagacgtagttacggttagttaacttacgtacttagactaacgtacgtagttacggtccggttacctaccggtacttacgtttacggtttccgggaccggtaacggggtaacctacggggttacaccggttaaaccgacgttaaaccgtaacgttacggttaggtaccggtactaccggaccttaaccgg

SEQ ID NO: 193028 - DNA, 816 bp, Homo sapiens
  misc_feature: GYAE6OF02FX3T0.13.59.F04.1.454.CMB.1.raw
tcagtcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatcgacccagtctccatccctccctgtctgctatcctcttgggaatacgagacgtaccacccggtactaccgttcggcccgggcgaacgttaccaaccgaactaacttaaacctacgtttaatttacggccgttaggtacttcgaacgagaaggtaacgaccgtaggggaagacggttaaccccttaaaagtttacgttagtacttctacgttgtccgtggtcccgttccggtccgttacgtaccgtacggttacccggggggtaccctaacggtttaccgtccggtttaccgtaacgggtcgggtaacgggttcggaacgtttacgggtaacggtaacgtaacgggttaacttccgtaaccgttccgtacctaaccgtaacttaaccctaacccctaaaccgtccgtaaccctacccgttaagtaaccgtagtttacgggttaacggtaaacgttttaacttaccggttacgtaacctaacggttaacccttaggttaaccgggtttacgggttcccgacccggttccgttaacggttacccggttttccgggacggggtaccgggtaaccgtaacgggtaccggtaagtaccggtaacttaaacggaacggttaggttacccggaggttacccgtaccggtacgttaaccccg

SEQ ID NO: 193029 - DNA, 779 bp, Homo sapiens
  misc_feature: GYAE6OF02IOZWQ.13.59.F04.1.454.CMB.1.raw
  modified_base (229)..(229): a, c, t, g, unknown or other
  misc_feature (229)..(229): n is a, c, g, or t
tcagtcacgtactacacgaccggtgctcgatttagtacacacacttagggatgggggcagaagtctctctcagtcaggacacagcatggacagtggacgggtccctgctcagctccgtgggactcctgctgctcgtggcctccagactaccagatgtcgacactccagactcgaccctgtcctacctactcccctccctgtcctcgacctacgttccgttcgtggaacnccgtaagtaccgtcctaccgtcgtacgttcggaccgggtcgacgtacgacgtaactaacgttaacctacgtttagttacgtaccgttggtaactacgtacgacgaacggaaacgcgtacgggacgtaaccgttaccttaaattacgtcgtaagttctacgttgccgttacgtcccgttccgaccgtttacgccgtaaccggttccggggtaccctagttcccgtttaaccgttcggacggttccggtgttaccgtaggtacccgttaggaactacggtaacttccctactacccgtaacgtaaccgtaccttaacccttaacccggaactccccggtaactaacccggtaaccggttaaagtcccggtttaaagggtttacccgggtaaacttttaaccggtaccgttacggtaacctacccggttaaagtacgttaccggtacgtccgggttaaccctcggttaaccgtacgggtttccgggacggcggtaaccctaagggtcacggtacaacggtttaacacgttacgcgtccgtacgactaccgtac

SEQ ID NO: 193030 - DNA, 554 bp, Homo sapiens
  misc_feature: GYAE6OF01DYIP6.16.15.B04.1.454.CMB.1.raw
  modified_base (264)..(264): a, c, t, g, unknown or other
  misc_feature (264)..(264): n is a, c, g, or t
  modified_base (326)..(326): a, c, t, g, unknown or other
  misc_feature (326)..(326): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggtgtgtttctaggtggctaatttaaaggtgtcagtgtgaggtgcagctgttggagtcgtgggggaggcttggtacagccgtggggggtccctgagctctcctgtgcagcctntggattcatctttgcagctatgtcatgcctgggtccgccaggctccgagggaagggctgggngtggtcgtgtagttagttggtggtagtgttatacactactactacgacacgtacgtcgtacggtacggtaccgtacgtacctactctaccgacgaacgaactaactaacaacgaacaactaactatatactactacaatacgaacacgacgtacgagacgacgacgacgacgacgtactatagtagtcgagaacggacgaggtagagtacgagagcgtcgtacgtacg

SEQ ID NO: 193031 - DNA, 713 bp, Homo sapiens
  misc_feature: GYAE6OF01DAHTC.16.15.B04.1.454.CMB.1.raw
  modified_base (183)..(183): a, c, t, g, unknown or other
  misc_feature (183)..(183): n is a, c, g, or t
  modified_base (257)..(257): a, c, t, g, unknown or other
  misc_feature (257)..(257): n is a, c, g, or t
tcagtgtactactccacgaccggtgctcgatttagacagtatatatccgcggggagctctgagagaggagcccagccctgggattttcaggtgttttcatttggtgatcaggactgaacagagagaactcaccatggagtctgggctgagcggtgtgtttctaggtcggctattttaaaaggngtcagtgtgaggtgcagctgttggagtctggggagcttggcacagccgtgggggtccctgagctctcctgtgcncgctcgtgtacttactacttacgacgacgtactactcgacctacgtacgtaccgtcgggtccggaccgacggtccgtaccggaacggggaacggggtacggtagggtaacggtacgggttaccgtacgtaaggttacgttacgttagggttagggttaggttaacgtaacctaacgtaacgtaacgtacgtacgtaacgtaccgtaccggtacggtaacgggtaccggttaccgtaccgtactacctaccgtaacgtaacgaactaaacgtaaccgaaacgtaaacctaacgtactacgttacgtacgtacgtaacgtaagtaacgtaacgaacgaccgtacgacgaacggaaccgaccgaaccgaaccgtaaccgtaacgtaacttaacgttacgttagtacggtaacgaaacgaccgaccggtacgtacgttacgtacctaaccgtaacgtaac

SEQ ID NO: 193032 - DNA, 509 bp, Homo sapiens
  misc_feature: GYAE6OF01EH40S.16.15.B04.1.454.CMB.1.raw
  modified_base (176)..(176): a, c, t, g, unknown or other
  misc_feature (176)..(176): n is a, c, g, or t
  modified_base (179)..(180): a, c, t, g, unknown or other
  misc_feature (179)..(180): n is a, c, g, or t
  modified_base (182)..(182): a, c, t, g, unknown or other
  misc_feature (182)..(182): n is a, c, g, or t
  modified_base (189)..(190): a, c, t, g, unknown or other
  misc_feature (189)..(190): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (230)..(231): a, c, t, g, unknown or other
  misc_feature (230)..(231): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (238)..(239): a, c, t, g, unknown or other
  misc_feature (238)..(239): n is a, c, g, or t
  modified_base (241)..(241): a, c, t, g, unknown or other
  misc_feature (241)..(241): n is a, c, g, or t
  modified_base (243)..(250): a, c, t, g, unknown or other
  misc_feature (243)..(250): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggctggttctaaggcgcattaaggntcnngnagtgcanngtgagntggnggctgtcgngcgnggtcngnctctctgngnnctngntnntntnnnnnnnngcgtcgcgcgcgcncgaggaggngngngtgtntgtgtgtggtggtgtagtactacactactacgtacgacgacgtacgtacgtaggtacggtcgtacgtactactctacgacgacgactaactacaacaacactactatactactacananacgaacgacgcgacgacgacgacggacggacgacgtacgtactacgtacgtacgtcgacggaacggacggaggtagtacgtacgtaggtaggcgtcggtacggtacgg

SEQ ID NO: 193033 - DNA, 600 bp, Homo sapiens
  misc_feature: GYAE6OF01CGXPP.16.15.B04.1.454.CMB.1.raw
  modified_base (531)..(531): a, c, t, g, unknown or other
  misc_feature (531)..(531): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatgggagtttgggctgagcgtgtcgttttctaggtggctattttaaaaggtgtccagtgtgaggtgcagctgttggagtcgtgggggaggcttggtacagccgtggggggtccctgagactctcctgtgcagcctctggattcatctttagcagctatgtcatgacctgggtccaccgaggctccgaggggaagggctgggagtgggtctcgtagtttagttggtggtagtggttaactaccactatactacgcagactccgtgaacgggtccgttcaccatcctaccagagaactaacttaccaaagtaccaactactaatatctagacaaagtgaaacacgcctaggacgtaacggcccggaaggaccgaacgggtcccgttaatacgttaaccgngttacggaacggaaacggtcccgtaagggtatacggacgtaggtcgggactcgggtaacctaaccgggg

SEQ ID NO: 193034 - DNA, 501 bp, Homo sapiens
  misc_feature: GYAE6OF01B67AS.16.15.B04.1.454.CMB.1.raw
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
  modified_base (243)..(243): a, c, t, g, unknown or other
  misc_feature (243)..(243): n is a, c, g, or t
  modified_base (268)..(270): a, c, t, g, unknown or other
  misc_feature (268)..(270): n is a, c, g, or t
  modified_base (272)..(274): a, c, t, g, unknown or other
  misc_feature (272)..(274): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggngtgttctaggtcggctatttaaaggntcagtgtgaggtgcagctgttggagtctggggagcttggacagcctgggggcctgagctctcngtgcagctctggattcatctttgcnnntnnntgcgtcgcgcncgcgcgaggaggngngngtgtgtgtgtgtggtgtagtgtactacacatactacgacgacgacgtcgcggacggtcgtcgacnctctacaganacactacaacaacacactatatacacacaananaacgacacgagacgacgacgacgacgacgacgtactactagtcgtgtagaacggacgaggtagtagtacgagtagtcggtcgtacgtacgg

SEQ ID NO: 193035 - DNA, 560 bp, Homo sapiens
  misc_feature: GYAE6OF01BZC8M.16.15.B04.1.454.CMB.1.raw
  modified_base (217)..(217): a, c, t, g, unknown or other
  misc_feature (217)..(217): n is a, c, g, or t
  modified_base (288)..(288): a, c, t, g, unknown or other
  misc_feature (288)..(288): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtgtcgtttctaggtcggctaatttaaaggtgtcagtgtgaggtgcagctgttggagtcgtggggnggcttggtacagccgtgggggtccctgagctctccgtgtgcagcctgtggattcattctttagcagctatntcatgaccgtcggtccgccgaggtccaccggaggggtaagggtcgtggaggtgggtctagtagttagttggtggtagtggtactacatatacgtcgacacgtacgtcgaggtaacggccgttacacncgtcncagtagactacgtacaaagcaactgtactagctacganaatcgaacgatccganaagacggcgagaccgtcgtatattacgtagtggtccgaggtaaacggctagggtatacgctaggtcggactacggtacctacgggg

SEQ ID NO: 193036 - DNA, 693 bp, Homo sapiens
  misc_feature: GYAE6OF01BSQGT.16.15.B04.1.454.CMB.1.raw
  modified_base (156)..(156): a, c, t, g, unknown or other
  misc_feature (156)..(156): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtgtnttttctgtggctatttaaaggtgtcagtgtgaggtgcagcttggttggagtcgtggggggaggtcttggtacaggtccgtggggggtccctgacgactctccgtgtgcacgcctcgtaggattcattctttagctagtctatgtcagtcgaccgttcgggcccgccgacggcctaccggaaggggacgggctgggaggtgggtctgtagttagttggtggtagttggttaacaccgataactactacgcagtaccgtccggtaggacgggtcccgttacacccgtatcccgtacgaaaggacaaacctaacttaccgaaaacgtaccaactaacctaattactccgtaacgaattaaacgacgaaacccgtaggtaccccaaggaacgggaaccgtacccggaacggggacccgtaaccgggtaccgtaaattaccggtttaaccgtaggggttaccgaacgggtaaaccggccggtaaagggtttaacacggaccggtaaggttacgggtccgtaacggggtaacccaaccggggg

SEQ ID NO: 193037 - DNA, 710 bp, Homo sapiens
  misc_feature: GYAE6OF01EJ7HD.16.15.B04.1.454.CMB.1.raw
  modified_base (268)..(268): a, c, t, g, unknown or other
  misc_feature (268)..(268): n is a, c, g, or t
tcagtgtactactccacgaccggtgctcgatttagacagtatatatccgcggggagctctgagagaggagcccagccctgggattttcaggttgttttcatttggtgatcagggctgaacagagagaactcaccatggtagtttgggctgagcgtcgtcgttttctaggtcggcttaagtttaaaggtgtccagtgtgaggtgcagctgttggagtcgtggggagtcgttggtacagccggtgggggtccctggacgctctcctgtcncacgtcctcgtgtacttcattctttagctagtctagtgtctagtcgtaccgtcgggtcccgaccgacggtcgtaccggaggggaacggtcgtagggaacggttcggtacctgtagttgttggtaggtacgtaggttactaccaacgtaactaccgtacgacagtaaccgtccgtaggaaccgggtccgttacaacccgtactccgtacgaagaacgtaacctaacttacccgaaagtaaccctaactaaccgtaaattaccgtacgtaacgtaactaaacgtacgaaacgtacgacccgtaagggaacgtaccggttaacggaacggaacgtaaccggtaccgttaggttaacccgtagttcggaacgtaagggaacccggtccgtaagggtaataccgtacggtacgggtacggtaacggttccgggaaaccgtaccgggg

SEQ ID NO: 193038 - DNA, 624 bp, Homo sapiens
  misc_feature: GYAE6OF01CB363.16.15.B04.1.454.CMB.1.raw
  modified_base (587)..(587): a, c, t, g, unknown or other
  misc_feature (587)..(587): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtggtcttttctaggtggctaattttaaaaggtgtccagtgtgaggtgcagctgttggagtcgtgggggaggtcttggtacaggtccgtcggggggtccctgagtactctcctgtgcagtcctcgtggtattcattcttagcagtctatgtcatcgtaccgtcgggtcccgccgacggtcgtaccggaggggacgggctgggagttgggtctgtagttagttggtggttagtaggttactaacctatacgttactacgacagtacgtccggtaggtaacgggtccgttacacctactcctacagacaactaacttaccgaaacgaaccaactaattagtaactctagaactaaagtacgaaacctacgccctagaacggacgaccgaaggaccacggtactattactacgtgcgtaacgggaacgtccgaaggtanacgtacgtaggtacggcgttaccggaaccgtacgggg

SEQ ID NO: 193039 - DNA, 713 bp, Homo sapiens
  misc_feature: GYAE6OF01ASPLK.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgcccagtgtgaggtgcagctgttggagtcgtgggggaggcttgggtacagccgtggggggtccctgagactctcctgtgcagcctctggattcatctttagcagtctatgtcagtcggaccccgggtccgccaggcctccggaggggaacggggctgggagtgggtctcgtagttagttgggtggttagttggtttaacaccgtactataccgtacgcacgtaccttccggtaggaaacggggtcccgttcaaccgtatcctaccgaagacgtaactaaacgttccaaacgaaccaacaacttataacttcctagaaaccctaaagtacgaaaccgtagtccctaaggaacggtaaccggacccgggtaacgggaacccgtaaccgggtcccgttaaattaacgtttaccggtagggttaccgggaaaccggtaaaccggggacccgtagggggttaaaccgtaacggaccgttaaggggttcggtacccggtttaccggggtaaaacccgtaaccgggggttaccgggggg

SEQ ID NO: 193040 - DNA, 626 bp, Homo sapiens
  misc_feature: GYAE6OF01APYWJ.16.15.B04.1.454.CMB.1.raw
  modified_base (259)..(259): a, c, t, g, unknown or other
  misc_feature (259)..(259): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtgtcgttttctagtggctattttaaaaggtgtcagtgtgaggtgcagctgttggagtctgggggaggcttggtacagccgtggggggtccctgagctctcctgtgcngcctctggattcatcttagcagctatgtcatgacctggtccgccaggctccgagggtacgggctgggagtgggtctcgagttagtggtggtagtggttataccgacatactacgcagactcggtgaacgggtccgttcacctatccgtaccgagacgacaacttaccgaaagaaccacactaatacgttcagacaaaattgaaacacgaccctagagtacgaccggaaggtaccgaccgggtcctaattacgttacttacggtacgggtaaccggaaaaggggtccccgaaagggggttaaacttaacgggacccggtaagggttaccgggtaccgtttaaaccggggtccccgtaaaaccgggggg

SEQ ID NO: 193041 - DNA, 566 bp, Homo sapiens
  misc_feature: GYAE6OF01AVAYP.16.15.B04.1.454.CMB.1.raw
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (181)..(182): a, c, t, g, unknown or other
  misc_feature (181)..(182): n is a, c, g, or t
  modified_base (184)..(186): a, c, t, g, unknown or other
  misc_feature (184)..(186): n is a, c, g, or t
  modified_base (188)..(189): a, c, t, g, unknown or other
  misc_feature (188)..(189): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (232)..(233): a, c, t, g, unknown or other
  misc_feature (232)..(233): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (241)..(242): a, c, t, g, unknown or other
  misc_feature (241)..(242): n is a, c, g, or t
  modified_base (244)..(244): a, c, t, g, unknown or other
  misc_feature (244)..(244): n is a, c, g, or t
  modified_base (246)..(249): a, c, t, g, unknown or other
  misc_feature (246)..(249): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
tcagtgtactactccacgaccggtgctcgatttagacagtatatatccgcgggggagctctgagagaggagcccagccctgggattttcaggtgttttcatttggtgatcagggctgaacagagagaactcaccatggagtttgggctgagcggtgtgttctaggcgctattaagncangnngnnngnngtgngtgngggngctgcagcgtggggtccngagcntctgtgcnnctngtntnntntnnnntntnngngcgngcncgngcgcgaggngngngngtgtntgtagtgtgtgtagtgtacacactactacacgcacgtcgtacgtacggacggtccgtacacgtacgtcacgaacgtacgtaactaactaaccgaataaccactactaactagactacgtaactaactaacgaacgtaccgtacgtacgtacggaccggacgaaccggaccggtaccggtacgttaacgttaaccgttacgtacggtacggtacggaacgggtacggtaacggtaacgtacgtacggtacggtaggtaccggtaccggtaaccggtacggg

SEQ ID NO: 193042 - DNA, 988 bp, Homo sapiens
  misc_feature: GYAE6OF01CAR49.16.15.B04.1.454.CMB.1.raw
tcagtgtactactccacgaccggtgctcgattttagacagtatatatccgcggggagctctgagagaggagcccagccctgggattttcaggtgttttcatttggtgatcagggctgaacagagagaactcaccatggagtttgggctgagctggtctttttcttgtggtcttatttttaaaaggtgtccagtgtgaggtgcagctggttggagtcggtgggggaggtcgtttggtacaggtcccggtcggggggtcccctggacgtaccttcctcctggtcgcacgtccctcgtggtatttcctatttccgtttaggcctagtccttagttcgttactagttacggtacccggttcggggttcccgaccggacgggtcccgtaccgggaacggggggtaacgggggtccggttaggggtacgggtttcggggttaccgttacggttaaggttttaggttttagggggtttacggggtttaagggttttacggggtttaaaccgttaaacccgtaaaccgttaaacgtttaaacccgttaacggggtacccgtaaaccgggttaccccggtttacccggggttaacgggggtaaaccccggggggttaccccgggtttttaccccgaaacccccgtttaacggttcccccgttaaccccggaaaagggtaaaccggtaaaacccttaaaccgtttaaaccccgaaaaaacgggtaaaccctaaaacgttaaaaacttacggtttaaacttacccgtaaacgtaaccgtaaaaagtttaccggaaaaccgttaccggaaccgttaagggaaaccggacggtaaccccgggaacgggtaacccggaccgggttaacccgtttaaatttaccgttacccggttagggttaaccggaaacgggtaaaacgggtccgggttaaggggttaaacgtacggtccgggaagggtttcgggaacccggttacgggtaaaccccggtaaaccgggggg

SEQ ID NO: 193043 - DNA, 756 bp, Homo sapiens
  misc_feature: GYAE6OF01DRHUW.16.15.B04.1.454.CMB.1.raw
  modified_base (607)..(607): a, c, t, g, unknown or other
  misc_feature (607)..(607): n is a, c, g, or t
tcagtgtactactccacgaccggtgctcgatttagacagtatatatccgcggggagctctgagagaggagcccagccctgggtattttcaggttgttttctatttggtgatcgagggctgaacagagagaactcacagtggtagtttgggctgagcttggttctttttcttgtggtacttaagttttaaaaggtgtcctagtgtggaggtgcagtcgttggttgggaggttcggtggggggtaggtccgttagggtacgtacgggtcccgggttcggggggttccctggacgtaccttcctccgtggtcgccgtacgtcccttcgtggtactttctactttcgtttagcgtaagtccttaagtcggtctacgtccggtacccggttccgggtacccaaccggacgggtacccggtaccgggaagggggtaacggggtccggtagggtagggttcgggtccgtagttaggtttaggttgggttaggttaggtttacgtactaaccaacgtaacttaccgtacgcaacggtaccgtcggtacggacgggtccttaccactcgtacacgaagtaacaactacgtaccaaaagacactatatatacgtaanaacaagtacgaacgtacacgtacggagtaccggaccgaaggacccgtaccggtacttaagtacgttaggtacggacggaaaggaaaccggtcgtaagggtaatcggaacgttacgggtaggacccgttaacggtaacccggtaacgggg

SEQ ID NO: 193044 - DNA, 768 bp, Homo sapiens
  misc_feature: GYAE6OF01CQ57R.16.15.B04.1.454.CMB.1.raw
  modified_base (644)..(644): a, c, t, g, unknown or other
  misc_feature (644)..(644): n is a, c, g, or t
tcagtgtactactccacgaccggtgctcgatttagacagtatatatccgcggggagctctgagagaggagcccagccctgggattttcaggttgttttcattttggtgatcagggctgaacagagagaactcaccatggagtttgggctgagcttggtctttttcttgtggtcttaattttaaaaggtgtccagtgtgaggtgcagtctggttggagtcggtgggggaggtcgttgggtacgacggtccggttcggggggtcccctggaacgtaccttcctccgtggtgccgacgtcccttcgtggtattctattactttagctagctattgtacagttcggaccggttcgggtcccgccgacggccgtaccgggaagggggaacgggtcgtaggggtaggttcgggttcctaggttaggtttagtttggggttacggttaaggtttgggtttaaacctaacccgaacgtaacgtaacgtaccgacgtaacggtaacccgttccgggtaacgggaaccgggttcccggttaccaacccgtacgttcccgtaccgaaaggaaccgtaaacttaaaccgttaacccgaaagtaaacccaaccgtaaacttaacttacttaccgtaacgaactaaaagtcgaaaacncggtaccagggacgaacggaccggaacggaccgaaccggtaccgttaagtacgttacgacggtacgaacggaacggtacgtaagggtactaggacgtaggcgtacgtaggtacccggtaacggg

SEQ ID NO: 193045 - DNA, 678 bp, Homo sapiens
  misc_feature: GYAE6OF01EC4RU.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggagcgttggtacaggccgtggggggtcccctggacgactctcctgtgcagtcctcgtcggtactttccccctttaaccactattactgcctaagtcggggcgttcggggtccccgccgacgggccgtacccggaagggggaacggggcgtggggaggttcggggtcctactacgttttagtaggtggtagtaggtagtactacactactacgcgagtacctaccggtaggaacgggtccggttacaccgtatcctccagaacgaacaactacccaaacgaacacctactgtactactgacaagtacggaacgccgtagacgacgaccggacggaccgaccggacgttaactagttacgtggtacgacccggtagggttacggtttacgtagttacgtagttaacgttacgttaacggttaaaacgtaaaacgggttaattaacgttagtaaccgtaaccggg

SEQ ID NO: 193046 - DNA, 602 bp, Homo sapiens
  misc_feature: GYAE6OF01CUSMG.16.15.B04.1.454.CMB.1.raw
  modified_base (306)..(306): a, c, t, g, unknown or other
  misc_feature (306)..(306): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttctgtggctattttaaaaggtgtccagtgtgaggtgcagctgttggagtctggggggagcttggtacaggccgttggggggtcccctgagacgtctcctgtgcagcctctggattcatctttagcagctatgtcatgacctggtccnccaggctccgagggaagggctggagtggtctcgagtttattggtggttagtgggttactaccgatactactacgctagacgtccggtagaacggggtccgttacaccactcgtaccagacgacaacttacaaagtaccaactaactatatctagtacaaagtagaactaggacccttaggagtacgccgaagggaccaaccgggccgtaattacgttatacggttcggacggaaaacggtccggaagggttagtaacgtaccgaaggttgggaccgtgggtaaccccgtaacgggg

SEQ ID NO: 193047 - DNA, 649 bp, Homo sapiens
  misc_feature: GYAE6OF01DC8FP.16.15.B04.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (582)..(582): a, c, t, g, unknown or other
  misc_feature (582)..(582): n is a, c, g, or t
  modified_base (620)..(620): a, c, t, g, unknown or other
  misc_feature (620)..(620): n is a, c, g, or t
  modified_base (630)..(630): a, c, t, g, unknown or other
  misc_feature (630)..(630): n is a, c, g, or t
tcagtgtactactccacgaccggtgctcgatttagacagtatatatccgcggggagctctgagagaggagcccagccctgggattttcaggttgttttcatttggtgatcagggctgaacagagagaactcaccatggagtttgggctgagcgtcgtcgtttctaggtgcttaatttaaaggtgtcagtgtgaggtgcagtctggtgagtcgtggggagcttggtacgngccgtcgggggtccctagngtctctctgtcgcgancctgtaggtattctacttactttagcctagtctagtcgtctgtcgtaccgtcgggtcccgacgacggccgtaccggaagggggtaacgggccgtagggtacggttcgggtctaccgttaggtttaggttgggttacgggtagtttacggtaactaccctaatactaacgtacgccgtaggtaaccgttcggaggtaaccgggtccgttaacaccctagttccacgaaggtacaactaactacgaacactacaactctacttccggataacaaggtacaaccgagcccgagagacgaccgttacggacacggtccttanacgttgacggtgaaacggttacgcgtaaggtattacgngtaacggtcncggtaagcccgtaacgggg

SEQ ID NO: 193048 - DNA, 807 bp, Homo sapiens
  misc_feature: GYAE6OF01BJYQ0.16.15.B04.1.454.CMB.1.raw
tcagtgtactactccacgaccggtgctcgatttagacagtatatatccgcggggagctctgagagaggagcccagccctgggattttcaggttgttttcatttggtgatcagggctgaacagagagaactcaccatggagtttggctgagctggtctttttcttgtggtcttaagttttaaaaggtgtcgagtgtgaggtgcgtaggttggtggactcggtgggggacgaccgtgactacccggccggtcgggggtccctgacgtacctcctccgtgtaccgacgtccgttcgtcggtacttaccgttaccgtttaaggacgcctacgtcgacctagtggacgtccggtccgggttcccgccggaacggtccgttacccggaagggggtaacggggtccgtgggtacgggttcgggttccttaccgttaacgtttacgtttaccgtgtaccgttaaggtacggttaactcggtaatggacttaagtaacgtagtcgtacgacggttaccgttaccgggtacgggtaccggggttaccccgtttcctaacccttaccgaaaccgtaagaacggtaacctaaacgttaaccccgaaaggtaaccctaccgttaccttaactttacgtaccctaacgaccttaaacgttccggaaaccctcgaccggttaccggaccggacccgaccggaacggaccgtaccccggattacgttacggttaacttacgtaacgttacgtaaacggtcccgggacggggtccgaccccgggtcgggtacccgtaccggttgggttacgtttgggtttacgg

SEQ ID NO: 193049 - DNA, 893 bp, Homo sapiens
  misc_feature: GYAE6OF01D234K.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggtcttaattttaaaggtgtccagtgtgaggtgcagtctggtggaggtcggtgggggagtcgttaggtacgacggtccgggttcggggggtcccgtaggacgtaccttccttcccgtggtcgaccgacgtcccgttcgttaggtactttaccgtatttaccgttttaacgactacggtacttacgttcgttacctaacggttccggtaaccccgggtttcgggggttcccccgacccggtaacggggtacccgtacccgggggtaagggggggtaaacggggttcgggtaagggggtacgggttcggggtttaccgttaaccggtttaagggtttttaacgggtttggggtttagggggttttaagggtttaacggtttaaccgtaacccgtaacgttaaccgtttaacccgtaaccggtacgtaaccggtaccccggttaccggggttaacggggaacccgggggtttaccccggtacctaaccccgttacgttaccccgtaccgtaaacggtaaaccgtaacccgttaaaaccgttaacccgaaaacggtaaccctaactaaacgttaactttaaccgtactaacgaactaaagtacaacgaccacgtagtacggaacgaccggaacggtccgaccgtacttagttagtaacgtaggtaccggaaggacgggtccgtaaagggtcaacgtcggaggtaccggtcgtacgggtaaccgaaccgggg

SEQ ID NO: 193050 - DNA, 786 bp, Homo sapiens
  misc_feature: GYAE6OF01EAB29.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggtagtttgggctgagcgtggtcttttctgtggtacttaagtttaaaaggtgtccagtgtgaggtgcagtctggttggagtcggtgggggaggtcgttagggtacgacggtccggtcggggggtccctaggacgtcctctccgtgtgcgacgtcctgtggtacttctattctttagctagtctagttcgtactagttccggtaccggttccggggtccccgaccgtacgggtacccgtaccgggaagggggacggggtacggtggggtacgggttcgggttaccttaggttaaggttttaggtttgggttagggtttaaggttaggttaaacctaccgtaaactaactaaccgtaccggacgtaacggtacccggttacccgggtagggtaaacccgggtcccgtttaaccaacccgttacgttaccgtaaccggtaaacgtaaccgtaaacctaaacgttaacccgaaaacgacctaaactaactacgttaactcgtaacgaactaaacgtacgaacctacgacgtaagacgaccgggtaccgaagaccggtaccgtacgttagttacgtcgtaggtacgaacggtaacggtcggtaaaggtagacggtacgtagggtacggtccgttaacgggtacccgtaaaccgggg

SEQ ID NO: 193051 - DNA, 1023 bp, Homo sapiens
  misc_feature: GYAE6OF01ALEA8.16.15.B04.1.454.CMB.1.raw
  modified_base (183)..(183): a, c, t, g, unknown or other
  misc_feature (183)..(183): n is a, c, g, or t
tcagtgtactactccacgaccggtgctcgatttagacagtatatatccgcggggagctctgagagaggagcccagccctgggattttcaggtgttttcatttggtgatcgagggctagaacagagagaactcaccagtggagttgggctgagctggtcttttctgtgtactattttaaaggtntcagtgtgaggtgcagctggttggagtcgtggggagtcttggacacggtccggtcgggggtccctgacgtccttcctccgtgtgctacgtccttcgtggtattacattcgttaagcacgtctagtcgtacagtaccgccggttccgggtcccacgacggtcccgtacgggaggggtacgggtcgttaggggtacggttcggtaccttacggttaaggttttcggttagggtttacggttaacgggttacggtttaaacctaccgtaacttaaacggttaccgtaaccggtaccgtaaccggtaaccggttacccggtaacgggggtaacccgggttacccggttacccctaaaccgtaccgtttaccccgtaaccgaaacggttaaacccggaaaccctttaaacccggttaaacccgaaaacgtaaccccgtaaacccgttaacgtttaaacgttacccttaaccggtaacgggtaaacccttaaaagggtaaccccgttaaaccggaacccggtttaacccggggttaaccgaaaccccgggggtaacccgggttaaacccccggggaaacccggggtaaaccccggtacccgggggtttaaaacccgtttaaactttttaaaccccggggtttaaacccggttaaccccgggggtaaacggggttaaaacccccgggggtaaaaccccgggggttaaaacccggggtttaacgggggtttaaaaaccccgttaaggggtaaacccccggggtttaacgggggttaaccccggggtttaaaccccgggtttaacccccgggggggttaaaaaccccccggtaaaccccgggggggggg

SEQ ID NO: 193052 - DNA, 723 bp, Homo sapiens
  misc_feature: GYAE6OF01B19HM.16.15.B04.1.454.CMB.1.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (458)..(458): a, c, t, g, unknown or other
  misc_feature (458)..(458): n is a, c, g, or t
  modified_base (545)..(545): a, c, t, g, unknown or other
  misc_feature (545)..(545): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtgtcgttttctaggtggactatttaaaaggngtcagtgtgacggtgcagctgttggngtcgtgggggagcttggtacgacggccgtggggggtccctagagactcgtcctgtgcngcctgtcggattcatcgtttagcagctatgtactagtcgtaccgtggtcccgcaggggcctccggaggggaacgggccgttagggacggttgggtctccgtaaggtttagttgggtggtacgttgggttaacttaccgactaagttaccacgtcgaacgtccttaccggtggaaaccgggttcccggttanaaccccggtatacctaccgacggaaactaaccgtaaacttcccgaaaataccgaacgtaacgtactaagtaccctagccctaaaacncggtaaacgcgttacccgaggtaccgacggtacccgacgggtaccggtaacccgtaccgggttattaatttacgggttaacgtcggaacccgggtaaaccggacggacgggggttttaaaactcggacccgttaaggttaccccgggttacgacccgggttaacccggtaacccgggg

SEQ ID NO: 193053 - DNA, 723 bp, Homo sapiens
  misc_feature: GYAE6OF01AI36Z.16.15.B04.1.454.CMB.1.raw
  modified_base (583)..(583): a, c, t, g, unknown or other
  misc_feature (583)..(583): n is a, c, g, or t
tcagtgtactactccacgaccggtgctcgatttagacagtatatatccgcggggagctctgagagaggacgcccagcccctgggtattttcaggttgttttcatttggtgatcgagggctgaacagagagaactcaccatggtagttgggctgagctagtctttttcttgtggtcttaagttttaaaaggtgtccagttgtgaggtgcagcttggtggagtcggtggggagtcgttggtacgacggtccggtcgggggtccctggacgtctccgtccgtagtcgcacgtcctcgtgtacttccgtattcttagcctagtacttagttcgtctgtccgtaccggttccgggcctcgacggtccgtacgggtaggggaacgggtcgtaggtacgggtacggtcgttacggttaggtttacgttgggttaggtacggtttacgtaacctaaccgtactaacgtacgtaccgacgtaacggtaccgttcggtacgggtaccgggtccgtaccacgtacctccgtaccgagtaccgtaactaacctaaccgaaactaacaacgttaacctaattactcgtaacgtaanaaccgtactaacggatacccgtaggacgacgacggaacggacctcggtactattacggtatacggggacgaacggtaaacggtcgtaagggtaatcggtaacgtcggtaccggtacggtccggtaacccggtaaccgggg

SEQ ID NO: 193054 - DNA, 600 bp, Homo sapiens
  misc_feature: GYAE6OF01D97UM.16.15.B04.1.454.CMB.1.raw
  modified_base (384)..(384): a, c, t, g, unknown or other
  misc_feature (384)..(384): n is a, c, g, or t
  modified_base (566)..(566): a, c, t, g, unknown or other
  misc_feature (566)..(566): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggctattttaaaaggtgtccagtgtgaggtgcagctgttggagtcgtgggggagcttggtacacgccgtcgggggtccctggagactctcctgtgcacgcctcgtggtattctattctttagctagctatgtacatcgaccgtgggtccgccgacggctaccggagggaggcgtggaggtggtctgtagttagttggtggtagttggttactaccganactacgtacgacacgtacgtcggtaggacgggtccgtacaccgtatccgcagacactaacttaccgaaagaaccactaactattactacgtagaactaaagtcgaaactacgaccgtggaacgacgaccggagaaccgcggtactattatacgtggacgacggaaacggtccgaagggttanacgtacgtaggtcggagtacggaaccgtaacggg

SEQ ID NO: 193055 - DNA, 849 bp, Homo sapiens
  misc_feature: GYAE6OF01B00QK.16.15.B04.1.454.CMB.1.raw
  modified_base (662)..(662): a, c, t, g, unknown or other
  misc_feature (662)..(662): n is a, c, g, or t
tcagtgtactactccacgaccggtgctcgattttagacagtatatatccgcggggagctctgagagaggagcccagccctgggtattttcaggttgtttttcattttggtgatcgagggctgaacagagagaactcacagtggagtttggctgagctggttctttttcttgtggtcttaagttttaaaaggtgtccagtgtggaggtgcagtcgttgttgggagtcggtgggggtagtcgtttagggtaccgacggtcccgggttcggggggtccctaggacggtaccttccttccgttgtcgaccgacggtcccttcgtcggtattaccgtatttcgtttacgacctaaggttccttagttcgttacgtaacgttccggtacccggtttccggggtacccggtaccccggaccggggtcccggtaaccggggtaagggggaaccgggggtcggttaggggtacgggttccgggttacgttacggtttaagggttttggtttagggtttaggtttaggtttacgttaacgttaacccacgttaacgttaaccgtacgtacgtacgttaccgtaccggtacggtaaccgggtcccgtactaccgtactccgtaccgagaacgactaactacgaacgaactactaacgtatacgtacagtaaanaacgtacgtaaccgaacgtaccgaagtaccgggacgtaacccggtaacgggaccgaacccggtttaacggtaccgtttaacttaccgggtacggtaacggaacccgggtaaacgggcccggtagggtaaacttcgggaacggttcggtaaccggtacggttaaaccgggtcccggtaaacccggggg

SEQ ID NO: 193056 - DNA, 686 bp, Homo sapiens
  misc_feature: GYAE6OF01EMU4K.16.15.B04.1.454.CMB.1.raw
  modified_base (445)..(445): a, c, t, g, unknown or other
  misc_feature (445)..(445): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttctgtggcttaatttaaaaggtgtccagtgtgaggtgcagctgttggagtcgtggggagcttggtacaggccgtgggggtccctgagtctctccgtgtgcagcctcgtggtattcattcttagcagctatgtctagtcgaccgtgggtcccgccgtaggcctaccgaggggagggtcgtgggagtcggtctcgtaggttgttgggtaggtagttaggttactacccgataacgttactacgacgtacgtaccgtcggtacggaacgggtccgtttacaacccggtntcctaccgaagtaccgaactaacgttacccgaaaagtaaccgtaaccaacttaagttactaccgtagtaaccaaagtacgaaacccgtatacccgtggaaacgaccggtacccgaagggaaccccacgggttacccgttaatttaaccgtaacgtttacgggactaacgggaaaaccggccgggtaaagggttaacaaccgggtcgtacggcggacgttaacggggaacccctaaacgggg

SEQ ID NO: 193057 - DNA, 680 bp, Homo sapiens
  misc_feature: GYAE6OF02JJOZ9.16.15.B04.1.454.CMB.1.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtgcgttttctaggtggctatttaaaggtgtccagtgtgaggtgcagctgttggagtcgtgggggagcttggtacngccgtgggggtccctggagactctcctgtgcngcctnggattcatcttagcagtctatgtcatgacctgggtccncaggtcaccgaggggaagggtctggaggtggtcncgtaagttnttggtggtacgtggttaataccatagtctaacgcgaacgtctccgtaggaacgggtccggttacaaccctatcctaccgaggtacaacaacttacccaaaggtaaccacctaagttaacactttaccgtagaacctaaattacggaaaccttaaggtcccctagggaacgaccgggtaccgaacgggaaccgaacccggggttacccttaattacggtttaacctagggttcgggaaccggaaaacgggttccccgggaaggggttttaaagtacccggacggtaaagggttcgggtacccggttttaacggggaaccccttaaaacccgggggg

SEQ ID NO: 193058 - DNA, 552 bp, Homo sapiens
  misc_feature: GYAE6OF02HPB0L.16.15.B04.1.454.CMB.1.raw
  modified_base (305)..(305): a, c, t, g, unknown or other
  misc_feature (305)..(305): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtggtcgttttctaggtggctattttaaaaggtgtcagtgtgaggtgcagctgttggagtctgggggaggcttggtacagccgtggggggtccctgagactctcctgtgcagcctctggattcatcttagcagctatgtcatgacctgggtccncaggctcagggagggctggagtgggtctcgagttagttggtggtagtggttataccgactagtactacgcaagacctccgtaggaacgggcccggtttacaacccgtatccgtacccagacgaacaattcccaaagacacactatatctgactaaatgaacacgcctagagacgccgaggacacggctatatactggtgacgaaggccgtaaggtatacggcaggttggacttagggacctaacggg

SEQ ID NO: 193059 - DNA, 672 bp, Homo sapiens
  misc_feature: GYAE6OF02G46LU.16.15.B04.1.454.CMB.1.raw
  modified_base (263)..(263): a, c, t, g, unknown or other
  misc_feature (263)..(263): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggaggcgttgggtacagccgtggggggtccctgagactctcctgtgcngcctctggattcattctttagcagctatgtcatgaccgtgggtccgccgacggcctccggaggggaacggggcgtgggaggtgggtctcgtagtttagttggtgggtagttggttactaccacatactacgacgacgacgtccggtaggaacgggtccggttacaccctatcctaccagacgtaacaacgttaccaaacgaaccaactaacttaactaattacctagaaccgtaaatacgaaaccacgcccgtagaacggaccggacccggaagggaccgaaccgggtacccgttaattaccgtttacgtacgggtcggtaaaccggggaaacggtcccggtaaacggggttataacggcggtaacgggttacgggtaccggttaccgggtaaccccgtaaccgggggg

SEQ ID NO: 193060 - DNA, 587 bp, Homo sapiens
  misc_feature: GYAE6OF02HLSZZ.16.15.B04.1.454.CMB.1.raw
  modified_base (349)..(349): a, c, t, g, unknown or other
  misc_feature (349)..(349): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (557)..(557): a, c, t, g, unknown or other
  misc_feature (557)..(557): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagccgtggggggtccctgagactctcctgtgcagcctctggattcatctttagcagctatgtcatgaccgtgggtccgccgaggctccgaggggaaggggctgggagtgggtctcgtagttnttggtggtagtggttataccacatacgtacgcaacgactccggtaggaacggggtccgttacaaccctattaccgtacccaaggacgaacctaacgttaccaaagtaaccaactaactatactcngacaaatgaaacncgacctagaagacgccggaagaccacggtacgtaatacttacgtgtcggacgaaaggtccgaagggttanacgtcgaggtcggactcgggtaaccacggg

SEQ ID NO: 193061 - DNA, 627 bp, Homo sapiens
  misc_feature: GYAE6OF02GG7OM.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggaggcttggtacagccgtggggggtccctgagactctcctgtgcagcctctggattcatctttagcagctatgtcatgacctgggtccgccaggcctccgagggaaggggcgtggaggtgggtctcgtaggttagttggtggtagtggttactaccatatactacgctacgactccggtaggaacgggtcccggttacaccgtactccgtaccagacgaactaacttacccaaagaaccaactactatactctagactaaagtcgaaacacgtaccctagaacggtacgaccggaaggaccctaaccgggaccgttaattacgtttacgtggtaacggaccggaaacgggtccgtaagggtacgtaggaccgtaagggtcgggtaccgttacgggtaaccccgtaacgggg

SEQ ID NO: 193062 - DNA, 561 bp, Homo sapiens
  misc_feature: GYAE6OF02IK5G6.16.15.B04.1.454.CMB.1.raw
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (189)..(190): a, c, t, g, unknown or other
  misc_feature (189)..(190): n is a, c, g, or t
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggcgtgttctaggngctatttaaaggntcagtgtgngnnagctgtgnctgggagctgtcagcgtgggggtcctgacgactctcctgtgcagcctctggattcattcttagcagctatgtactgtnaccgtggtccacgnggctccgagggagggctaggagtggtctgtaagttgtggtggttagtggttactaccacatactaaccgntagccgtcgaggtacggtaccgttacacgtctccacgagacgtaactaacgtaccaaagtaacacttaactatactacngtaanaatagaacgacgacgagacgacgacgacgacgacgtacgtactactacgtaggtacgacgaacggaacggtacggtagtacgtacgacggtacggtacggtacggtaccggtaacgg

SEQ ID NO: 193063 - DNA, 561 bp, Homo sapiens
  misc_feature: GYAE6OF02HKBGE.16.15.B04.1.454.CMB.1.raw
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcatctttagcagctatgtcatgacctgggtccgccgaggcctccgaggggaaggggcgtgggaggtgggtctcgagttagttggtggtagtggttataccactatactacgcagactccgtaggaacgggccggttacacctatcctaccgagacgactaacttaccaaagaacacaactatactactgacaactgaacagcctgagcgccgaaggacacgcgtanattacgngtgacggaaggccgaagggtactaggacgaggttcggacttacgggacctaaccgggg

SEQ ID NO: 193064 - DNA, 513 bp, Homo sapiens
  misc_feature: GYAE6OF02GBBDU.16.15.B04.1.454.CMB.1.raw
  modified_base (182)..(182): a, c, t, g, unknown or other
  misc_feature (182)..(182): n is a, c, g, or t
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggtgtggttctaaggcggctaatttaaaggntcagtgtgagtgcagctgtgagtcgtgggagcttggacagccgtggggtccagagctncgtgagccagcctatgattcatcgttagcagctanctcagtgccgtggcacgnggtcacgaggaggttcaggcgtggtctaangtntggttagagtcgttanaccganatacacgngacnctcgagacgtctacactancgcaganacatacacanatatatatananananaganacgacagacgacgacgacgacgacgtacgtacgtacgtacgtacgtacgacgacggtacgtagtagtacgtacgtagtacgtacgtacgtacgtacg

SEQ ID NO: 193065 - DNA, 575 bp, Homo sapiens
  misc_feature: GYAE6OF02I8GGJ.16.15.B04.1.454.CMB.1.raw
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (376)..(376): a, c, t, g, unknown or other
  misc_feature (376)..(376): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagtgtactactccacgaccggtgctcgatttagacagtatatatccgcgggggagctctgagagaggagcccagccctgggattttcaggtgttttcatttggtgatcagggctgaacagagagaactcaccatggagtttgggctgagcgtgtgttctaggtcggctatttaaaggntcagtgtgaggtgcagctgttggagtcgtggggagcttggtacnggccgtgggggtccctgacgctctcctgngcagcctctgtattcatctttagcagctatgtcagtcgaccgtggtccgccgaggctccggagggaaggggcttagggaggttcggtctcgtagttagttggtggtagtacggttataccganattacacgctagacctcggtcgaagggtccgtcacgtactctacagacactatacaagaccacatactagtcncgactaangaacagtaccgagagacgaccgaaggaccgtacggaccttagtatttacggtgtacggaacgaacgggtaccagggttatacggcgtacgtggggaccttacgggtaaccctacgggg

SEQ ID NO: 193066 - DNA, 525 bp, Homo sapiens
  misc_feature: GYAE6OF02GWBP7.16.15.B04.1.454.CMB.1.raw
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
tcagtgtactactccacgaccggtgctcgatttagacagtatatatccgcggggagctctgagagaggagcccagcccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcatctttagcagctatgtcatgaccgtgggtccgccaggcctccgaggggaaggggctgggagtgggtctcgtagttattggtggtagtggttataccanatactacgcagactccgtgaacgggccgtcacatctcaganacatccaagacacactatactctgacaaatgaacagctagagacgcgaggacacggctatactactgtcgacgaaggcgaaggtataggctaggtcggctacggacctaacgg

SEQ ID NO: 193067 - DNA, 606 bp, Homo sapiens
  misc_feature: GYAE6OF02H5EH0.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggcttaattttaaaaggtgtccagtgtgaggtgcagctgttggagtcgtgggggaggcttggtacagccgtggggggtcccctggacgactctcctgtgcagcctcgtggattcattcttagcagctatgtcaatcgtaccgtgggtcccgccgaggcctccggaggggaacggggctgggagtgggtctcgtagttagttggtggtagtggttactaccacatactacgcagacctcggtgaacgggccgttcacctactctccagacactaactaccaaagaaccacaactatactctagacaaatgaaacacgtcctaggaacgacggacccgaagggacccaacgggtaccttaagtacctttacgtagtcggaaccggaaaggacccgtaagggtaactagcgtaaggtcggacggttacgggaccctaacgggg

SEQ ID NO: 193068 - DNA, 605 bp, Homo sapiens
  misc_feature: GYAE6OF02HD026.16.15.B04.1.454.CMB.1.raw
  modified_base (483)..(483): a, c, t, g, unknown or other
  misc_feature (483)..(483): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggaggcttggtacagccgtggggggtccctggagactctcctgtgcagcctctggattcattctttagcagctatgtcatgacctggtccgcaggctccgagggagggctggagtggtctcgagttatggtggtagtggttatacgatatacgtacgctacgacgtccggtaggaacgggtcccgtttacaccgtagtccgtcccaaggtacgaacctaacgttaccaaaagaccaactaacgttactactctagacaaatcgaaacncgtcctagaacgtacggacccgaaggacaaccgggtaccttaatacgttacgtggtaccgaacggtaacggccgtaagggtatacggccgtaggttcggacttaccgggaacctaaccgggg

SEQ ID NO: 193069 - DNA, 542 bp, Homo sapiens
  misc_feature: GYAE6OF02F1ZIR.16.15.B04.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (511)..(511): a, c, t, g, unknown or other
  misc_feature (511)..(511): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggagcttggtacagccgtggggggtccctgagactctcctgtgcagcctctggattcatctttagctagctatgtcatgacctggtccacaggctccgagggaggggctggagtgggtctcgagttattggtggtagtggttataccanatactacgcagctcgngaacgggcgtcacatctacagagactaactaccaagaaccacactagtactacagaacaatagaacagctagaggacgccgaggaacgaccgaccgtatagttactggtcgacggaaacggccgagggtanacggcgaaggtggcgttacggacctaacggg

SEQ ID NO: 193070 - DNA, 822 bp, Homo sapiens
  misc_feature: GYAE6OF02H3HVY.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggctattttaaaaggtgtccagtgtgaggtgcagctgttggagtcgtgggggaggtcttggtacaggccgtgggggtccctgacgactctcctgtgcagcctcgtggacttcattcttagcagtctatgtctatcgtaccgtcgggtcccgccgacggtcctaccggagggggaacggggtcgtagggacgggttcgggtacctcgtaggttttaggttcgggttagggttaggttgggttaactaccgaacgtaacttaaccgtaccgactaacggtaccgttccggtaacgggtaaccggggtccccggtttacaacccgttacgtttcccgttaacccgaaaggtaaccgtaaacttaaaccgttaacccgaaaaggtaaaccctaaccttaacctttaaagttactaccgttaagaaacctaaaaagtcgtaaaaccgtacgtacccggttaggaaacggaccggaacccggaacggggtaaacctaacccggggtaacccgttaagtttaacgtttacccggttagggtaacccgggaaacccgggttaaaacgggccccgggtttaaaggggtttaccgtaacgggacccggttaacggggtttacccgggaaccgttttacccggggaaaaccccgttaacccgggggg

SEQ ID NO: 193071 - DNA, 681 bp, Homo sapiens
  misc_feature: GYAE6OF02GGT1V.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggctattttaaaaggtgtccagtgtgaggtgcagctgttggagtcgtgggggaggcttggtacagccgtggggggtccctgagactctcctgtgcacgcctctggtattcattctttgacagtctatgccagtcgaccgttcgggtccgccgacggtccgttaccggaagggggtaaacgggggctagggtaaaggtcggggttaccgtacgtaagggttaacgtttacggttggggttacgggtttagggtttaactaacccgaagtaactaaccgtaccgacctaacgtaccgttccggtacgggtaaacggggtcccggtttaccaaccgtacttccgaccaagtaacgaacctaaacttacccgaaacgaaccactactagttatcctagaccaaagtcgaaacgacgaccgtagacggacgacccgaacgaccgacgactatactattacgtgtacgaccgaaacggccgaaccggtctaacgttacgacccaaccgtacttccttaacg

SEQ ID NO: 193072 - DNA, 603 bp, Homo sapiens
  misc_feature: GYAE6OF02GFFF9.16.15.B04.1.454.CMB.1.raw
  modified_base (420)..(420): a, c, t, g, unknown or other
  misc_feature (420)..(420): n is a, c, g, or t
  modified_base (484)..(484): a, c, t, g, unknown or other
  misc_feature (484)..(484): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttctgtggctattttaaaaggtgtccagtgtgaggtgcagctgttggagtcgtgggggagcttggtacagccgtggggggtccctgagactctcctgtgcagcctctggattcatctttagcagctatgtcatcgaccgttcgggtccgccgaggcctaccgaggggaacggggctgggagtgggtctcgtaggtttagttggtaggttagtggttactaccatatacacgcagacctcggtagacgggtccgttacacctntcctccgagacgactaacttaccaaagaaccactactaactatcctagaccaaagtcaaacganccgtaggaagtacgaccggaaggtaccgacggaccgttatacttacgtggtcggaacggaaaccggtcgaacgggtatacggacgtagggtcgtaccgttacgggtaacccgtaacggg

SEQ ID NO: 193073 - DNA, 638 bp, Homo sapiens
  misc_feature: GYAE6OF02ISU03.16.15.B04.1.454.CMB.1.raw
  modified_base (235)..(235): a, c, t, g, unknown or other
  misc_feature (235)..(235): n is a, c, g, or t
  modified_base (510)..(510): a, c, t, g, unknown or other
  misc_feature (510)..(510): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtggtctttttcttgtggcttaattttaaaaggtgtccagtgtgaggtgcagctggttggagtcgtgggggagtcttggtaacngccgtgggggtccctgagactctcctgtgcagcctcgtggattcattctttagcagtctatgtcatcgaccgtgggtccgcgaggcctccgaggggaacgggctggaggtcgggtctcgtaagtttgtgggtggttagtggttactaccacaattacgtacgcacgtacctacggtaggaacgggtccgttacaacctgtcctccgaaggacaactaaacttaccgaaagaaccgaactaccttaatacgtacacgaactaaaagttcggaaacnccggtacctagggaacgaaccgcgggaaacgtaccgaacgggtaccttatacgttaacgcggtaacggacggaaacggtccgaaggtagtccggagttacggtcggaccgttacggaacctaacgggg

SEQ ID NO: 193074 - DNA, 742 bp, Homo sapiens
  misc_feature: GYAE6OF02H44YZ.16.15.B04.1.454.CMB.1.raw
  modified_base (627)..(627): a, c, t, g, unknown or other
  misc_feature (627)..(627): n is a, c, g, or t
tcagtgtactactccacgaccggtgctcgatttagacagtatatatccgcggggagctctgagagaggagcccagccctgggattttcaggtgttttcatttggtgatcagagctgaacagagagaactcaccatggagtttgggctgagctggctttttcttgtggtctattttaaaaggtgtccagtgtgaggtgcagctgttggagtcgtgggggaggtcgttggtacgagcccggtggggggtcccctgacgacgttcctccgtggtcgcacgtcctcgtggtattctacttcctttagctacgcttaagtcgttacacgtcggtacccgttcggggtccccggccgacgggcctaccgggaagggggaacggggtcgtgggtaggtggggtctcggttaggtttagttggggttgggttaggtttacgggtttaacttaaccgtactaacgttaacccgtaaccggtaccacggtacccgttcccgggttaggggtaaaccgggggtccccggtttaccaaaccccgtaacgttccctacccgaaggtaacgaacctaaacctttacccgaaaacgtaaaccacgtaactaagttaacttctacgaactaacgtacgaaacncgaccgagacgaacgccgaagaccgacggttacctaagttacgttacgtaggtacgaaccggaagggtaccgtaagggtataccggaggtaggtcggtaccggtcgggtaaaccg

SEQ ID NO: 193075 - DNA, 693 bp, Homo sapiens
  misc_feature: GYAE6OF02H6BMQ.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttctgtggcttattttaaaagtgtccagtgtgaggtgcagctgttggagtcgtgggggaggcttggtacaggccgtggggggtccctggagacgtctccgtgtcgcagtcctctggtacttcgattctttaagcagctatgtactatcgtaccgtgggtcccgacacggcctaccgaggggacgggtcgtagggaggtcggtcgtacgtaggttagttgggtaggttagtggttaactaccgtaactaacgtactacgactacgtaccctcggtaggtaaccgggtcccggttaacaaccctaccgttccgtacccgaaaggtaacgtaaacctaaacttaacccgaaaagaaaccctaacctaccttaaagtacttacctaaggtaaacctaaaagttacgaaacctaacggtcccgtaaggaacgtacggacccggtacggacctaccgggtacgtattacttacgtggacgaacggaacggtaccgtaggtatacgcgttaggtcggtaccgtacggtaaccggtaccggg

SEQ ID NO: 193076 - DNA, 881 bp, Homo sapiens
  misc_feature: GYAE6OF02HHYNM.16.15.B04.1.454.CMB.1.raw
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
tcagtgtactactccacgaccggtgctcgatttagacagtatatatccgcggggagctctgagagaggagcccagccctgggattttcaggtgttttcatttggtgatcgagggctgaacagagagaactcaccagtggtagtttgggctggagcgtggtctttttcgttggtggtcttaagttttaaaggtgtccgagtgtgaggtgcagtctgttggagtcggtgggggagtcgttggangccgtcgggggtcctgacgtactctcgtgtgcncgcctgtgacttctacttcgttacgcagtaccttagttcgtaccgacgttacggtacccggttcgggtccccgaccggtaccggtccgtaccggggtaagggggtacgggtccgggttaggggtacgggtttccgggttacttacggttaaggttaggttagggttgggttaacggggttttggttaaaccgtacctacgtaacgttaccggtaaaccgtacgtacccggtaccgttaccggggtacgggtaacccggggttaccgttacccggacctaaccggtccgtaccgaacgggtacctaaaccgttaacgtaaaccctaaacggtaaccttaaccgttaacttacgttaacctacggtacgtaaacctaaaccggtaacggtaaccgacccggttaaccgacggtaacgggaacccgtaaccggggtaaccgggtaaccgggaaacggtttacccgtaaccggttacggtttacgggttaacccgggtaacggtaaaccgggaacccgggttaaacgggtaaccggtaaggttcccggtaaagggttcccggggttcgggtttaaaccccggttaccggaacccggggttaacccggggg

SEQ ID NO: 193077 - DNA, 799 bp, Homo sapiens
  misc_feature: GYAE6OF02H01DH.16.15.B04.1.454.CMB.1.raw
  modified_base (478)..(478): a, c, t, g, unknown or other
  misc_feature (478)..(478): n is a, c, g, or t
tcagtgtactactccacgaccggtgctcgatttagacagtatatatccgcggggagctctgagagaggagggcccagccctgggattttcaggtgttttcatttggtgatcagggctgaacagagagaactcaccatggagttgggctgagcgtgtcgttttcttaggtggctaatttaaaaggtgtccagtgtgaggtgcagtctgttggagtgtgggggagcgttggtacgagtccgtgggggtccctgagactcctcgtgtcgcgagcctcgtggtattacattcttagcagctatgtacagtcgacgtacggccaaccgtggcgaccgagggaacggggtcgtgggtaggtggtccttgtaagtttgttcggttagggttacggtttagggttactaaccgtaactacgtaaccgtacgaccgtaacgtaacccgttccggtaagggtaacgggttcccgtttacaaacccgtntacccgtacccgaagtacggaaaccttaaacgttaacccaaagaaaccctaacgaaccttaattaacgtaccgtaagaaacctaaagtaccggaaaacgtatacccggtaagaagggtacccggaaccggaaacgggttaaaccctaccccggggtaacgtttaaaccgtttaacgttaacccggttcggggttaacggaaaaacccggggtaaccggggtaaccccgtttaaaagggggtttaacccgtacgggaaccggtttagggttaaacccgggggtaacctttaccgggggaaaaccccggttaaaccccggggg

SEQ ID NO: 193078 - DNA, 586 bp, Homo sapiens
  misc_feature: GYAE6OF02HS9VT.16.15.B04.1.454.CMB.1.raw
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcggtgtcgtttctaggtcgctaatttaaaggngtcagtgtgaggtgcagctggttggagtcgtggggagtcgttggtacagccgtgggggtaccctggacgtcctntcctgtagcagtcctgtagnttcagttcttgcagtctagtcgtnacttgcgtcggtccngacggctcgaagggaggctggnggtggtcctagtattgttgggtcgtagttcggttanaccgataccgtacanaccgngtacctcggtaaggacggtccctaanaccgtactacgtcaagataactaacgaacaacgtaacagttatatcggtanacgtaacaaagtcaacgacgcgngngacgacgacgacgacgtacgtagttagtacgtacgacgaacggtacggtacggtacgagacgtcgtagtcggtacggtacgtacggtacgg

SEQ ID NO: 193079 - DNA, 672 bp, Homo sapiens
  misc_feature: GYAE6OF02GAP9R.16.15.B04.1.454.CMB.1.raw
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaaccatggagtttgggctgagctgtcttttctgtggcttaagttttaaaggtgtccagtgtgaggtgcagctggttggagtcgtgggggagtcgttggtacngccggtgggggtccctggagctctcctggtgcagcctntcggattcattctttagcagtctatgtcagtcgaccgtcgggtccnccgaggtcctccggaggggagggcgtggaggttgggtactcgtagtttgttgggtacgggttagttacggttactaccgtaacagttactaccgacgtaagtacccggttcggtacgggaacgggttcccgtaccaaccgtactccgtaccgagacgtaacctacttaccaaacgactaacaactagttacctagttacgaactaatacgaacacggtctaaggacgaaccgaccgggtaacggacccgtaaccgggtcgtaattacgttacgttacgggaacggacggaaacgggacccgtaaggggtactaaggccgtaaggttaccggcggttaaccggacccgtaacggggg

SEQ ID NO: 193080 - DNA, 1050 bp, Homo sapiens
  misc_feature: GYAE6OF02IOSWL.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagcgtggtcttttcttggtggcttaattttaaaggtgtccagtgtgaggtgcagctgttggacgtcgtgggggagtcgttcggtacacggtccggtcgggggtccctaggacgtaaccgttcctccgtggtcgccgtacggtccttcgtggtaactttcaactttaccgttttaagccgaggtcttaacttcgtacgtaacgttccggtaccggtttcggggacccggtacccgtacgggacccgttacccggggaagggggtaacgggggtcctaggggtaacgggttcggggttaccttaccgttaggtttaacggttttagggtttacggggttaacggttttacgggtttaccttaaacccgtaaccgttacgttaaaaccggtaccggtaaccgtaaccggtttacccggttaccccggggttaaggggtaaacccggggtttccccgggtttaaaccccgtaacccgtaaccgtttaccctaaacccggtaacggtaaaccggtaaaccgttaaaccttaaccccgaaaaacgggttaaacccctaaaccgttaaaacgtttaaactttaaccgtaccggtttaccgaaaaccgtttaaaacggtaaccgttaaaacccgaacccgggtttacccgttaacggggtaaaacccgggtaacccggggaaaccccggggtttaaacccggaaacccgggttaaaccccggggtaaaccgttttacccggttttaaaacggtttaacccgggtttaacgggtaaccggggtaaacccggggtaaaaccggggtaaccccggggttaaaggggtttaaaccgttacgggacccggtttaacggggtcgtttaaacccggggtttaaacccggggaaccccgtttaaaacccggggggggg

SEQ ID NO: 193081 - DNA, 827 bp, Homo sapiens
  misc_feature: GYAE6OF02F9OPK.16.15.B04.1.454.CMB.1.raw
  modified_base (276)..(276): a, c, t, g, unknown or other
  misc_feature (276)..(276): n is a, c, g, or t
tcagtgtactactccacgaccggtgctcgatttagacagtatatatccgcggggagctctgagagaggagcccagccctgggattttcaggtgttttcatttggtgatcagggctgaacagagaggactcaccatggagttttggctgagttgggttttccttgctgctattttaaaaggtgtccagtgtgaggtgtacttggtggagtctggaggaggcttgacccaggccgggggggtccctgagactctccgtgtgcacgcctcgtgggttcngcgtcaacgtaacaaccacgtagattggtcgggtcccgccacgccctaccgagggggaacggggcctgggaacgtggggtctacgagtttattagaaaattggagtggtagaactacaattccgtaccggaccgtacgtccggtaggaacggggtacccgtaattcccgaacctacttcccgtaccgaaggaacgaaccctaaacgtttaccccgaaaaggtaaccgtacgggtaacgtaaactttacccttaacgaaaacgttacgaaaacccgtaggttaccccgttaaggaaaccgggtaaacccgggaacgggtaaacccggtacccggggttaccgttaaagtttaaccgttttacgtttagggttaaacttttaaggggttttaacgtagggggtttaacggtttaaccgggtttcccgggggtacccccgggttaggggggaacccggtaaaccggggggttaaccccggttcgggttaccccgtaacccggtttcccttaccccgtaccgaacccggttccccgtaaccccgtaaccccgggg

SEQ ID NO: 193082 - DNA, 898 bp, Homo sapiens
  misc_feature: GYAE6OF02GXJ8X.16.15.B04.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcacatggagttggctgagctggtcttttctgtgctatttaaagngtcagtgtgaggtgcngctggttggagtgtgggggaggtcgttgggtacacgggtccggtcggggggttaccctggtaacgtaccttcccgttccgtggtacgaccgacgtaccctccgtagggttactttacgtaacgtttccgttttaaggccgaagttaccgttaagttacgttactacggttaccggtaccggttaccggggggttccccgtaccggtaacgggtcccgtaaccgggaaaggggggggttaaccggggtccggtttacggggggacggttacggggggttacccttacggttaaagggtttacggtttacggggttaaggggttaacggggtttaacgggtttaaactaacccgtaaacgttaaaccgttaaacccggtaaccgtaaccgtaaacggtaacccgtttacccggggtaacgggtaaacccgggggttacccgggtttaaccgaacccgtaattaccccgttaaccgaaagggtaaacgaaacctaaacgttaaccgaaaacggtaaacccaaaccgtaactttaacggtaactcccgtaagtaaaccaaaaggttcgaaaaccgtagtacccgagtaaacggcggaccgggaaccggaacgtaacccgggtactaagtttacgttcggtaacggtcgaaacgggaaccggtagaaggggttaacagacggtcggttaggccggttaacggaaccgtaacggg

SEQ ID NO: 193083 - DNA, 628 bp, Homo sapiens
  misc_feature: GYAE6OF02FK0Z9.16.15.B04.1.454.CMB.1.raw
  modified_base (184)..(184): a, c, t, g, unknown or other
  misc_feature (184)..(184): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (464)..(464): a, c, t, g, unknown or other
  misc_feature (464)..(464): n is a, c, g, or t
tcagtgtactactccacgaccggtgctcgatttagacagtatatatccgcggggagctctgagagaggagcccagccctgggattttcaggtgttttcattttggtgatcagggctgaacagagagaactcaccatggagtttgggctgagctggtctttttcttgtggctattttaaaaggtntccagtgtgaggtgcagctgttggagtctgggggagcttggtacagccgtgggggtccctgagactctcctgtgcagcctctggattcattctttagcagtctatgtcagtcgaccgtggtcccnccgagcctaccgaggggagggctaggagtcggtctacgngtttatggtgtgtgttacacacatacacgtcagtactccgtaggaacgggtccgttacgaccatcctacgagaacgactaacttacccaaagaacctaacacttaactagtactanactaaacgtagaaaccgtagtccgtaaggacggtaaccgccgggaaaggacccgtacgggacctttaagttacgtaccgttggtaacgaacgggtaaacggtaccgtaagggttactacgggtacggaggtttacggaccgtttaccgggaaccctaaccgggg

SEQ ID NO: 193084 - DNA, 665 bp, Homo sapiens
  misc_feature: GYAE6OF02FIZXL.16.15.B04.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttcttgtggctattttaaaaggtgtccagtgtgaggtgcagctgttggagtcgtgggggagcttggtacngccgtgggggtccctgngactctcctgtgcagcctcgtggtattcattctttagcagtctatgtcatcgaccgtcggtaccaccgaggcctccggaaggggaacggggcgtagggaggtgggtactcgtaggtttagttgggttagggttaggttagggtttaactaacctaacgtacttaaccgtacgaccacgtacccgtccggtagggaaccggggtcccggttaccaccgtacttcctaccgaacgtaacgaacctaacgttaaccaaacgaaccactaactattaatcgtagactaaaagtacgaaacacgtcctagagtaccggaccgaaggaccgacggtccgtattacgttacgtggtaacgacggaaacggccggtaaggtaacgacgtacggacggttcggcggttacggtaacccggtaacgggg

SEQ ID NO: 193085 - DNA, 710 bp, Homo sapiens
  misc_feature: GYAE6OF02H8TY2.16.15.B04.1.454.CMB.1.raw
  modified_base (192)..(192): a, c, t, g, unknown or other
  misc_feature (192)..(192): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccagtggagttggctgagctggtctttcgtgtgctaagtttaaagtgtcagtgtgagtgcngcttgttggagttacggtgggggagtcgttaggaccacggtccggtcgggggtcctaggacgtaccttccgtacctgtacgcgtacgtccgttgtcggattcctatttcgtttaacgcgtacgtactagtacggtctaagtcggaccggttcccggggttaccgcccgaacggccgtacgggaacgggggtaacgggtcgtaggggtagtcgggttccgtagttaaggtttcggttagggttacggttaagggtttacggttaacctacgaaactacgtaaccggtacgtaccgtacgggtccgtaaccggttgggtaaacccggggtcccggttacctaaccctacgtccgtaacgtagaaccgtaatacttaacgaactaaccgactaacgtntaacgttntacgtaacaagtacaacgacgaccgtgaacggtacgaccgtaacgcgaccgtaccgtatactacgtagacgacgtaacgcgtagtagcgtacggcgtcgacgttcgacggtacgg

SEQ ID NO: 193086 - DNA, 774 bp, Homo sapiens
  misc_feature: GYAE6OF02JG1BY.16.15.B04.1.454.CMB.1.raw
  modified_base (363)..(363): a, c, t, g, unknown or other
  misc_feature (363)..(363): n is a, c, g, or t
  modified_base (624)..(624): a, c, t, g, unknown or other
  misc_feature (624)..(624): n is a, c, g, or t
tcagtgtactactccacgaccggtgctcgatttagacagtatatatccgcggggagctctgagagaggagcccagcccctgggattttcaggtgtttttcatttggtgatcagggctgaacagagagaactcaccatggagtttgggctgagctggtctttttcttgtggcttaattttaaaaggtgtcctagtgtgaggtgcggctagttggacggcgtgggggagtaattggtacaggccggttcgggggtccctggacgacctcgtcctggtagccgacgtccttcgtggtacttcctacccgtttcggacgtacggttactcgtacccagttacggaccggttcgggttccccgaccgnggtccgtacccggaagggggaacgggtcgtagggtaacggttcggggttacctacggtagggttaatttagggttggtttaacggtgggttacgggttaacgccgaacttacgttaaaccggttacgcgtaaccggtaccgttaccgggttacgggtaaccgggtcccggtttaacctaccgttaactcccgtacccgaaggaaccgtaacctaaacgttaaccgaaaacggaaattctaccggtacttaagttaccggtntccgtaatacgtaattcggaccaagtacccgtagaaggaacgaaccgaacggtaaccgcggttaacctacgttacttaacctacggtcggtaacgcgtaccccgaacccgtccccgtaccgtaccagttcccggtagtacctgggtacgg

SEQ ID NO: 193087 - DNA, 176 bp, Homo sapiens
  misc_feature: GYAE6OF02GU0M4.16.15.B04.1.454.CMB.1.raw
  modified_base (168)..(176): a, c, t, g, unknown or other
  misc_feature (168)..(176): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagttggctgagcggctggcaaggcgcatagnnnnnnnnn

SEQ ID NO: 193088 - DNA, 846 bp, Homo sapiens
  misc_feature: GYAE6OF02GN9OO.16.15.B04.1.454.CMB.1.raw
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggtctttttctgtggcttattttaaaaggtgtcagtgtgaggtgcagctgttggagtcgtgggagaggtcgttggtacagtccgtggggggtccctgacgtactctcctgtcgcagtcctcgtggtcttctattcttagcagtcttatcgtactagtcggtaccgtcgggtaccaaccgtacggacctaccggaagggggaacggggtcgtagggtacggttcgggtaccttacgtaaggtttaggtttcggggttagggtttaacggtttacgggtttaaaccttaaccccgtaaacgtaaccgttaaccggtaacccgtacgtaaccggtacccggttacccgggttaagggtaaccgggggttccccgtttaccctaaacccgttacgtttacccgtaaccccggtaagggtaaaccgtaaaccggttaaacctttaacccccggaaaaagtaaaccccgttaaaccgtaaacttaaacgttaccgtaaccgttacgaaaacgtaaacgttaccgaaaaccgtacggtacccgtaagggtaaccggaccggaaccggaaagggtaacccgttaccgggtaaccttagttaaacgtttccgtaagggtacggtaaaccgggtaaacgggtcccggttaaggttaacgtacggaacgttacggggtacggttaccggtaacggtaaacccggg

SEQ ID NO: 193089 - DNA, 852 bp, Homo sapiens
  misc_feature: GYAE6OF02G314F.16.15.B04.1.454.CMB.1.raw
tcagtgtactactccacgaccggtgctcgatttagacagtatatatccgcggggagctctgagagaggagcccagccctgggattttcaggtgttttcatttggtgactcagggctgaacagagagaactcaccatggtagtttggctgagctggtcttttctgtggtcttagtttaaagtgtcagtgtgaggtgcagtctgtggagtcggtggggagtcgttggtacaggtccggtcgggggtccctaggtacgtaccgttccgtaccgtggtcgccgtacgccgttcgtaggtacttactacgttacgtttaacgctaggtacttaagttcgtactacgtacggtaccggtcgggtacccgtaccggtacggtaccggtacgggaacgggggtacgggtcggttacgggtcggttcggtaccgttacggttacggtttaggttcgggtttacgggtaggtttacggttaaccgttaaccgtacgttaaccgtaccgtacggaaccgtaacggtaccggttaccgggtaccggggtaaccggggttcccgttaaccaacccgttaggtaaccccgtaccgtaaaggtaacccgtaaacgttaacgtaaacccgaaacgtacctaaaccgttaagtttaacgtttaacgccgttaaacgaaaccgttaaaggtaccgtaactacccggtagtaaggaaccggtaaccggaccggtaacggtaacccgtaacggttacccgttaagttaccgtttacggacgggtaaccggtaaacggtaaccggggtaccttaaggggtacacggttacggacccgggtttagaacccgggttaacgtacgggtaacccggg

SEQ ID NO: 193090 - DNA, 634 bp, Homo sapiens
  misc_feature: GYAE6OF02FPFQ3.16.15.B04.1.454.CMB.1.raw
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctagctttttcttgtggctattttaaaaggtgtccagtgtgaggtgcagctgttggagtcgtgggggaggcttgggtacaggccgtggggggtccctgagactctcctgtgcagcctctggattcatctttagcagctatgtcatgacctggccncnggcncgagggagggctggagtgggtctnagttagttggtggtaggtggttactaccacactaacacgacgagacctccggtaggaacggggtcccgttcaacctatacctccgaacgacgaactaaacttaccaaagaaccaacgaactacttactctacgaacaaatacgaacctaggacctaggaacggacggaccgaaagggaccaaccgggaccttaagttacgtaaccgtaggtccgtaacggggaaaacggtccggtaacgggttaagtaaccgggtactaggggtacggtaccgttacgggtaaaccccgtaaaccgggg

SEQ ID NO: 193091 - DNA, 733 bp, Homo sapiens
  misc_feature: GYAE6OF02GFK48.16.15.B04.1.454.CMB.1.raw
tcagtgtactactccacgaccggtgctcgatttagacagtatatatccgcggggagctctgagagaggagcccagccctgggattttcaggttgttttcatttggtgatcgagggctgaacagagagaactcaccatggagtttggctgagctggtctttttctgtggtacttaagttttaaaaggtgtccaggtgtgaggtgcagtcttgttggagtcgtgggggaggtcttggtacacggtccggttggggggtccctggacgtaccttctccgtggtcgcgacgtcccttcgtaggtattcctagtttcgtttaggcgtacggtacttagtcgtacctagttcggaccggttcggggacccgccggtaggtccgtacccgggaagggggtaacgggtcgtagggtaggttcggtccgtacgtagtttgttgggtaggttacggttaggttaacctaccgaactacgtaaccgtacgacgtacgtaccgttaccggtacgggtaccgggtcccgtacaaccgtacgttccgaccgtaaggaactacttaacgttaccgaaactaacaacctaattaatctacgtacgaacaagtacaagccgtactaggaacgacggaaccggaacgacggtaacccggtacttaaagttacgttcggtggtaacggaacggtaacgtacggtaaggttacacggtcggtacggtcggtactacgggtacccgtaacgggg

SEQ ID NO: 193092 - DNA, 991 bp, Homo sapiens
  misc_feature: GYAE6OF02FQM9R.16.15.B04.1.454.CMB.1.raw
  modified_base (180)..(180): a, c, t, g, unknown or other
  misc_feature (180)..(180): n is a, c, g, or t
tcagtgtactactccacgaccggtgctcgatttagacagtatatatccgcggggagctctgagagaggagcccagccctgggattttcaggtgttttcatttggtgatcgagggctgaacagagagaactcaccatggagtttgggctgagctggctttttctgtggctattttaaaggntccagtgtgagtgcagctgttggagtcgtgggggaggtcttagggtacacggcccggttggggggtccctggacgtaccttccgttccgtggtacgtccacgtccctcgtggtactttccgtaattccgttttagaccagtaccttatcggtactaacgttcggtaacccggttcggggtaccccgtacccggaagggtccccgttccgggaacggggggtaacgggggttccggagggggtttaaacgggtcgggggttcccgttaacggtttaaccggttttagggtttacggggtttacgggttaacgggtttacgggttttaaaccgtaaccctaacgttaacgttaaaccgttacccgggtaacctaaccggttaacccggttcccgggttaacggggaaacccggggttccccggggttacccgttaaccccggtaaccgttcccgtaaccccgacgggttaaacgtaaaaccgtaaaccgtttaaacccgaaaccggaaaacctaaacccggttaaaattaaaccgtttaacgtttaacccgtaaccgtaacctaaaacgttaaacccgggtaaaccgtaacccgggtaccgttaacgggaaccggttaaccggggaacccggaaacccggggtaaaccgaacccggggttaaacccggttaacggtttacccggtttaaccgttacggggttaacccggaaccgggttaaacccgggtaccgggtaacggttaaccgggtacggttaccggttacggggttacggttacccggttaacggggttacccctaaacccggggggg

SEQ ID NO: 193093 - DNA, 179 bp, Homo sapiens
  misc_feature: GYAE6OF02GMKAW.16.15.B04.1.454.CMB.1.raw
  modified_base (149)..(179): a, c, t, g, unknown or other
  misc_feature (149)..(179): n is a, c, g, or t
tcagtgtactactccacgaccggtgctcgatttagacagtatatatccgcggggagctctgagagaggagcccagccctgggattttcaggtgttttcatttggtgatcaggggcttgaacagagagaactcaccatggtagtttgggnnnnnnnnnnnnnnnnnnnnnnnnnnnnnnn

SEQ ID NO: 193094 - DNA, 813 bp, Homo sapiens
  misc_feature: GYAE6OF02HCIVT.16.15.B04.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (731)..(731): a, c, t, g, unknown or other
  misc_feature (731)..(731): n is a, c, g, or t
tcagtgtactactccacgaccggtgctcgatttagacagtatatatccgcggggagctctgagagaggagcccagcccctgggattttcaggtgttttcatttggtgatcagggctgaacagagagaactcaccatggagtttgggctgagcgtggtctttctggtggcttaatttaaaggtntcagtgtgaggtgcngtctgtggagtgnggggagtcttaggacacggccgggtcggggtcctggacgctctcgtgtcgcgcgtcctcgtgtacttactactttccgttagaccgtagttactacgttgtacaccgttacggaccccgttaccggggaccccaaccggaaccggggttcccggtaaccgggtaagggggggtaaccgggtggtcgggggttaacggttcggggacctttacggttaaagggttttcggtttggggttacggggtttaggtttaacggggtttaacctaacccgtaacctaacgtttaaccgaacccgtacgtaaaccggtcgttacccgggtaacgggtaaccgggttcccggtttaccaccgtaccgtaccttaaaccggaggtaaacccgtaaactaaacccgttaaccgaaacgtaaacccggtaccttaaacttaccgtacgttactaacgaataaccgaaagtacctacgtccgaaggaaccgacggtaccgaaccggacgaccgttaccgtaacgttacgttntaacggcggtaacggtaacggtaacgagggtttacgaacggtacgtacgggtaggtacccggtacggtaacccgtaccgggg

SEQ ID NO: 193095 - DNA, 790 bp, Homo sapiens
  misc_feature: GYAE6OF02HHVSA.16.15.B04.1.454.CMB.1.raw
  modified_base (633)..(633): a, c, t, g, unknown or other
  misc_feature (633)..(633): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggtagtttgggctgagctggtcttttttcttgtggcttaagttttaaaaggtgtcctagtgtgaggtgcagctgttggagtcgtgggggaggcttggtacagccgtcgggggtccctggacgactcctctgtgcacgtcctcgtggtacttcattactttacgcgtagtcttaagtcgttacagttcgtaccgtcggggtcccgccgacggtccgtccggaaggggtaacggggtccgtaggggtacggtcgggttctacgtaggtttgtttcgggttgggttaggttacggtttaacctaccctaacgtaacgttaccgttaaccgaccgtaacggtacccgttaccgggtacgggtaaccggggttcccgtttaccaacccgtctttacccgtacccgaacggtaaccgtaaacgttaaaccgttacccgaaacggaacccgtaactaacttagtactcgttagaactaaagcgtaaacgccgtacgtagggaacncggtaaccccgaggtaacccgacggtaaccgtttaagtttccgttaacggttcgggtaaccggtaaccggggttaaacgaccggtttaacggggtaacttacgggtaccgttacgggttcggttaaacccggttccgggtaaccggtaacccggggg

SEQ ID NO: 193096 - DNA, 688 bp, Homo sapiens
  misc_feature: GYAE6OF02GUQ0K.16.15.B04.1.454.CMB.1.raw
  modified_base (304)..(304): a, c, t, g, unknown or other
  misc_feature (304)..(304): n is a, c, g, or t
  modified_base (558)..(558): a, c, t, g, unknown or other
  misc_feature (558)..(558): n is a, c, g, or t
  modified_base (624)..(624): a, c, t, g, unknown or other
  misc_feature (624)..(624): n is a, c, g, or t
  modified_base (655)..(655): a, c, t, g, unknown or other
  misc_feature (655)..(655): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggtagtttggctgagctggtctttttcttgtggcttaagttttaaaaggtcgtcagtgtgaggtgcagcttggttggagtcggtgggggaggtcgttggtacaggtccggtgggggtccctggagtcctctcgtgtgcacgccttcgtggtacttctacttcttttagntacgtcttaagtcgtacagttcggtacccggttcgggtcccgaccggtacggccgttaccggaagggggtacgggtcggtagggtagggtttcgggttacctaggttagtttaggtttcgggtaggttaaggttcgttactaacccgtacgtaacttaccgtcgtacgacgttaccgtccggtagaaccgggttcggtacactacgtctaccgaagataactactaacaaacactaaccgaactagtacttacngtaaaccaatcgaacgaccgcgtaagacggaacgaccggacggaacgtacgaccgttaatttaccncgtagtcggaaccggtaggacgtacgggtanacgtacgcggtagtcgtacccggtaacgtcggg

SEQ ID NO: 193097 - DNA, 702 bp, Homo sapiens
  misc_feature: GYAE6OF02GJFON.16.15.B04.1.454.CMB.1.raw
  modified_base (259)..(259): a, c, t, g, unknown or other
  misc_feature (259)..(259): n is a, c, g, or t
tcagtgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtcgtgggggaggcttggtacagccgtggggggtccctgagactctcctgtncagcctctggattcattctttagcagctatgtcatgaccgtgggtccaccgaggcctccggaggggacggggctagggagtgggtctcgtaggtttagttgggtggttaggttagggttactaacccgtataacttaccgtacgacgacgtaccttaccggtagggaaccgggtcccggtttacacccgtacttccctacgagaacgaactaacttaccgaaacgtaaccacttaactaattactacgttacgaactaaactacgaaactcggtaccgtaggaacggtaccggaccggtaaacgggaacccgtaaccgggtacccgttaagttacgtttaaccgttacggtacggaaaccgggtaaacggtcccggtaaggggttaactacgggaccggtaacgggttacggtccgttaccgggtaacccgttaacccggggg

SEQ ID NO: 193098 - DNA, 791 bp, Homo sapiens
  misc_feature: GYAE6OF02JBB7W.16.15.B04.1.454.CMB.1.raw
  modified_base (209)..(209): a, c, t, g, unknown or other
  misc_feature (209)..(209): n is a, c, g, or t
  modified_base (279)..(279): a, c, t, g, unknown or other
  misc_feature (279)..(279): n is a, c, g, or t
tcagtgtactactccacgaccggtgctcgatttagacagtatatatccgcgggggagctctgagagaggagcccagccctgggattttcaggtgttttcatttggtgatcagggctgaacagagagaactcaccatggagtttggctgagctggtctttttcgtgtggtacttaagttttaaaaggtgtccagttcgtggaggtgacgngtcttggttaggtacgtgggtagggggacggtcgttgggtacgacggtccggtacggggggtcccctggngtaccctccgtcgtggtgcgacgtcctcgtggtacttcgtactttacgtttcgcctaagttccttagtacgtctaagttccggtacccgtcggggttacccgccgaccggtcccgttaccggggaacggggaacggggggacgttggggtacggttccgggttacgttcgttaggtttaggttagggttaggggttaacggtttggttaacctaacaccgttaacgttaccgaacgtcgtaacggaccgtacggtacggtacgggtccggtaccactcgtccgtacgacgaactagtaaccttacgaaaccgtaactaacgtactaaggttactacgtaataacccgtaaagaacgtaaccacgacccgtgggtaaacccgacgggaaccgaaccgggaaacccgtaccgggaccgtttaaggttacgttaacgtcgggtaagaacccggacgggaccggtacggtaacggacgcggtacgtccgggacgttaccgggacgtaacccggggg

SEQ ID NO: 193099 - DNA, 810 bp, Homo sapiens
  misc_feature: GYAE6OF02FN839.16.15.B04.1.454.CMB.1.raw
tcagtgtactactccacgaccggtgctcgatttagacagtatatatccgcggggagctctgagagaggagcccagccctgggatttttcaggttgttttcatttggtgatcgagggctgaacagagaagaactcaccatggagtttgggctgagcgtggtcttttcgttgtggtctaattttaaaaggtgtaccagtgtgaggtgcagtcgtgttggagttcggtgggggaggtcgtttagggtactacggtacccggttcggggggttccccgtggtaacgtaccgttccgttccgtgtcgcgaccgtccttcgtaggtcttactagtctttagacgagtcttattcgtacgtacgtccggtaccggttccgggacccgtccggtacggccgtaccgggtacgggggtaacggtcggttaggggtcgggttcgggtaccggttacgtttacggtttaggtttacgggttaggggttaggttacggttaacgttaacccgtaaacgttacgttaaaccgtaaccggtaacgtaaaccgttacccggttaccggtacgggtaacgggtcccggtttaccaacgttacgtaacccgtaccgtaacggaaacgtaaactaaaccgtaaccgaaaacgtaacctaacgttaactatacctgtaaacgtaccaagttacgaacgtacgacgaggtaaccgaggtacccgaacgaaaccgtcggtaacttataaccgtgttaggtaacccgaaggttaccgcggtaaggttaacctggtaagtcgggtaaccgtcggtaacggtaccgtaccgggg

SEQ ID NO: 193100 - DNA, 679 bp, Homo sapiens
  misc_feature: GYAE6OF02HWXDX.16.15.B04.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (566)..(566): a, c, t, g, unknown or other
  misc_feature (566)..(566): n is a, c, g, or t
tcagtgtactactccacgaccggtgctcgatttagacagtatatatccgcggggagctctgagagaggagccccagccccgtgggatttttcaggttgttttcattttggtgatcagggctagaacagagagaactcaccagtggagtttgggctgagcgtgtcttttctgtgcttaatttaaagtgtcngtgtgagtgcngctgttaggagtcgtgggggagtcgttggtacgaggtccggttcgggggtccctggacgtctccgtccgtgtcgcgacgtccttcgtcggtaacttcgtacgtttacgtttacgactagtcttatcgtactagtcggtaccgtcgggtcccncgacgtcctcggagggtacgggtgtggngtggtctgtagttgtggtgtagttagttactactactactacgtactcgacgacttacccggtagtaccgggttcccgttacaccgtacgtcctaaccgacgtactaacctaacttaaccaaacgtaaccacttaacgttaactaccgttacgtacgactaaagtcgaactacgtctacgggacnccggaccgaacgggaactccggtaacgtagttactacggtacggacgtaccggaaccggtcgttaacggtatacgggtggtaacgtccggacgttaccggtaccctaccgggg

SEQ ID NO: 193101 - DNA, 801 bp, Homo sapiens
  misc_feature: GYAE6OF02JOCAI.16.15.B04.1.454.CMB.1.raw
  modified_base (245)..(245): a, c, t, g, unknown or other
  misc_feature (245)..(245): n is a, c, g, or t
  modified_base (727)..(727): a, c, t, g, unknown or other
  misc_feature (727)..(727): n is a, c, g, or t
  modified_base (760)..(760): a, c, t, g, unknown or other
  misc_feature (760)..(760): n is a, c, g, or t
tcagtgtactactccacgaccggtgctcgatttagacagtatatatccgcggggagctctgagagaggagcccagccctgggattttcaggttgttttcatttggtgatcagggctgaacagagagaactcaccatggagtttggctgagcgtggtctttttcgttgtggtacttagttttaaaaggtgtccagtgtgtaggtgcagtcgtggttggagttcggtgggggagtcgttgggtaacncggtaccggtcggggggtccctgaacgtcctcgttccgtgtacggccgacgtcctcggttggtacttcgtacttacgtttaggctaggtcttattcgaactgtacgaccttcgggccctaaccggccgaccggtaccgaacgggggtacggaccggttaggggtacggttcgggtaccttacgtaggttttaagtcgggttagggtacggtttacgttacgtaacgtactaacgtaccgttacgaaccggttaacacccggttaccggacgggttaacgggtacccgttaacccgtaacccacgtttacccgtacggtaacacggtaacttaaccgggtaaacccaaacggttaacccaattaaccgtttaactattaaacccgtcgttaaaaccaagtaacctaaacggaccgttaccgaacgggtacggaccgttacccgaacggtacgaaaccgggttcccttaaaggttcttaacggnggtacgaaccggtaaggaacggtacgggttaanccggttacgacggtggttacgtacggggtaacctaccgggg

SEQ ID NO: 193102 - DNA, 846 bp, Homo sapiens
  misc_feature: GYAE6OF02I8845.16.15.B04.1.454.CMB.1.raw
  modified_base (428)..(428): a, c, t, g, unknown or other
  misc_feature (428)..(428): n is a, c, g, or t
tcagtgtactactccacgaccggtgctcgatttagacagtatatatccgcggggagctctgagagaggagcccagccctgggattttcaggtgttttcatttggtgatcagggcctgaacagagagaactcaccagtggagtttggctgacgctggtcttttcttcgtggtacttaatttttaaaacggtcgtaccgagtgtagaggttgcgagcgttggttggacgtcgtgggggacgtcgtttagggaacacggtccggttcggggggtccctggacgtactccgttcctaggtcgacgaccgtccgttcgtacggtctttcgaacgttccgtttagccagtcgtaactggttaacctacgtaggtccgtccggtacccggaccgtggtaccgtacccggaacgggggtacgggcgttaacggggnggttcggtcttacgtaaggtttacgtttgggtggggttaaggtttacggtaaccgttaacccgacgttcgttaaaccgtaccgggacttaacgggtaaccgtcccggtagggtaacggggtcccgttacctaaccggtacttacccgtacgaaacgcggttaaaccttaacgaaccgaaacgtaaacccacggtaaccttaagttccaaccgtcgtaaccgaacgttagaacctaccggaccgtggaaacgaccggggttacccgaacggttacccgaaacgggttacccttacggtttaactttaaccggaggttaccgggtaaaacgaacccggggccggttaaagggttttaaccgacccgggttaaagggcccggtttacggaacggttttacccggggaaaccccacgggggg

SEQ ID NO: 193103 - DNA, 429 bp, Homo sapiens
  misc_feature: GYAE6OF01C3D4N.37.46.E02.1.454.CMB.1.raw
  modified_base (425)..(429): a, c, t, g, unknown or other
  misc_feature (425)..(429): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattatgtatgtatagcagtggctcagggtactactacgggatggacgtctggggccaagggaccacggtcaccgtctcctcagcctccaccaagggcccatcggtctccccctggcaccctcctccaagagcacctctggggcacagcggccctgggctgcctggtcaaggactacttccatctacactactgagcgggctggcaaggcgcatagnnnnn

SEQ ID NO: 193104 - DNA, 431 bp, Homo sapiens
  misc_feature: GYAE6OF01AWTZP.37.46.E02.1.454.CMB.1.raw
  modified_base (426)..(431): a, c, t, g, unknown or other
  misc_feature (426)..(431): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggccgtgtattattgtatgtatagcagtggctcagggtactactacgggatggacgtctggggccaagggaccacggtcaccgtctcctcagcctccaccaagggcccatcggtcttcccctggcaccctcctccaagagcacctctggggcacagcggccctgggctgcctggtcaaggactactccatctacactactgagcgggctggcaaggcgcatagnnnnnn

SEQ ID NO: 193105 - DNA, 430 bp, Homo sapiens
  misc_feature: GYAE6OF01C8BXX.37.46.E02.1.454.CMB.1.raw
  modified_base (425)..(430): a, c, t, g, unknown or other
  misc_feature (425)..(430): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctcaccaagggcccatcggtcttcccctggcaccctcctccaagagcacctctggggcacagcggccctgggctgcctggtcaaggactacttccatctacactactgagcgggctggcaaggcgcatagnnnnnn

SEQ ID NO: 193106 - DNA, 429 bp, Homo sapiens
  misc_feature: GYAE6OF01BAFHI.37.46.E02.1.454.CMB.1.raw
  modified_base (426)..(429): a, c, t, g, unknown or other
  misc_feature (426)..(429): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaaggcccatcggtcttccccctggcaccctcctccaagagcacctctgggggcacagcggccctgggctgcctggtaaggactacttccatctacactactgagcgggctggcaaggcgcatagnnnn

SEQ ID NO: 193107 - DNA, 437 bp, Homo sapiens
  misc_feature: GYAE6OF01DBVIA.37.46.E02.1.454.CMB.1.raw
  modified_base (431)..(437): a, c, t, g, unknown or other
  misc_feature (431)..(437): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatgggacgtcgtggggccaagggaccacggtcaccgtctcctcagcctccaccaagggcccatcggtcttccccctggccaccctcctccaagacgcacctctgggggcacagcggccctgggctgcctggtcaaggctacttccatctacactactgagcgggctggcaaggcgcatagnnnnnnn

SEQ ID NO: 193108 - DNA, 446 bp, Homo sapiens
  misc_feature: GYAE6OF01C1OPL.37.46.E02.1.454.CMB.1.raw
  modified_base (196)..(196): a, c, t, g, unknown or other
  misc_feature (196)..(196): n is a, c, g, or t
  modified_base (431)..(446): a, c, t, g, unknown or other
  misc_feature (431)..(446): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagacacggcgtttctgcaaatgaacagcctagaaaaccgnggacacggcctgtattatgtatgtatagcagtggctcagggtactactacgggatgggacgtcgtggggccaagggaccacgggtcaccgtctcctcagcctccaccaagggcccatcgtcttccccctggccaccctcctccaagacgcacctctggggcacacgcggccctgggctgcctggtcaaggctacttccatctacactactgagcggctggcaaggcgcatagcgnnnnnnnnnnnnnnnn

SEQ ID NO: 193109 - DNA, 488 bp, Homo sapiens
  misc_feature: GYAE6OF01A0936.37.46.E02.1.454.CMB.1.raw
  modified_base (202)..(202): a, c, t, g, unknown or other
  misc_feature (202)..(202): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (450)..(451): a, c, t, g, unknown or other
  misc_feature (450)..(451): n is a, c, g, or t
  modified_base (453)..(473): a, c, t, g, unknown or other
  misc_feature (453)..(473): n is a, c, g, or t
  modified_base (475)..(488): a, c, t, g, unknown or other
  misc_feature (475)..(488): n is a, c, g, or t
tcagtagtgtagatcacgaccggtgctcgatttagactcatctacaggggaaagggctggagtgggttggcccgaatttagaagtaaagactaaacacgttacggcgacagcatatgttgcgtcggtgaaaggcaggttcaccatctccagagatgattcaaagaacacggcgtttctgcaaatgaacagcctgaaaaccgnggacacggccgtgtattattgtatgtataggcaggtggctcagggtactactacggggattggacgtcgtggggcctaaggggaccacgggtcaaccgtctcctcagcctccgaccaagggccccagtccggtcttcccccctgggccaccctcctccaagagcacctctcggggcacagcgccctagggctgctggtcaaggctactcatctacactacngagcggctggacaaggcncatacgntnntnnnnnnnnnnnnnnnnnnnnngnnnnnnnnnnnnnn

SEQ ID NO: 193110 - DNA, 440 bp, Homo sapiens
  misc_feature: GYAE6OF01CAJL4.37.46.E02.1.454.CMB.1.raw
  modified_base (434)..(440): a, c, t, g, unknown or other
  misc_feature (434)..(440): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggccgtgtattatgtatgtatagcagtggctcagggtactactacgggatggacgtctggggccaagggaccacggtcaccgtctcctcagcctccaccaagggcccatccggtcttccccctggccaccctcctcccaagacgcacctcgtgggggcacgacgcggccctgggctgcctggtcaaggactacttccatctacactactgagcggctggcaaggcgcatagnnnnnnn

SEQ ID NO: 193111 - DNA, 433 bp, Homo sapiens
  misc_feature: GYAE6OF01CW8IB.37.46.E02.1.454.CMB.1.raw
  modified_base (428)..(433): a, c, t, g, unknown or other
  misc_feature (428)..(433): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattatgtatgtatagcagtggctcagggtactactacgggatgggacgtctggggccaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 193112 - DNA, 435 bp, Homo sapiens
  misc_feature: GYAE6OF01BEJY6.37.46.E02.1.454.CMB.1.raw
  modified_base (429)..(435): a, c, t, g, unknown or other
  misc_feature (429)..(435): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatccggtcttccccctggcgccctgctccaggagcacctccgagagcacagcggccctgggctgcctggtcaaggactacttccatctacactactgagcgggctggcaaggcgcatagnnnnnnn

SEQ ID NO: 193113 - DNA, 434 bp, Homo sapiens
  misc_feature: GYAE6OF01AVN3Q.37.46.E02.1.454.CMB.1.raw
  modified_base (429)..(434): a, c, t, g, unknown or other
  misc_feature (429)..(434): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacggccgtgtattattgtatgtatagcagtggctcagggtactactacgggatggacgtcgtggggccaagggaccacggtcaccgtctcctcagcctccaccaagggcccatcggtcttccccctggcaccctcctccaagagcacctctgggggcacagcggccctgggctgcctggtcaaggactactccatcacactactgagcgggctggcaaggcgcatagnnnnnn

SEQ ID NO: 193114 - DNA, 436 bp, Homo sapiens
  misc_feature: GYAE6OF01CY1LU.37.46.E02.1.454.CMB.1.raw
  modified_base (195)..(195): a, c, t, g, unknown or other
  misc_feature (195)..(195): n is a, c, g, or t
  modified_base (425)..(436): a, c, t, g, unknown or other
  misc_feature (425)..(436): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactacgtacgggatggacgtctggggccaagggaccacggtcaccgtctcctcagcctccaccaagggcccatcggtctcccctgcaccctctccagagcacctctggggcacgagcggccctgggcctgcctggtcaaggctacttccatctacactactgagtcgggctggcaaggcgcatagnnnnnnnnnnnn

SEQ ID NO: 193115 - DNA, 440 bp, Homo sapiens
  misc_feature: GYAE6OF01D14YK.37.46.E02.1.454.CMB.1.raw
  modified_base (336)..(336): a, c, t, g, unknown or other
  misc_feature (336)..(336): n is a, c, g, or t
  modified_base (436)..(440): a, c, t, g, unknown or other
  misc_feature (436)..(440): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctgaaaaccgaggacacggccctatattactgtacgaaaatggcctacggatatgactactattgggactggtacttcgatctctggggccgtggcaccctggtcactgtctcctcagcctccaccaagggcccatcggtctcccctggcnccctgctccaggagcacctccgagagcacagcggccctgggctgcctggtcaaggactacttccatctacactactgagcgggctggcaaggcgcatagnnnnn

SEQ ID NO: 193116 - DNA, 426 bp, Homo sapiens
  misc_feature: GYAE6OF01BYPE5.37.46.E02.1.454.CMB.1.raw
  modified_base (196)..(196): a, c, t, g, unknown or other
  misc_feature (196)..(196): n is a, c, g, or t
  modified_base (330)..(330): a, c, t, g, unknown or other
  misc_feature (330)..(330): n is a, c, g, or t
  modified_base (413)..(413): a, c, t, g, unknown or other
  misc_feature (413)..(413): n is a, c, g, or t
  modified_base (419)..(426): a, c, t, g, unknown or other
  misc_feature (419)..(426): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgnggacacggccgtgtattattgtatgtatagcagtggctcagggtactactacgggatggacgtctgggccaagggaccacggtcaccgtctctcagcctcaccaaggcccatcggtctcccctgcgcctgctcnggagcacctccgagagcacagcggccctgggctgcctggtcaaggctacgttccatctacactactgagcggctggcaaggcncatagnnnnnnnn

SEQ ID NO: 193117 - DNA, 432 bp, Homo sapiens
  misc_feature: GYAE6OF01DPCPX.37.46.E02.1.454.CMB.1.raw
  modified_base (195)..(195): a, c, t, g, unknown or other
  misc_feature (195)..(195): n is a, c, g, or t
  modified_base (422)..(432): a, c, t, g, unknown or other
  misc_feature (422)..(432): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtctggggccaagggaccacggtcaccgtctcctcagcctcaccaagggcccatcggtctcccctggcaccctcctccagagcacctctggggcacagcggcctgggctgcctggtcaaggactacttccatctacactactgagcgggctggcaaggcgcatagnnnnnnnnnnn

SEQ ID NO: 193118 - DNA, 432 bp, Homo sapiens
  misc_feature: GYAE6OF01A2VUI.37.46.E02.1.454.CMB.1.raw
  modified_base (427)..(432): a, c, t, g, unknown or other
  misc_feature (427)..(432): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnnn

SEQ ID NO: 193119 - DNA, 433 bp, Homo sapiens
  misc_feature: GYAE6OF01ESWOQ.37.46.E02.1.454.CMB.1.raw
  modified_base (428)..(433): a, c, t, g, unknown or other
  misc_feature (428)..(433): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgttctgcaaatgaacagcctgaaaaccgaggacacggccgtgtattattgtatgtatagcagtggctcagggtactactacgggatggacgtctggggccaagggaccacggtcaccgtctcctcagcctccaccaaggcccatcggtcttccccctggcaccctcctccaagacgcacctctgggggcacagcggcccctgggctcgcctggtcaaggctacttccatctacactactgagcgggctggcaaggcgcatagnnnnnn

SEQ ID NO: 193120 - DNA, 442 bp, Homo sapiens
  misc_feature: GYAE6OF01DMGGS.37.46.E02.1.454.CMB.1.raw
  modified_base (197)..(197): a, c, t, g, unknown or other
  misc_feature (197)..(197): n is a, c, g, or t
  modified_base (345)..(345): a, c, t, g, unknown or other
  misc_feature (345)..(345): n is a, c, g, or t
  modified_base (431)..(442): a, c, t, g, unknown or other
  misc_feature (431)..(442): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctgaaaaaccgnggacacggccgtgtattattgtatgtatagcagtggctcagggtactactacggggatggacgtctggggccaagggaccacggtcaccgtctcctcagcctccaccaagggcccatcggtcttccccctggcaccctcctccaagancacctctgggggcacagcggccctgggctgcctggtcaaggactacttccatctacactactgagcgggctggcaaggcgcatagnnnnnnnnnnnn

SEQ ID NO: 193121 - DNA, 549 bp, Homo sapiens
  misc_feature: GYAE6OF01CMIJO.37.46.E02.1.454.CMB.1.raw
  modified_base (197)..(197): a, c, t, g, unknown or other
  misc_feature (197)..(197): n is a, c, g, or t
  modified_base (513)..(513): a, c, t, g, unknown or other
  misc_feature (513)..(513): n is a, c, g, or t
  modified_base (516)..(549): a, c, t, g, unknown or other
  misc_feature (516)..(549): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgnggacacggccgtgtattattgatgtatagcagtggctcgagggtactactacggggatgggacgtcgtgggccaagggaccacggtcaccgtctcctcacgcctccaccaacggggccccagtccggtccttccccccgtggccacccctcctccaaagacgccaaccgtcgtcggggggcaacgaggtcggccccgtggggcctcggcccgtgggtaccaaagggtacctaccttcccgaattcctaaccaccttacgttcggaacggccggggaccttagggaccaaacgggtccgacctaaagttaggactgntannnnnnnnnnnnnnnnnnnnnnnnnnnnnnnnnn

SEQ ID NO: 193122 - DNA, 427 bp, Homo sapiens
  misc_feature: GYAE6OF01EV974.37.46.E02.1.454.CMB.1.raw
  modified_base (424)..(427): a, c, t, g, unknown or other
  misc_feature (424)..(427): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattatgtatgtatagcagtggctcagggtactactacgggatggacgtctgggccaagggaccacggtcaccgtctcctcagcctccaccaagggcccatcggtcttccccctggcaccctcctccaagagcacctctgggggcacagcggcctgggctgcctggtcaaggactactccatctacactactgagcgggctggcaaggcgcatagnnnn

SEQ ID NO: 193123 - DNA, 431 bp, Homo sapiens
  misc_feature: GYAE6OF01DG9GB.37.46.E02.1.454.CMB.1.raw
  modified_base (426)..(431): a, c, t, g, unknown or other
  misc_feature (426)..(431): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattatgtatgtatagcagtggctcagggtactactacgggatggacgtctgggccaagggaccacggtcaccgtctcctcagcctccaccaagggcccatccggtctccccctggcaccctcctccaagagcacctctgggggcacagcggccctgggctgcctggtcaaggactacttccatctacactactgagcgggctggcaaggcgcatagnnnnnn

SEQ ID NO: 193124 - DNA, 441 bp, Homo sapiens
  misc_feature: GYAE6OF01DRU1X.37.46.E02.1.454.CMB.1.raw
  modified_base (435)..(441): a, c, t, g, unknown or other
  misc_feature (435)..(441): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacggccgtgtattattgtatgtatagcagtggctcgagggtactacgtacgggatggacgtcgtggggccaagggaccacggtcaccgtctcctcagcctccaccaagggcccatccggtcttccccctggccaccctcctccaggacgcacctccgagacgcacagcggccctgggctgcctggtcaaggctactcatctacactactgagcgggctggcaaggcgacatagnnnnnnn

SEQ ID NO: 193125 - DNA, 473 bp, Homo sapiens
  misc_feature: GYAE6OF01BZPRK.37.46.E02.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
  modified_base (435)..(436): a, c, t, g, unknown or other
  misc_feature (435)..(436): n is a, c, g, or t
  modified_base (438)..(439): a, c, t, g, unknown or other
  misc_feature (438)..(439): n is a, c, g, or t
  modified_base (441)..(473): a, c, t, g, unknown or other
  misc_feature (441)..(473): n is a, c, g, or t
tcagtagtgtagatcacgaccggtgctcgatttagactcatctacagggaaagggcgtggagtgggttggccgaattagaagtaaagctaacagttacgcgacagcatatggttgccgtcggtgaaaggcaggttcaccatctccagagatgattcaaaagacacggcgtttctgcaaatgaacagccctgaaaaccgnggaccacggccctgtattatgtatgtatagcagtggctcagggtactactagggntggacgtctaggggccaagggaccacggtcaccgtctcctcagcctccaccaacgggccctatcggtcttccccctggccaccctcctccaacgacgcacctctcgggggcacagcggcctgggctgcctggtcaaggctacttccatctacactactgagcggctggcaaggcgcatagnntnngnnnnnnnnnnnnnnnnnnnnnnnnnnnnnnnnn

SEQ ID NO: 193126 - DNA, 442 bp, Homo sapiens
  misc_feature: GYAE6OF01BI8DM.37.46.E02.1.454.CMB.1.raw
  modified_base (430)..(431): a, c, t, g, unknown or other
  misc_feature (430)..(431): n is a, c, g, or t
  modified_base (433)..(442): a, c, t, g, unknown or other
  misc_feature (433)..(442): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctgggccaagggaccacggtcaccgtcgtcctcagcctccaccaaggccccatcggtcttcccccctggcacccgtcctccaagagcacctctgggggcacagcggccctggggctgcctggtcaaggactacttccatctacactactgagcggctggcaaggcgcatagnngnnnnnnnnnn

SEQ ID NO: 193127 - DNA, 440 bp, Homo sapiens
  misc_feature: GYAE6OF01B40WV.37.46.E02.1.454.CMB.1.raw
  modified_base (196)..(196): a, c, t, g, unknown or other
  misc_feature (196)..(196): n is a, c, g, or t
  modified_base (431)..(440): a, c, t, g, unknown or other
  misc_feature (431)..(440): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgnggacacggccgtgtattattgtatgtatagcagtggctcagggtactactacgggatggacgtcgtggggccaagggaccacggtcaccgtctcctcagcctccaccaagggcccatcggtcttccccctggccaccctcctccaagacgcacctctgggggcacgagcggccctgggctgcctggtcaaggactactccatctacactactgagcggctggcaaggcgcatagnnnnnnnnnn

SEQ ID NO: 193128 - DNA, 460 bp, Homo sapiens
  misc_feature: GYAE6OF01CAKCN.37.46.E02.1.454.CMB.1.raw
  modified_base (170)..(170): a, c, t, g, unknown or other
  misc_feature (170)..(170): n is a, c, g, or t
  modified_base (439)..(460): a, c, t, g, unknown or other
  misc_feature (439)..(460): n is a, c, g, or t
tcagtagtgtagatcacgaccggtgctcgatttagactcatctacagggaaagggctggagtgggttggccgaattagaagtaaagctaacagttacgccgacagcatatgttgcgtcggtgaaaggcaggttcaccatctccagagatgattcaaagacacggctttcngcaaatgaacagcctagaaaaaccgggacacggcctgtattatgtatgtatagcagtgctcgagggtactatacgggatggacgtcagggccaaagggaccaacggtcaaccgtctcctcagcctccaccaagggcccatcggtcttccccctggccacccgtcctaccaagacgcaacctcgtcgggggcacgagccggccctgggctgcctggcaaggactacttccaatctaacactactgagcgggctggcaaaggcgcatacgnnnnnnnnnnnnnnnnnnnnnn

SEQ ID NO: 193129 - DNA, 534 bp, Homo sapiens
  misc_feature: GYAE6OF01CHQD9.37.46.E02.1.454.CMB.1.raw
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (507)..(534): a, c, t, g, unknown or other
  misc_feature (507)..(534): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagacaattccaagaacaccctgtctctgcaaatgaacaacctgagagccgaggacacggccctatatactgtaacgaaaatggcctacggatatgactactattgggactggtacttcgatctctggggccgtggcaccctggtcactgtctcctcagcctccacccgaagggccccatccggtccttcccccgtggccncccctgcctccagggcnccaccctccgagacgccacacggccggcccgtggggcctggcccgtgggtccaacgggtaccttaaccgttcccaagttccttaaccaccttactagggacggccggggtaccgtcgggaccgaaacgggcccgacgaagtacggnnnnnnnnnnnnnnnnnnnnnnnnnnnn

SEQ ID NO: 193130 - DNA, 446 bp, Homo sapiens
  misc_feature: GYAE6OF01CGS7T.37.46.E02.1.454.CMB.1.raw
  modified_base (198)..(198): a, c, t, g, unknown or other
  misc_feature (198)..(198): n is a, c, g, or t
  modified_base (436)..(446): a, c, t, g, unknown or other
  misc_feature (436)..(446): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaaatgaacagcctagaaaaccgnggacacggccgtgtattattgtatgtatagcagtggctcgagggtactacgtacgggatggacgtcgtgggccaagggaccacggtcaccgtctcctcagcctccaccaggcccatcgtccttcccctggcacccctcctccaagacgcacctcgtggggcacacgcggcctgggctgcctggtcaacggctactccatctacactactgacgcgggctgggacgaaggcgacatagnnnnnnnnnnn

SEQ ID NO: 193131 - DNA, 459 bp, Homo sapiens
  misc_feature: GYAE6OF01DMYVO.37.46.E02.1.454.CMB.1.raw
  modified_base (200)..(200): a, c, t, g, unknown or other
  misc_feature (200)..(200): n is a, c, g, or t
  modified_base (452)..(459): a, c, t, g, unknown or other
  misc_feature (452)..(459): n is a, c, g, or t
tcagtagtgtagatcacgaccggtgctcgatttagactcatctacagggaaagggctggagtgggttggccgaattagaagtaaagctaacagttacgcgacagcatatgttgcgtcgtgaaggcaggttcacatctccagagatgattacaaaagaacacggtcgttttctgacaaatgaaacagcctagaaaaaccgnggacacggccgtgtattatgtatgtatagcagtggctcagggtactacgtacggggatggacgtcgtgggaccgaagggaccacggtcaacccggtctcctcagcctccaccgaacggcccatccggtccttccccctggccaccctcctccaacgagcacctcgtcgggggcacacgcggcccgtgggctgcctggtcaaggactacttccatctacactactgagcgggcgtggcgaaggcgacagtagnnnnnnnn

SEQ ID NO: 193132 - DNA, 435 bp, Homo sapiens
  misc_feature: GYAE6OF01B8Y84.37.46.E02.1.454.CMB.1.raw
  modified_base (429)..(435): a, c, t, g, unknown or other
  misc_feature (429)..(435): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggccaccctcctccaagagcacctcgtggggcacacgcggccctgggctgcctgtcaaggactacttccatctacactactgagcgggctggcaaggcgcatagnnnnnnn

SEQ ID NO: 193133 - DNA, 477 bp, Homo sapiens
  misc_feature: GYAE6OF01AUI2G.37.46.E02.1.454.CMB.1.raw
  modified_base (198)..(198): a, c, t, g, unknown or other
  misc_feature (198)..(198): n is a, c, g, or t
  modified_base (335)..(335): a, c, t, g, unknown or other
  misc_feature (335)..(335): n is a, c, g, or t
  modified_base (459)..(477): a, c, t, g, unknown or other
  misc_feature (459)..(477): n is a, c, g, or t
tcagtagtgtagatcacgaccggtgctcgatttagactcatctacagggaaagggctggagtgggttcggccgaattagaagtaaagctaacagttacgcgacagcatatgttgcgtcggtgaaaggcaggttcaccatctccagagatgattcaaaagacacggtcgtttctgcaaatgaacagcctagaaaaccgnggacacggccgtgtattatgtatgtatagcagtggctcagggtactacgtacgggatggacgtcgtggggccaagggaccacggtcaccgtctcctcacgcctccaccaacgggccccagtccggtccttcccccgnggcccaccctcctaccaagcgccacctcgtcgggggcacgagccggccctggggctcggcctggtcaaggaccttactccaatcctaacactactgacggcgggctcgggacaggcgacatagnnnnnnnnnnnnnnnnnnn

SEQ ID NO: 193134 - DNA, 447 bp, Homo sapiens
  misc_feature: GYAE6OF01EAH11.37.46.E02.1.454.CMB.1.raw
  modified_base (431)..(431): a, c, t, g, unknown or other
  misc_feature (431)..(431): n is a, c, g, or t
  modified_base (437)..(447): a, c, t, g, unknown or other
  misc_feature (437)..(447): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgacaaatgaacagcctagaaaaccgaggacacggccgtgtattatgtatgtatagcagtggctcagggtactacgtacgggatgggacgtcgtggggccaagggaccacggtcaccgtctcctcagcctccaccaacggcccatccggtcttcccccgtggccaccctcctccaagacgcacctcgtgggggcacacgcggcccgtgggctcgcctggacaaggactactccatctacactactgagcggctggcaggcncatagnnnnnnnnnnn

SEQ ID NO: 193135 - DNA, 443 bp, Homo sapiens
  misc_feature: GYAE6OF01DT3C5.37.46.E02.1.454.CMB.1.raw
  modified_base (173)..(173): a, c, t, g, unknown or other
  misc_feature (173)..(173): n is a, c, g, or t
  modified_base (435)..(443): a, c, t, g, unknown or other
  misc_feature (435)..(443): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgttttcngcaaatgaacagcctagaaaaaccgggacacggccgtgtattattgtatgtatagcagtggctcagggtactacgtacgggatgggacgtcgtggggccaagggaccacggtcaccgtctcctcagcctccaccaagggcccatcggtcttccccctggccaccctcctccaagagcacctctggggcacagcggccctgggctgcctggtcaaggactacttccatctacactactgagcgggctggcaaggcgacatagnnnnnnnnn

SEQ ID NO: 193136 - DNA, 476 bp, Homo sapiens
  misc_feature: GYAE6OF01EEOTD.37.46.E02.1.454.CMB.1.raw
  modified_base (462)..(476): a, c, t, g, unknown or other
  misc_feature (462)..(476): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaaatgaacagcctagaaaaccgaggacacggccgtgtattattgtatgtatagcagtggctcgagggtactacgtacgggatggacgtcgtggggccaagggaccacggtcaccgtctcctcacgcctccaccaacgggcccatccggtccttccccctggccaccctcctccaacgacgcaccgtcgtcggggcacgacggccggcccgtgggctcgccgtggtacaacggacttacgtccagtcctaacgactactgacggcgggcgtggacgaaggcgcagtagnnnnnnnnnnnnnnn

SEQ ID NO: 193137 - DNA, 472 bp, Homo sapiens
  misc_feature: GYAE6OF01EF6PP.37.46.E02.1.454.CMB.1.raw
  modified_base (197)..(197): a, c, t, g, unknown or other
  misc_feature (197)..(197): n is a, c, g, or t
  modified_base (462)..(472): a, c, t, g, unknown or other
  misc_feature (462)..(472): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgnggacacggccgtgtattattgtatgtatagcagtggctcagggtactacgtacgggatggacgtcgtggggccaagggaccacggtcaccgtctcctcacgcctccaccaacggcccatccggtccttcccccgtcggccacccctcctccaacgacgccacctcgtcggggcacgacgccggcccgtgggcctcggccgtggtacgaacggacctacctccatcctacactactgacggcgggcgtggcgaaggcgacagtagnnnnnnnnnnn

SEQ ID NO: 193138 - DNA, 507 bp, Homo sapiens
  misc_feature: GYAE6OF01B8SQX.37.46.E02.1.454.CMB.1.raw
  modified_base (269)..(269): a, c, t, g, unknown or other
  misc_feature (269)..(269): n is a, c, g, or t
  modified_base (479)..(481): a, c, t, g, unknown or other
  misc_feature (479)..(481): n is a, c, g, or t
  modified_base (484)..(507): a, c, t, g, unknown or other
  misc_feature (484)..(507): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagaacacggcgttttctgacaaaatgaacagcctagaaaaccgaggacacggccgtgtattattgtatgtatagcagtggctcgagggtactacgtacgggatggacgtcgngggaccaagggaccacggtcaccgtctcctcacgcctccaccgaagggcccagtccggtccttcccccgtggccctaccctcctaccgaacgacgccacctcggtcggggccacgacggccggcccgtggggcctcgccgtcggtacgaacggtacttacctccgatcctacactacgtggacggcggcgtggacgacggcgacaatagnnngcnnnnnnnnnnnnnnnnnnnnnnnn

SEQ ID NO: 193139 - DNA, 543 bp, Homo sapiens
  misc_feature: GYAE6OF01EKNDJ.37.46.E02.1.454.CMB.1.raw
  modified_base (515)..(515): a, c, t, g, unknown or other
  misc_feature (515)..(515): n is a, c, g, or t
  modified_base (518)..(543): a, c, t, g, unknown or other
  misc_feature (518)..(543): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacgggccgtgtattattgtatgtatagcagtggctcgagggtactacgtacgggatggacgtcgtggggaccaagggaccacggtccaccgtctcctcagccctccaccgaacgggcccagtccggtcccttcccccgtggccctacccctcctaccgaagacgccctacctcggtcgggggacaccgacggcccggcccgtgggccgtcgccgttagggtaccaacggtaccctaccttcccaacgttccttaaccgaccttacgtagggacggccggggtcgtacgggtaccgaagggcctacgaatacggnagnnnnnnnnnnnnnnnnnnnnnnnnnn

SEQ ID NO: 193140 - DNA, 473 bp, Homo sapiens
  misc_feature: GYAE6OF01D5X76.37.46.E02.1.454.CMB.1.raw
  modified_base (457)..(473): a, c, t, g, unknown or other
  misc_feature (457)..(473): n is a, c, g, or t
tcagtagtgtagatcacgaccggtgctcgatttagactcatctacagggaaaggggtggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggccgtgtattattgtatgtatagcagtgctcagggtactacgtacgggatggacgtcgtggggccaagggccacggtcaccgtctcctcagcctccaccaggcccctagtccggtccttcccccgtcggccacccctccctaccaagacgccacctcgtggggccacacggccggcccgtgggctcggcctggtacgaacggtacctacttccactctacactactgacggcgggtctggacaaggcgcagtgnnnnnnnnnnnnnnnnn

SEQ ID NO: 193141 - DNA, 439 bp, Homo sapiens
  misc_feature: GYAE6OF01AFMNT.37.46.E02.1.454.CMB.1.raw
  modified_base (401)..(401): a, c, t, g, unknown or other
  misc_feature (401)..(401): n is a, c, g, or t
  modified_base (431)..(439): a, c, t, g, unknown or other
  misc_feature (431)..(439): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaaggccccatccggtctccccctggccaccctcctccaagagcacctctgggggcacagtcggccctgggctgccctggtcaaggctacttccatctacnctactgacgcgggctggcaaggcgcatagnnnnnnnnn

SEQ ID NO: 193142 - DNA, 469 bp, Homo sapiens
  misc_feature: GYAE6OF01BDROE.37.46.E02.1.454.CMB.1.raw
  modified_base (236)..(236): a, c, t, g, unknown or other
  misc_feature (236)..(236): n is a, c, g, or t
  modified_base (446)..(446): a, c, t, g, unknown or other
  misc_feature (446)..(446): n is a, c, g, or t
  modified_base (448)..(469): a, c, t, g, unknown or other
  misc_feature (448)..(469): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacggccgtgtattattgtatgtatagcagtggctnagggtactacgtacgggatggacgtcgtggggccaagggaccacggtcaccgtctcctcacgcctccaccaacgggcccatccggtccttcccccgtcggccacccctcctccaagacgcacctcgtggggcacgagccggccctgggctcgcctggtcaacggctacttccatcacactactgagcgggctggacaaggcgacagtagngnnnnnnnnnnnnnnnnnnnnnn

SEQ ID NO: 193143 - DNA, 461 bp, Homo sapiens
  misc_feature: GYAE6OF01D9Y9P.37.46.E02.1.454.CMB.1.raw
  modified_base (200)..(200): a, c, t, g, unknown or other
  misc_feature (200)..(200): n is a, c, g, or t
  modified_base (447)..(461): a, c, t, g, unknown or other
  misc_feature (447)..(461): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgttttctgcaaaatgaaacagcctgaaaaaccgnggacacggccgtgtattattgtatgtatagcagtggctcgagggtacctacgtacgggatggacgtcgtggggccaagggaccacggtcaccgtctcctcagcctccaccaaggcccatcggtcttccccctggccaccctcctccaagagcacctcgtgggggcacgagccggccgtgggctgccgtggtcaaggactactccatctacacctactgtaagcgggctggacaaaggcgacatacgnnnnnnnnnnnnnnn

SEQ ID NO: 193144 - DNA, 442 bp, Homo sapiens
  misc_feature: GYAE6OF01DH3M5.37.46.E02.1.454.CMB.1.raw
  modified_base (357)..(357): a, c, t, g, unknown or other
  misc_feature (357)..(357): n is a, c, g, or t
  modified_base (409)..(409): a, c, t, g, unknown or other
  misc_feature (409)..(409): n is a, c, g, or t
  modified_base (434)..(442): a, c, t, g, unknown or other
  misc_feature (434)..(442): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgacaaatgaacagcctagaaaaccgaggacacggccgtgtattatgtatgtatagcagtggctcagggtactaacgtaggggatgggacgtcgtggggccaaagggaccacggtcaccgtctcctcagcctccaccaaggccatccggtcttccccctggccaccctcctccaagagcacctcgnggggcacagcgcctgggctgcctggtcaaggactacttccatctacactacngagcggctggacaaggcgcaatagnnnnnnnnn

SEQ ID NO: 193145 - DNA, 598 bp, Homo sapiens
  misc_feature: GYAE6OF01EDFTQ.37.46.E02.1.454.CMB.1.raw
  modified_base (200)..(200): a, c, t, g, unknown or other
  misc_feature (200)..(200): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
  modified_base (567)..(585): a, c, t, g, unknown or other
  misc_feature (567)..(585): n is a, c, g, or t
  modified_base (587)..(598): a, c, t, g, unknown or other
  misc_feature (587)..(598): n is a, c, g, or t
tcagtagtgtagatcacgaccggtgctcgatttagactcatctacaggggaaagggctggagtgggttggccgaattaggaagtaaagctaacagttacgcgacagcatatgttgcgtcggtgaaaggcaggttcaccatctccagagatgattcaaagaacacggtcgtttctgacaaatgaacagcctagaaaaccgnggacacggccgtgtattattgtatgtatagcagtggctagacgggtactacgtacgggatgggacgtcgtgggaccaacgggaccacggtcaccgtctcctcacgcctaccgaccgaacgggcccctacgttccggttcccttcccccgtcggtcccctaccccttccctacccgaacggaccgtacccgtacccgttccggtacgggggacctaccggacggcccggtcccggtcggggtcctcggtcccggttcgggtaaccgtaacggtaccttacccttaccgacttacctaacctaccgtacgtacggacgggtccgggccgtcgggacgaacgggccacggtagtacggangtagcancgnnnnnnnnnnnnnnnnnnncnnnnnnnnnnnn

SEQ ID NO: 193146 - DNA, 511 bp, Homo sapiens
  misc_feature: GYAE6OF01CRR5X.37.46.E02.1.454.CMB.1.raw
  modified_base (139)..(139): a, c, t, g, unknown or other
  misc_feature (139)..(139): n is a, c, g, or t
  modified_base (145)..(145): a, c, t, g, unknown or other
  misc_feature (145)..(145): n is a, c, g, or t
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (380)..(380): a, c, t, g, unknown or other
  misc_feature (380)..(380): n is a, c, g, or t
  modified_base (451)..(451): a, c, t, g, unknown or other
  misc_feature (451)..(451): n is a, c, g, or t
  modified_base (493)..(493): a, c, t, g, unknown or other
  misc_feature (493)..(493): n is a, c, g, or t
  modified_base (495)..(511): a, c, t, g, unknown or other
  misc_feature (495)..(511): n is a, c, g, or t
tcagtagtgtagatcacgaccggtgctcgatttagactcatctacagggaaagggctggagtgggttggccgaattagaagtaaagctaacagttacgcgacagcatatgttgcgtcgtgaaaggcaggttcaccatcnccaganatgattcaaaagaacacggcgttttcngacaaatgaacngacctaggaaaaaccgnggacacggtcctgtattatgtatgtatagctagtggctcgaagggtactacgtacgggatgggactcgtgggccaacgggaccaccggtcaccgtctcctcacgcctaccaccaacgggccccacgtccggtccttccccccgtcggcccacccctccctccaacgacgccacctccgngggggcacacggccggccgtcgggcgtcgccgtcggacgacggtacctaccttcactcgtactaccgtacncgtacggcgggtccgtcggacgaagggtccgacgtaagtcgncnnnnnnnnnnnnnnnnn

SEQ ID NO: 193147 - DNA, 577 bp, Homo sapiens
  misc_feature: GYAE6OF01B6LDP.37.46.E02.1.454.CMB.1.raw
  modified_base (199)..(199): a, c, t, g, unknown or other
  misc_feature (199)..(199): n is a, c, g, or t
  modified_base (548)..(577): a, c, t, g, unknown or other
  misc_feature (548)..(577): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgacaaaatgaacagcctagaaaaccgnggacacggccgtgtattatgtatgtatagcagtggctcgagggtactacgtacgggatggacgtcgtggggccaagggaccacggtcaccgtcctcctcacgcctccgaccaacgggcccagtccggtccttcccccgtcggcccaccccgtcctacccgaagacgcccacccgtcggtcgggggaccacgacggcccggtccccgtcggggtcccgtcggtcccgttacgggtaccgtaaacgggtaacccttaaccgtttcccctaacttacccgtaacctaaccgttaacgtcggtaacgggccggggccgttacggggaccgaaacgggccgtactaagtaacgnnnnnnnnnnnnnnnnnnnnnnnnnnnnnn

SEQ ID NO: 193148 - DNA, 608 bp, Homo sapiens
  misc_feature: GYAE6OF01CB4MI.37.46.E02.1.454.CMB.1.raw
  modified_base (231)..(231): a, c, t, g, unknown or other
  misc_feature (231)..(231): n is a, c, g, or t
  modified_base (577)..(579): a, c, t, g, unknown or other
  misc_feature (577)..(579): n is a, c, g, or t
  modified_base (581)..(608): a, c, t, g, unknown or other
  misc_feature (581)..(608): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctcagagatgattacaaaagaacacggtcgtttctgacaaatgaacagacctacgaaaaccgaggacacggccgtgtattatgtatgtatagnagtggctacgagggtactacgtacgggagtgggacgtcgtcggggacgaacgggaccgacggtcaccgtctcctcacgcctacccgaaccgaacgggccctacgtccggttcccttcccccgtcggcccacccctaccctaccaacggactaccaccgttcggcgggggaccacggaccggcccggtacccggtcgggccgtcggtcccgtacgggtaaccgtaaaccgggtaccttaacccgttccctaacgttacccttaaaccgtaccgttaaccggtacgggaacggggtcccggggtacggtccgggaaccggtaaacgggaccgtaccgtaaggacgacnnngnnnnnnnnnnnnnnnnnnnnnnnnnnnn

SEQ ID NO: 193149 - DNA, 449 bp, Homo sapiens
  misc_feature: GYAE6OF01CTAHV.37.46.E02.1.454.CMB.1.raw
  modified_base (429)..(429): a, c, t, g, unknown or other
  misc_feature (429)..(429): n is a, c, g, or t
  modified_base (435)..(449): a, c, t, g, unknown or other
  misc_feature (435)..(449): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgacaaatgaacagcctgaaaaccgaggacacggccgtgtattatgtatgtatagcagtggctcagggtactactacgggatggacgtgtggggccaagggaccaacggtcaccgtctcctcagcctccaccaacgggcccatccggtcttccccctggccaccctcctccaagagcacctctcgggggcacagcggccctgggctgccgtggtcaaggacacgttccatctacactactgacgcggctggcaaggcncatagnnnnnnnnnnnnnnn

SEQ ID NO: 193150 - DNA, 506 bp, Homo sapiens
  misc_feature: GYAE6OF01CX1SW.37.46.E02.1.454.CMB.1.raw
  modified_base (477)..(479): a, c, t, g, unknown or other
  misc_feature (477)..(479): n is a, c, g, or t
  modified_base (481)..(506): a, c, t, g, unknown or other
  misc_feature (481)..(506): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggcgtgtattattgtatgtatagcagtggctcgagggtactacgtacgggatggacgttcgtggggaccgaagggaccacggtctaccgtctccctcacgtccctaccaccgtaacgggcccagtccggtccttccccctggcccacccctcctccgaagacgccaccgtcgtcggggcacgacggccggcccgtgggcctgccgtggtccgaaggtacctaccttaccatccgtactactacgtggacgcgggctggacgaaggcgtcaagtcnnntnnnnnnnnnnnnnnnnnnnnnnnnnn

SEQ ID NO: 193151 - DNA, 521 bp, Homo sapiens
  misc_feature: GYAE6OF01EVTS5.37.46.E02.1.454.CMB.1.raw
  modified_base (257)..(257): a, c, t, g, unknown or other
  misc_feature (257)..(257): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (494)..(495): a, c, t, g, unknown or other
  misc_feature (494)..(495): n is a, c, g, or t
  modified_base (497)..(521): a, c, t, g, unknown or other
  misc_feature (497)..(521): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacggccgtgtattactgttcgaaagataggtactctggttcgcgtacttttttaangtccattctttgaccacgtggggccagggaaccctggtccaccgtctcctcacgccctccaccgaagggccccagtccggtccttccccccgtggccncccctgcctccgaggacnccaccctccgagacgcacacggccggcccgtggggctcggcctggtaccaacggtacctacgttccaacttcctaactacctacgtgacggcggggtcgtcggacgacgggccacagtagnngnnnnnnnnnnnnnnnnnnnnnnnnn

SEQ ID NO: 193152 - DNA, 596 bp, Homo sapiens
  misc_feature: GYAE6OF01DL47Z.37.46.E02.1.454.CMB.1.raw
  modified_base (561)..(561): a, c, t, g, unknown or other
  misc_feature (561)..(561): n is a, c, g, or t
  modified_base (563)..(572): a, c, t, g, unknown or other
  misc_feature (563)..(572): n is a, c, g, or t
  modified_base (574)..(596): a, c, t, g, unknown or other
  misc_feature (574)..(596): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagaacacggcgttttctgacaaatgaacagcctagaaaaccgaggacacggcgtgtattattgtatgtatagcagtggctcagtgtactacgtacgggatggacgtcgtggggaccgaagggaccacggtcctaccgtctcctcacgccctaccaccgacgggcccatcccggttcccttccccccgtcggaccctacccctccctacccgaagtaccgcctacccgtcggtccgggggacaaccggacggcccggccccggtggggcccgttcggtcccggtacggggtaccgtaaacgggtaaccctttacccgttacccgtaacttacgtaacccgtaaccgttaacccggcggggtccggggaccgttcgggaccggaaacgggccgtaccaagttaggngnnnnnnnnnngnnnnnnnnnnnnnnnnnnnnnnn

SEQ ID NO: 193153 - DNA, 438 bp, Homo sapiens
  misc_feature: GYAE6OF01DDNM1.37.46.E02.1.454.CMB.1.raw
  modified_base (195)..(195): a, c, t, g, unknown or other
  misc_feature (195)..(195): n is a, c, g, or t
  modified_base (430)..(438): a, c, t, g, unknown or other
  misc_feature (430)..(438): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtcgtggggccaaggggaccacggtcaccgtctcctcagcctccaccaagggcccatcgtcttccccctggcaccctcctccaagagcacctctgggggcacagcggccctgggctgcctggtcaaggactacttccatctacactactgagcgggctggcaaggcgcatacgnnnnnnnnn

SEQ ID NO: 193154 - DNA, 603 bp, Homo sapiens
  misc_feature: GYAE6OF01BRES7.37.46.E02.1.454.CMB.1.raw
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (563)..(563): a, c, t, g, unknown or other
  misc_feature (563)..(563): n is a, c, g, or t
  modified_base (566)..(567): a, c, t, g, unknown or other
  misc_feature (566)..(567): n is a, c, g, or t
  modified_base (569)..(603): a, c, t, g, unknown or other
  misc_feature (569)..(603): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagacacggtcgttttcngacaaatgaaacngccctagaaaaccgaggacacggtccgtgtattattgtatgtaatagcaggtgctgagggtacctagtacgggatgggacgtcgagggaccgaagggacccacgggtcaccgtctcctcagcctccaccgaagggcccagtccggtccttcccccgtggcccaccccgtcctaccgaaacggcgcccaacccgttccggtacgggggcccaacggaccggcccgggtaccccgtgggggcccttcggtcccgttacgggtaccgtaaaaccgggtaccctttaaccttcccgaactttccctaaaccgtaccttaaccgttacggacgggtacccggggcttacgggaccgtaaacgggcccgacgtaagtacggncgnngnnnnnnnnnnnnnnnnnnnnnnnnnnnnnnnnnnn

SEQ ID NO: 193155 - DNA, 559 bp, Homo sapiens
  misc_feature: GYAE6OF01C4KCJ.37.46.E02.1.454.CMB.1.raw
  modified_base (201)..(201): a, c, t, g, unknown or other
  misc_feature (201)..(201): n is a, c, g, or t
  modified_base (504)..(504): a, c, t, g, unknown or other
  misc_feature (504)..(504): n is a, c, g, or t
  modified_base (528)..(559): a, c, t, g, unknown or other
  misc_feature (528)..(559): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgaattcaaaagaacacggcgtttctgacaaaatgaacagcctagaaaaaccgnggacacggccgtgtattattgtatgtatagcagtggctacgaggtactaacgtacggggatgggacgtcggtaggggccaaagggaccaacggtcaaccgtctccctcacgcctccaaccgaacgggccccagtccggtcccttcccccgtcggaccctaccccgtcctacccgaaagaccgccaaccgtcggtcgggggacaacgacggccggtccccgtggggcctcgtacccgtggtacgaaacggtaccttaccgttcccaattccgtaactaccgtacgtacggaggtccgggaccgnggaacgaacgggacacgaagtagnnnnnnnnnnnnnnnnnnnnnnnnnnnnnnnn

SEQ ID NO: 193156 - DNA, 441 bp, Homo sapiens
  misc_feature: GYAE6OF01BZGMM.37.46.E02.1.454.CMB.1.raw
  modified_base (195)..(195): a, c, t, g, unknown or other
  misc_feature (195)..(195): n is a, c, g, or t
  modified_base (434)..(441): a, c, t, g, unknown or other
  misc_feature (434)..(441): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagacacggcgtttctgcaaatgaacagcctagaaaaccgnggacacggccgtgtattattgtatgtatagcagtggctcagggtactacgtacgggatggacgtcgtgggccaagggaccacggtcaccgtctcctcagcctccaccaagggcccatccggtcttccccctggccaccctcctccaagagcacctctgggggcacgacgcggccctgggctgcctggtcaaggctacttccatctacactactgacgcgggctggcaaggcgcagtagnnnnnnnn

SEQ ID NO: 193157 - DNA, 666 bp, Homo sapiens
  misc_feature: GYAE6OF01CJEUJ.37.46.E02.1.454.CMB.1.raw
  modified_base (175)..(175): a, c, t, g, unknown or other
  misc_feature (175)..(175): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
  modified_base (637)..(666): a, c, t, g, unknown or other
  misc_feature (637)..(666): n is a, c, g, or t
tcagtagtgtagatcacgaccggtgctcgatttagactcatctacagggaaagggctggagtgggttggccgaattagaaagtaaagctaacagttacgcgacagcatatgttgcgtcggtgaaaggcaggttcaccatctccagagatgattacaaaagaacacggtcgtttcngacaaaatgaaacagcctaagaaaaaccgaggacacggccgtagtattatgtatgtatagcaggtggctacgaagggtactacggtacgggatgggacgtcggtaggggaccgaaacgggaccacggtcaccgtctcctacgacgccctccaaccggaaacgggtcccctaagtcccggttcccttcccccgtcggacccctacccccttcctaaccgaaaacggaccgtacccgtacccgttccggggtacggggggaacccaaccgggaaccgggtccccgggtccccggtcggggtcccgttccgggtaccccgttaacggggtaaccgtaaaaccggggttaaccctttaacccgttacccgtaacttacccgtaaacctaaccgttaccggtacgggaaccgggtccggggtaccgtacggggaacgaaacgggccgaacgtaaacggtgcngtngnnnnnnnnnnnnnnnnnnnnnnnnnnnnnn

SEQ ID NO: 193158 - DNA, 770 bp, Homo sapiens
  misc_feature: GYAE6OF01DROIF.37.46.E02.1.454.CMB.1.raw
  modified_base (173)..(173): a, c, t, g, unknown or other
  misc_feature (173)..(173): n is a, c, g, or t
  modified_base (682)..(682): a, c, t, g, unknown or other
  misc_feature (682)..(682): n is a, c, g, or t
  modified_base (698)..(698): a, c, t, g, unknown or other
  misc_feature (698)..(698): n is a, c, g, or t
  modified_base (704)..(704): a, c, t, g, unknown or other
  misc_feature (704)..(704): n is a, c, g, or t
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
  modified_base (734)..(734): a, c, t, g, unknown or other
  misc_feature (734)..(734): n is a, c, g, or t
  modified_base (741)..(741): a, c, t, g, unknown or other
  misc_feature (741)..(741): n is a, c, g, or t
  modified_base (744)..(744): a, c, t, g, unknown or other
  misc_feature (744)..(744): n is a, c, g, or t
  modified_base (759)..(759): a, c, t, g, unknown or other
  misc_feature (759)..(759): n is a, c, g, or t
  modified_base (768)..(768): a, c, t, g, unknown or other
  misc_feature (768)..(768): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctcagagatgattacaaaagacgacggtcgtttcngcaaatgaacagcctagaaaaccgagacgacggcgtagtattattgtatgtatagcagtgctcgagggtactacgtacggagtcggacgttcggtacggggaccaacggggaacccgtaccggtaccgtaacccgttaccctcccgttaccgaacggtccccctacccgaaaccccggaaccgggggtaccccctaacggttcccgggttcccctttcccccccgtacggaccccgtacccccgttacccgtacccgaaaacgaccgtacccgtaaccccgttccgggtacgggggaccaaccggaccgggaccccgggtcccccggtcggggacccttccggtacccggtttacggtaaccggtaaaccggttaccctttaaccccgtttacccgtaaactttaacccgtttaaccctaaccgttaacccggttacgggaaccgggcccggggtaccgttacgggaccggtaaaccgggttacccggaactaacggttaaggccgtanacgacgctacgagagngcgcgngtcgcgtcgtacgtacncgtcgngtcgcgntagacgngtnacgcagacgacgacncagtcgtgngc

SEQ ID NO: 193159 - DNA, 674 bp, Homo sapiens
  misc_feature: GYAE6OF01CQCCD.37.46.E02.1.454.CMB.1.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
  modified_base (641)..(641): a, c, t, g, unknown or other
  misc_feature (641)..(641): n is a, c, g, or t
  modified_base (644)..(674): a, c, t, g, unknown or other
  misc_feature (644)..(674): n is a, c, g, or t
tcagtagtgtagatcacgaccggtgctcgatttagactcatctacagggaaagggctggagtgggttggccgaattagaagtaaagctaacagttacgcgacagcatatgttgcgtcggtagaaaggcaggttcaccatctccagagatgattacaaaagaacacggtcgttttcngacaaatgaacacgaccaaggaaaaaccggaggaccacggtccgttnttaatttattgtattagtatagcgtaggtggcctacggtaagggtactaacgttacggggagtacggggtacgttcggacgggggacccggaaacgggacccgtacgggtccaccgttcctcctaccaccgtcccacccgaaccggaaaccgggtccccctaacgttcccggttccccctttacccccgccggtacccctaccccctaccgtaaccaaacggtaccacccgtaacccggttcgggacgggggacccaacgtaccggccccgggtacccggtcggggtccctcggtcccgttacggtaaacccgtaaacggtaccctttaccgtaccctaacgtaccttaaccgtaacctaccggtaggaccgggtccgggacggtaccggaaccggaacggtccgaacgtaggaacgngannnnnnnnnnnnnnnnnnnnnnnnnnnnnnn

SEQ ID NO: 193160 - DNA, 566 bp, Homo sapiens
  misc_feature: GYAE6OF01EZCPZ.37.46.E02.1.454.CMB.1.raw
  modified_base (255)..(255): a, c, t, g, unknown or other
  misc_feature (255)..(255): n is a, c, g, or t
  modified_base (531)..(531): a, c, t, g, unknown or other
  misc_feature (531)..(531): n is a, c, g, or t
  modified_base (537)..(566): a, c, t, g, unknown or other
  misc_feature (537)..(566): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgttttctgcaaaatgaacagcctagaaaaccgaggacacggccgtgtattattgtatgtatagcaggtgctcgaggtactacgtagggntggacgtcgtcggggaccaagggaccacggtcaccggtcctcctcacgccctcccaaccgaacgggcccctagtccggttcccttcccccgtcggccctacccctccctaccgaacgacgccgacccgtcggtcgggggaccacgacggcccggcccgtgggccgtcggccgtcggtaccgaacggtaccttacccgttcctaacttcctaactaaccttacgtacgggacggtaccgggacggtcgggaccgaacgggtccgacgaagttagcangatcgnnnnnnnnnnnnnnnnnnnnnnnnnnnnnn

SEQ ID NO: 193161 - DNA, 627 bp, Homo sapiens
  misc_feature: GYAE6OF01BLCCY.37.46.E02.1.454.CMB.1.raw
  modified_base (593)..(593): a, c, t, g, unknown or other
  misc_feature (593)..(593): n is a, c, g, or t
  modified_base (597)..(627): a, c, t, g, unknown or other
  misc_feature (597)..(627): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaagaacgacggtcgtttctgacaaatgaacacgacctaaggaaaaccggaggaccgacggccgtgtattattgtatgtatagctaggtggctacggtaacggtacttaacggtacggggtatcgggtacggttcggtcggggacccggaaacggggaccgtaaccggtccgtaacccgtccgttcccgtaccgaaccgtccccgtaccccgaaaccggaaacccggggtcccgtaccggttcccgggttcccccttcccccggttccggaccctaccccgtaccctaccgaacggtaccgcccgtaaccgtccgggtacgggaccaccggccggtcccggccggtcgggcgtcggtccgtcggtacgaacggtccttacctcctaactaccgtactacgtacgtggacggcggtgtcggaacgagggcctacgagagngcannnnnnnnnnnnnnnnnnnnnnnnnnnnnnn

SEQ ID NO: 193162 - DNA, 853 bp, Homo sapiens
  misc_feature: GYAE6OF01CR5ZH.37.46.E02.1.454.CMB.1.raw
  modified_base (175)..(175): a, c, t, g, unknown or other
  misc_feature (175)..(175): n is a, c, g, or t
  modified_base (766)..(766): a, c, t, g, unknown or other
  misc_feature (766)..(766): n is a, c, g, or t
  modified_base (772)..(772): a, c, t, g, unknown or other
  misc_feature (772)..(772): n is a, c, g, or t
  modified_base (785)..(785): a, c, t, g, unknown or other
  misc_feature (785)..(785): n is a, c, g, or t
  modified_base (792)..(792): a, c, t, g, unknown or other
  misc_feature (792)..(792): n is a, c, g, or t
  modified_base (809)..(809): a, c, t, g, unknown or other
  misc_feature (809)..(809): n is a, c, g, or t
  modified_base (826)..(826): a, c, t, g, unknown or other
  misc_feature (826)..(826): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagaacgacggtcgtttcngtacaaatcgaacacgaccgtaacggaaaacccgaggaccgaaccggtcccgttagttaatttagttaggttattggtaattagcgtaggtcggtactcggtaagggttacgtaacggtaacgggagttacggggtaccggttcggtacgggggacccggaaaccggggaacccgtaccgggtaccgtaccccggttccttacccgtaccgaacccgtccccttaccccgaaacccgggtaacccgggaccccttaaccggtttcccccgggtttacccccttcccccggtaccgggtacccctaacccccgttaccccgttaacccgaaaacggaaccggtaccccgttaacccggttccggggtaccggggggacccaaaccgggtaccgggtaccccgggtccccgggtagggttacccggttccgggtacccgggtttaacggggttaaccgtaaaccgggtttaacccttacccgtttaaccccgtaacgttaacccgttaacccgttaaccggttaccgggtaccgggaacggggtacccgggttcggtaaccgggaccggaaacggtcgtaacgtaacgttagnacgcgntgactagctaacngcagtcncgacacgcagcgtacgngactcgacgtcgacganacgcagcgacgtacatatcacgactcg

SEQ ID NO: 193163 - DNA, 594 bp, Homo sapiens
  misc_feature: GYAE6OF01CVEIM.37.46.E02.1.454.CMB.1.raw
  modified_base (174)..(174): a, c, t, g, unknown or other
  misc_feature (174)..(174): n is a, c, g, or t
  modified_base (555)..(556): a, c, t, g, unknown or other
  misc_feature (555)..(556): n is a, c, g, or t
  modified_base (558)..(562): a, c, t, g, unknown or other
  misc_feature (558)..(562): n is a, c, g, or t
  modified_base (564)..(565): a, c, t, g, unknown or other
  misc_feature (564)..(565): n is a, c, g, or t
  modified_base (567)..(594): a, c, t, g, unknown or other
  misc_feature (567)..(594): n is a, c, g, or t
tcagtagtgtagatcacgaccggtgctcgatttagactcatctacagggaaagggctggagtgggttggccgaattagaagtaaagctaacagttacgcgacagcatatgttgcgtcgtgaaaggcaggttcaccatctccagagatgattacaaaagaacacggtcgttttcngacaaatgaacagcctagaaaaaccgaggacacggccgtgtattattgtatgtaatagctagtggctcgaggggtaactacgtacgggatcgggacgttcgaggggaccgtaacggggaccgacgggtccaaccggtcctccctcaccgcctacccaaccgaaccggggccccacgtcccggttcccttacccccgtcggcccaccccgtcccgtaccgaacgacgcccacccgtcggtacggggccaacgacggtccggccccgtggtcccgtcgtccgtagggttaccaacggtacccttacgtaccctaacgttcctaaccgtactacggtacggaggccgggtcgtcggacccgaaggtccgacgtaacgtcgatgnngnnnnngnngnnnnnnnnnnnnnnnnnnnnnnnnnnnn

SEQ ID NO: 193164 - DNA, 561 bp, Homo sapiens
  misc_feature: GYAE6OF01C98C0.37.46.E02.1.454.CMB.1.raw
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (533)..(561): a, c, t, g, unknown or other
  misc_feature (533)..(561): n is a, c, g, or t
tcagtagtgtagatcacgaccggtgctcgatttagactcatctacagggaaagggctggagtgggttggccgaattagaagtaaagctaacagttacgcgacagcatatgttgcgtcggtagaaaggcaggttcacatctccagagatgattacaaaagaacacggtcgttttctgacaaatgaacacgcctaggaaaaaccgaggacacgggccgttgtattattgtattagtatagcagtggctcgagggtactacgtacgggatggacgtcgtgggaccagggaccacggtcaccgtctcctcacgccctaccgaccgaacgggcccacgtccggtcccttcccccgnggccctacccctcctacaacggacncctaccgtcggtcggggccacgacggcccggtccgtcgggaccgtcgtaccgtaacgtaccggtaacggtaccttaccgtttaccacttaccgttaaccacttcgtacggaacgggtccgggcgttacgggacgtaacgggacgactaaacgtcgannnnnnnnnnnnnnnnnnnnnnnnnnnnn

SEQ ID NO: 193165 - DNA, 486 bp, Homo sapiens
  misc_feature: GYAE6OF01DQ7VV.37.46.E02.1.454.CMB.1.raw
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (331)..(331): a, c, t, g, unknown or other
  misc_feature (331)..(331): n is a, c, g, or t
  modified_base (466)..(486): a, c, t, g, unknown or other
  misc_feature (466)..(486): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagntgattcaaagaacacggcgtttcngcaaatgaacagcctagaaaaccgngacacgcgtgtattatgatgtatagnagtggctacgaggtactagtacgggatggacgtgtgggccaaggcacggcacgtctccgcagcctccacaagggcccagtcgtccttcccctgccaccctccgtccaanacgcaccgtcgaggggcacgaggtccgcccgtgggactcggcccgtttgggacctaaaggacctttactttaccattacctaactaccgttaatcggaacgtcccgggacgttcggaccaaagggcgacaagtgnnnnnnnnnnnnnnnnnnnnn

SEQ ID NO: 193166 - DNA, 559 bp, Homo sapiens
  misc_feature: GYAE6OF01AKUX6.37.46.E02.1.454.CMB.1.raw
  modified_base (523)..(523): a, c, t, g, unknown or other
  misc_feature (523)..(523): n is a, c, g, or t
  modified_base (527)..(559): a, c, t, g, unknown or other
  misc_feature (527)..(559): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaaatgaacagcctagaaaaccgaggacacggccgtgtattattgtatgtatagcagtggctcgagggtactacgtacgggatggacgtcgtgggccaagggacccacggtccaccgtctcctcagcctccaccaacggccccagtccggtccttccccctcggccacccctccctaccaacgagccacctcgtcgggggccaccgacggcccggccccgtcggggccgtacggcccgttgggtcccgtaaacgggtacctaacccgtttccctacttcccttaacccaccgttaccgtagaacgggtcccgggtcgtcgggtaccgtaaacgggccggactaacgtagnacgnnnnnnnnnnnnnnnnnnnnnnnnnnnnnnnnn

SEQ ID NO: 193167 - DNA, 731 bp, Homo sapiens
  misc_feature: GYAE6OF01EMDQ8.37.46.E02.1.454.CMB.1.raw
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
  modified_base (677)..(677): a, c, t, g, unknown or other
  misc_feature (677)..(677): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (692)..(692): a, c, t, g, unknown or other
  misc_feature (692)..(692): n is a, c, g, or t
  modified_base (704)..(704): a, c, t, g, unknown or other
  misc_feature (704)..(704): n is a, c, g, or t
  modified_base (721)..(721): a, c, t, g, unknown or other
  misc_feature (721)..(721): n is a, c, g, or t
  modified_base (723)..(723): a, c, t, g, unknown or other
  misc_feature (723)..(723): n is a, c, g, or t
  modified_base (726)..(726): a, c, t, g, unknown or other
  misc_feature (726)..(726): n is a, c, g, or t
tcagtagtgtagatcacgaccggtgctcgatttagactcatctacagggaagggctggagtgggttggccgaattagaagtaaagctaacagttacgcgacagcatatgttgcgtcgggtagaaggcaggttcaccatcctcagagatgaattacaaaagacacgggtctttcagacaaatcggaaacacgacccgtaaggaaaaacccggagaccgtaaccgggtccgttaagttatttagttaggtaactaggtaactacggactaggttcggacttacggaaacgggtactacggtacggggtatacgggaccgtggacgggaaccctaacggggacctaaccggtccgtaacccgttccgtaccttaccgaccggtaccctaaccccggaaccggtaaaccggtccccgtaaccgtttcccggttacccccttaaccccggtcggtacccctaacccccgtacccgtaccgaaacgtaccggtccaaccggttccgggacggggacctacgggacggacccggtccggttacggccgttacggaccgttacgggtaacaaccggttacttaccgactactactaacgaacttacggacggtacgccgggtagttcggaaccggagtacgtacgtaagngtagctncggactcancgactgacntancgtacanacanancgtctaganagagcgtagacncgacgtacgtactacananacngtgtg

SEQ ID NO: 193168 - DNA, 593 bp, Homo sapiens
  misc_feature: GYAE6OF01AET6H.37.46.E02.1.454.CMB.1.raw
  modified_base (174)..(174): a, c, t, g, unknown or other
  misc_feature (174)..(174): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
  modified_base (561)..(593): a, c, t, g, unknown or other
  misc_feature (561)..(593): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagaacacggtcgtttcngcaaatgaacagcctagaaaaccgaggacacggccgtgtattattgtatgtatagcagtggctcgagggtactacgtacgggatcgggacgtcggtacgggggacctaaaggggacccgacggtccacccgttcctccctccacgccctaccaaccgtaacgggcccctagttccggtcccttccccccgcggtacccacccccttcccgtacccaaacgaccgacccgtaccggtcgggtcgggacccacggaccgggcccggtccggtcggtcgtccggtccggtacggtaacggaaccgtaccgttacctacctctaacctacctaccgtacggtaggaccgggtcgtacggtcggaacggtaccggccgtaactagngacngnnnnnnnnnnnnnnnnnnnnnnnnnnnnnnnnn

SEQ ID NO: 193169 - DNA, 660 bp, Homo sapiens
  misc_feature: GYAE6OF01BHER9.37.46.E02.1.454.CMB.1.raw
  modified_base (143)..(143): a, c, t, g, unknown or other
  misc_feature (143)..(143): n is a, c, g, or t
  modified_base (147)..(147): a, c, t, g, unknown or other
  misc_feature (147)..(147): n is a, c, g, or t
  modified_base (170)..(170): a, c, t, g, unknown or other
  misc_feature (170)..(170): n is a, c, g, or t
  modified_base (204)..(204): a, c, t, g, unknown or other
  misc_feature (204)..(204): n is a, c, g, or t
  modified_base (525)..(525): a, c, t, g, unknown or other
  misc_feature (525)..(525): n is a, c, g, or t
  modified_base (563)..(563): a, c, t, g, unknown or other
  misc_feature (563)..(563): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (611)..(611): a, c, t, g, unknown or other
  misc_feature (611)..(611): n is a, c, g, or t
  modified_base (614)..(615): a, c, t, g, unknown or other
  misc_feature (614)..(615): n is a, c, g, or t
  modified_base (618)..(619): a, c, t, g, unknown or other
  misc_feature (618)..(619): n is a, c, g, or t
  modified_base (624)..(625): a, c, t, g, unknown or other
  misc_feature (624)..(625): n is a, c, g, or t
  modified_base (627)..(627): a, c, t, g, unknown or other
  misc_feature (627)..(627): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (638)..(639): a, c, t, g, unknown or other
  misc_feature (638)..(639): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (651)..(653): a, c, t, g, unknown or other
  misc_feature (651)..(653): n is a, c, g, or t
  modified_base (655)..(655): a, c, t, g, unknown or other
  misc_feature (655)..(655): n is a, c, g, or t
tcagtagtgtagatcacgaccggtgctcgatttagactcatctacaggggaagggctgggagtgggttgccgaatttagaagtaaagctaacagttacgcgacagcagtatgttgcgtcgtgaaggcagttcacatctcaganagtnattcaaagacgcggtcgttttcngactaagagaacgacgtacctaacggaaaaccgnggaccgacgggcttagttaattattggtattaggtatacggacagtcggtctacgaacggttacctaacgtaggtgtacggtcgtccgggtaggaccgaacggggtacctaacgtccgtaaccgttccgttacctacgtacggtaccccctccgaaaccgacccgggtaccctaaccgtttccggtacccgtttcccccgttaaggaccccctacccgttaccctacggaactccgtaccacggtccggtcgggactaccggccgttaaccggccccgtggtaccgttccggaccgtaggttaccaaaccgtcgttaaccnccgtttaacttccggtaactttaccgaggtaacccggnggtacccggaggtcccgaagttaccgngacngacngactgtcagaccngtnncanngctgnncnacnangtaganncangancgcgcnnncngtgcg

SEQ ID NO: 193170 - DNA, 547 bp, Homo sapiens
  misc_feature: GYAE6OF01EA0S4.37.46.E02.1.454.CMB.1.raw
  modified_base (207)..(207): a, c, t, g, unknown or other
  misc_feature (207)..(207): n is a, c, g, or t
  modified_base (520)..(547): a, c, t, g, unknown or other
  misc_feature (520)..(547): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaaggaacacggtcgttttctgacaaatgaacagcctagaaaaccgaggacncggccgtgtattattgtatgtatagcagtgctcgagggttactacgtacgggagtgggacgtcggacgggaccgaaggggacccgtaccggtccacccgttcctcctcacgccctacccgaaccgaacgggcccacgttccggttccctttcccccgtcggccctacccctcctaccgaagacgccgtaccgtcggtcgggggcacgcggccggccgtggcgtcgccgtggtacgaacggtaccttaccttcctactacgtacctacgtcggacggcgggtccgtacgggacggaacggtcgatacgtaggcnnnnnnnnnnnnnnnnnnnnnnnnnnnn

SEQ ID NO: 193171 - DNA, 619 bp, Homo sapiens
  misc_feature: GYAE6OF01EAQ17.37.46.E02.1.454.CMB.1.raw
  modified_base (591)..(619): a, c, t, g, unknown or other
  misc_feature (591)..(619): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattacaaaagaacacggtcgttttctgacaaatgaacacgccgtaagaaaaccggaggaacgaccggtccgttgttaatttattgtatgtactagcgaggtggtctcgaacgggttacctacggtacgggtagtggtacgttcggtcggggaccgaacgggaccgaccggtccaccgtcctcctccgacgtccctacccaaccgaccggtccctacgttccggttccccgttcccccgtcggcccctacccctccgtacccaacgacgtacccgtaccgtcgggtacgggggaccaccggtacggcccgggtcccggtcgggtccgtccggccggtacgggtaccgtaaacggtcccttaccttcccgtactacccgttaacaccgttaacgcgggtacgggtcccggggcgtacgggacggtaacggccgatagacgggcnnnnnnnnnnnnnnnnnnnnnnnnnnnnn

SEQ ID NO: 193172 - DNA, 669 bp, Homo sapiens
  misc_feature: GYAE6OF01BQYB7.37.46.E02.1.454.CMB.1.raw
  modified_base (170)..(170): a, c, t, g, unknown or other
  misc_feature (170)..(170): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (335)..(335): a, c, t, g, unknown or other
  misc_feature (335)..(335): n is a, c, g, or t
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
  modified_base (599)..(599): a, c, t, g, unknown or other
  misc_feature (599)..(599): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatcctcagagatgattcaaagacacggtcgtttntgcaaatgaacngcctagaaaccgnggacacggctgtattntgatgtatagcaggtgactcagggtactacgcgggtatcgggacgtcgtcggggaccaagggcctaacggtcaccggtctccgtacaggcctccacggaacggcccacgtccggttctccccgngcctacccgtcctcgaacgcgtccacgtcggtacggggacacgtcggaccggtccgtcgggtactcgggtccctagggtaccgaacggttaccgttaaccgtttacgaacccgtttccgtaaacgtacccgttaacggtaccggtacgggtaccggggtaccgttacggggaacccgttaaggggacccctaagggtaactaaccgggtnacgagttacncgtanccggtanccggaatntacggntacgtcgattcccggganacgtgacgtacgaccgtactacggtacctagagccgtagtaccgacggttctacgatcggatacggtacg

SEQ ID NO: 193173 - DNA, 588 bp, Homo sapiens
  misc_feature: GYAE6OF01A0FK2.37.46.E02.1.454.CMB.1.raw
  modified_base (173)..(173): a, c, t, g, unknown or other
  misc_feature (173)..(173): n is a, c, g, or t
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (553)..(553): a, c, t, g, unknown or other
  misc_feature (553)..(553): n is a, c, g, or t
  modified_base (557)..(588): a, c, t, g, unknown or other
  misc_feature (557)..(588): n is a, c, g, or t
tcagtagtgtagatcacgaccggtgctcgatttagactcatctacagggaaagggctggagtgggttggccgaattagaagtaaagctaacagttaccgcgacagcatatgttgcgtcggtgaaaggtcaggttcaccatcgtccagagatgatacaaagaccacggctttcngcaaatgaacagcctagaaaaccgnggacacgggcctagtacttattcgtatggtatagcatgggcctgaggtacctagtacggatggacgtcgngggaccaagggccacgatcgaccgtcctcgtcacgcctaccgacccgaacgggccctacgttcccggttccttacccccgcggtcccgacccctccctaaccgaaggacgtacccgacccgttccggcgggggaccaccgacgggcccggcccggttggggccctagggtcccggtcggtaaccggaaacgggtaccttacccgttaccaacgtttcccaacgtaccgttacggcggtaacgggccgggtcgtacgggccgaaaggtcccagtaacgtgcatcgnacgnnnnnnnnnnnnnnnnnnnnnnnnnnnnnnnn

SEQ ID NO: 193174 - DNA, 435 bp, Homo sapiens
  misc_feature: GYAE6OF02IT81G.37.46.E02.1.454.CMB.1.raw
  modified_base (195)..(195): a, c, t, g, unknown or other
  misc_feature (195)..(195): n is a, c, g, or t
  modified_base (428)..(435): a, c, t, g, unknown or other
  misc_feature (428)..(435): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatacgnnnnnnnn

SEQ ID NO: 193175 - DNA, 432 bp, Homo sapiens
  misc_feature: GYAE6OF02F8KD8.37.46.E02.1.454.CMB.1.raw
  modified_base (426)..(432): a, c, t, g, unknown or other
  misc_feature (426)..(432): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaaggggaccacggtcaccgtctcctcagcctccaccaagggcccatcggtcttccccctggcgccctgctccaggagcacctccgagagcacagcgccctgggctgcctggtcaaggctacttccatctacactactgagcgggctggcaggcgcatagnnnnnnn

SEQ ID NO: 193176 - DNA, 454 bp, Homo sapiens
  misc_feature: GYAE6OF02FZZ69.37.46.E02.1.454.CMB.1.raw
  modified_base (432)..(454): a, c, t, g, unknown or other
  misc_feature (432)..(454): n is a, c, g, or t
tcagtagtgtagatcacgaccggtgctcgatttagactcatctacaggggaaagggctggagtgggttggccgaattagaagtaaagctaacagttaccgcgacagcatatgttgcgtcggtgaaaggcaggttcaccatctccagagatgattcaaagaacacggcgtttctgcaaatgaacagcctgaaaaccgaggacacgtccgtgtattattgtatgtatagcagtggctcagggtactactacgggatggacgtctggggccaagggaccacggtcaccgtctcctcagcctccaccaagggcccatcggtcttccccctggcaccctcctccaagagcacctctgggggcacgagcggccctgggctgcctggtcaaggactacttccatctacactactgagcgggctggacaaggcgcatagnnnnnnnnnnnnnnnnnnnnnnn

SEQ ID NO: 193177 - DNA, 428 bp, Homo sapiens
  misc_feature: GYAE6OF02HR4IW.37.46.E02.1.454.CMB.1.raw
  modified_base (427)..(428): a, c, t, g, unknown or other
  misc_feature (427)..(428): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnn

SEQ ID NO: 193178 - DNA, 433 bp, Homo sapiens
  misc_feature: GYAE6OF02HEHVE.37.46.E02.1.454.CMB.1.raw
  modified_base (195)..(195): a, c, t, g, unknown or other
  misc_feature (195)..(195): n is a, c, g, or t
  modified_base (427)..(433): a, c, t, g, unknown or other
  misc_feature (427)..(433): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtctggggccaagggaccacggtcaccgtctcctcagcctccaccaagggcccatcggtcttccccctggcaccctcctccagacgcacctctgggggcacagcggccctgggctgcctggtcaaggctacttccatctacactactgagcgggctggcaaggcgcatagnnnnnnn

SEQ ID NO: 193179 - DNA, 433 bp, Homo sapiens
  misc_feature: GYAE6OF02G52J2.37.46.E02.1.454.CMB.1.raw
  modified_base (195)..(195): a, c, t, g, unknown or other
  misc_feature (195)..(195): n is a, c, g, or t
  modified_base (429)..(433): a, c, t, g, unknown or other
  misc_feature (429)..(433): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtctggggccaagggaccacggtcaccgtctcctcagcctccaccaagggcccatcggtcttccccctggccaccctcctccaagagcacctctgggggcacagcggccctgggctgcctggtcaaggactacttccatctacactactgagcgggctggcaaggcgcatagnnnnn

SEQ ID NO: 193180 - DNA, 429 bp, Homo sapiens
  misc_feature: GYAE6OF02H22WC.37.46.E02.1.454.CMB.1.raw
  modified_base (424)..(429): a, c, t, g, unknown or other
  misc_feature (424)..(429): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggctacttccatctacaactgagcgggctggcaggcgcatagnnnnnn

SEQ ID NO: 193181 - DNA, 442 bp, Homo sapiens
  misc_feature: GYAE6OF02I7TV4.37.46.E02.1.454.CMB.1.raw
  modified_base (435)..(442): a, c, t, g, unknown or other
  misc_feature (435)..(442): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctgaaaaccgaggacacggccgtgtattattgtatgtatagcagtggctcaggggtactactacgggatgggacgtcgtggggccaaggggaccacggtcaccgtctcctcagcctcaccaagggcccatcggtcttccccctggccaccctcctccaagagcacctctgggggcacagcggccctgggctgcctggtcaaggactacttccatctacactactgagcgggctggcaagggcgcagtagnnnnnnnn

SEQ ID NO: 193182 - DNA, 808 bp, Homo sapiens
  misc_feature: GYAE6OF02HBO6O.37.46.E02.1.454.CMB.1.raw
  modified_base (735)..(735): a, c, t, g, unknown or other
  misc_feature (735)..(735): n is a, c, g, or t
  modified_base (754)..(754): a, c, t, g, unknown or other
  misc_feature (754)..(754): n is a, c, g, or t
tcagtagtgtagatcacgaccggtgctcgatttagactcatctacagggaaaggtcggtggtagtcggttggccgaacttagaagtaaagctaacagtttacccggcgaccaggcatatgttgacgtcggtgaaaccggcaggtttccacccatccttccagagattcgattttcggaaaagaacgaacggtccgtttacctagtccaaaatttggaacccgaggacccttggaaaaaccccgaggaactaacgggcccgtttttggactttagtttcgtaatgtagtagccaggtcggactcccaagggttaccctacgtacgggatttggacgtctcggggccttaaggggaccacggtcgaaccggttcctaccgtccaggtccctaccgaccgaacgggaccctagttccggttccgttcccccctaggtcctaccccgtccctccctaacgaccgcctaccctacgtcgggggacctaccaggccggacccctcggggcgtacggccctttcgggtaccgtaaacgggttacctttaacccgtttcccgaacttaacccgttaaacctaaccttttaaccgtttttacggtaacccggttaccggggtaccgtttttacggggacccgaaaacgggggttacccgaacgtaacgtttaacggggactaacgttacgaaacgtacgtcgttagctacggacctacctatccgtgtctactactccgtaccncctatccgtatataccgtnttaccgtgtcctaaggtaccggacggttcctagggtaccaagggtcgaccgtaa

SEQ ID NO: 193183 - DNA, 433 bp, Homo sapiens
  misc_feature: GYAE6OF02INHJT.37.46.E02.1.454.CMB.1.raw
  modified_base (427)..(433): a, c, t, g, unknown or other
  misc_feature (427)..(433): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcaggggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggctactccatctacactactgagcgggctggcaaggcgcatagnnnnnnn

SEQ ID NO: 193184 - DNA, 436 bp, Homo sapiens
  misc_feature: GYAE6OF02GGD4G.37.46.E02.1.454.CMB.1.raw
  modified_base (80)..(80): a, c, t, g, unknown or other
  misc_feature (80)..(80): n is a, c, g, or t
  modified_base (424)..(436): a, c, t, g, unknown or other
  misc_feature (424)..(436): n is a, c, g, or t
tcagtagtgtagatcacgaccggtgctcgatttagactcatctacagggaaagggctggagtgggtgcgatagagtaagntaacagtacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccggtctcctcagcctccaccaagggcccatcggtcttccccctggcaccctcctccacgacgcacctctgggggcacgagcggccctgggctgcctggtcaaggactacttccatctacactactgagcggctggcgaaggcgcatagcnnnnnnnnnnnnn

SEQ ID NO: 193185 - DNA, 540 bp, Homo sapiens
  misc_feature: GYAE6OF02F18ZK.37.46.E02.1.454.CMB.1.raw
  modified_base (194)..(194): a, c, t, g, unknown or other
  misc_feature (194)..(194): n is a, c, g, or t
  modified_base (339)..(339): a, c, t, g, unknown or other
  misc_feature (339)..(339): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagacacggcgtttctgcaaatgaacagcctgaaaaccgnggacacggcctgtattatgtatgtatagcagtggctcagggtactactacgggatggacgtctggggccaagggaccacggtcaccgtctcctcagcctccaccaagggcccatccggtcttccccgtggccacctcctcaacgngcacctctggggcacgacgccggcctgggctcgccgtggtcaaggactacgttccagtcctaacacgtactcgagcggctggcaaggcgacataggcagtcngtcgngtactgacncgtgacncgactgcncgagtcacgtactgcgtacacgtcgtactacgtactacgcgtacgtcgtacgtacgtcgtacgtgtaccg

SEQ ID NO: 193186 - DNA, 439 bp, Homo sapiens
  misc_feature: GYAE6OF02G0CMT.37.46.E02.1.454.CMB.1.raw
  modified_base (429)..(439): a, c, t, g, unknown or other
  misc_feature (429)..(439): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggcaccctcctccaagacgcacctctgggggcacgagcggccctgggctgcctggtcaaggactacttccatctacactactgagcgggctggcgagcgcatagnnnnnnnnnnn

SEQ ID NO: 193187 - DNA, 438 bp, Homo sapiens
  misc_feature: GYAE6OF02F1XIJ.37.46.E02.1.454.CMB.1.raw
  modified_base (431)..(438): a, c, t, g, unknown or other
  misc_feature (431)..(438): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggactctggggccaagggaccacggtcaccgtctcctcagcctccaccaagggcccatcggtcttccccctggccaccctcctccaacgagcacctctgggggcacagcggccctggggctgcctggtcaaggactacttccatctaccactactgagcgggctggcaaggcgcatagnnnnnnnn

SEQ ID NO: 193188 - DNA, 436 bp, Homo sapiens
  misc_feature: GYAE6OF02HKU2F.37.46.E02.1.454.CMB.1.raw
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
  modified_base (430)..(436): a, c, t, g, unknown or other
  misc_feature (430)..(436): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggccaccctcctccaagacncacctctgggggcacagcggccctgggctgcctggtcaaggactacttccatctacactactgagcgggctggcaaggcncatagnnnnnnn

SEQ ID NO: 193189 - DNA, 462 bp, Homo sapiens
  misc_feature: GYAE6OF02I2XSK.37.46.E02.1.454.CMB.1.raw
  modified_base (432)..(433): a, c, t, g, unknown or other
  misc_feature (432)..(433): n is a, c, g, or t
  modified_base (435)..(462): a, c, t, g, unknown or other
  misc_feature (435)..(462): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggccgtgtattattgtatgtatagcagtggctcagggtactactacgggatggacgtctggggccaagggaccacggtcaccgtctcctcagcctccaccaaggcccatcggtcttccccctggcaccctcctccaagagcacctctgggggcacagcgccctgggctgcctggtcaaggactacttccatctacactactgacgcgggctcgggcaaggcgcataggcnncnnnnnnnnnnnnnnnnnnnnnnnnnnnn

SEQ ID NO: 193190 - DNA, 464 bp, Homo sapiens
  misc_feature: GYAE6OF02IM935.37.46.E02.1.454.CMB.1.raw
  modified_base (454)..(464): a, c, t, g, unknown or other
  misc_feature (454)..(464): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgacaaatgaacagcctagaaaaccgaggacacggccgtgtattattgtatgtatagcagtggctcgagggtactacgtacgggatggacgtcgtggggccaagggaccacggtcacccgtctcctcagcctccaccaagggcccatccggtccttccccctggccaccctcctccaagacgccacctcgtgggggcacgacgccggcccgtgggctcgccgtcggtcaacggactactccactactaccactacgtgacgcgggctggacaaggcgcagtagnnnnnnnnnnn

SEQ ID NO: 193191 - DNA, 451 bp, Homo sapiens
  misc_feature: GYAE6OF02H5127.37.46.E02.1.454.CMB.1.raw
  modified_base (195)..(195): a, c, t, g, unknown or other
  misc_feature (195)..(195): n is a, c, g, or t
  modified_base (438)..(451): a, c, t, g, unknown or other
  misc_feature (438)..(451): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtcgtggggccaagggaccacggtcaccgtctcctcagcctccaccaagggcccatcggtcttccccctggccacccctcctccaagacgccacctcgtgggggcacgagccggccccgtgggctgcctggtcaaggacctacttccatctacactactgagcgggctggcaggcgcatagnnnnnnnnnnnnnn

SEQ ID NO: 193192 - DNA, 432 bp, Homo sapiens
  misc_feature: GYAE6OF02I3FHC.37.46.E02.1.454.CMB.1.raw
  modified_base (195)..(195): a, c, t, g, unknown or other
  misc_feature (195)..(195): n is a, c, g, or t
  modified_base (426)..(432): a, c, t, g, unknown or other
  misc_feature (426)..(432): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgnggacacggccgtgtattattgtatgtatagcagtggctcagggtactactacgggatggacgtctggggccaagggaccacggtcaccgtctcctcagcctccaccaagggcccatcggtcttcccctggcaccctcctccagacgcacctctgggggcacagcggccctgggctgcctggtcaaggactacttccatctacactactgagcggctggcaaggcgcatagnnnnnnn

SEQ ID NO: 193193 - DNA, 456 bp, Homo sapiens
  misc_feature: GYAE6OF02HFFPD.37.46.E02.1.454.CMB.1.raw
  modified_base (434)..(434): a, c, t, g, unknown or other
  misc_feature (434)..(434): n is a, c, g, or t
  modified_base (440)..(456): a, c, t, g, unknown or other
  misc_feature (440)..(456): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgaggacacggccgtgtattattgtatgtatagcagtgctcgagggtactactacgggatgggacgtcgtggggccaaagggaccacggtcaccggtctcctcagcctccaccaagggcccatcggtcttccccctggcaccctcctccaagacgcacctctcgggggcacacgccggcccgtgggcctgccgtggtcaagggactacgtccatctacactactgagcggctggcaaggcncatagnnnnnnnnnnnnnnnnn

SEQ ID NO: 193194 - DNA, 438 bp, Homo sapiens
  misc_feature: GYAE6OF02GPGIC.37.46.E02.1.454.CMB.1.raw
  modified_base (198)..(198): a, c, t, g, unknown or other
  misc_feature (198)..(198): n is a, c, g, or t
  modified_base (430)..(438): a, c, t, g, unknown or other
  misc_feature (430)..(438): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgttttctgcaaatgaacagcctagaaaaccgnggacacggccgtgtattattgtatgtatagcagtggctcagggtactactacgggatggacgtcgtggggccaagggaccacggtcaccgtctcctcagcctccaccaagggcccatcggtcttccccctggccaccctcctccaagacgcacctctgggggcacagcggccctgggctgcctggtcaaggactactcatctacactactgagcggctggcaggcgcatagnnnnnnnnn

SEQ ID NO: 193195 - DNA, 436 bp, Homo sapiens
  misc_feature: GYAE6OF02FM4YU.37.46.E02.1.454.CMB.1.raw
  modified_base (429)..(436): a, c, t, g, unknown or other
  misc_feature (429)..(436): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatgggacgtctgggggccaagggaccacggtcaccgtctcctcagcctccaccaaggcccatcggtcttccccctggcaccctcctccaagagcacctctgggggcacagcggccctgggctgcctggtcaaggactacttccatctacactactgagcgggctggcaaggcgcatagnnnnnnnn

SEQ ID NO: 193196 - DNA, 438 bp, Homo sapiens
  misc_feature: GYAE6OF02HU0T8.37.46.E02.1.454.CMB.1.raw
  modified_base (405)..(405): a, c, t, g, unknown or other
  misc_feature (405)..(405): n is a, c, g, or t
  modified_base (429)..(438): a, c, t, g, unknown or other
  misc_feature (429)..(438): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaaatgaacagcctgaaaaccgaggacacggccgtgtattattgtatgtatagcagtggctcagggtactactacgggatgggacgtctggggccaaggggaccacggtcaccggtctcctcagcctcaccaagggcccatcggtcttccccctggcaccctcctccaagagcacctctgggggcacagcgccctgggctgcctggtcaaggctacttccatctacactacngagcgggctggcaaggcgcatagnnnnnnnnnn

SEQ ID NO: 193197 - DNA, 555 bp, Homo sapiens
  misc_feature: GYAE6OF02JMDEZ.37.46.E02.1.454.CMB.1.raw
  modified_base (198)..(198): a, c, t, g, unknown or other
  misc_feature (198)..(198): n is a, c, g, or t
  modified_base (341)..(341): a, c, t, g, unknown or other
  misc_feature (341)..(341): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(555): a, c, t, g, unknown or other
  misc_feature (527)..(555): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaaacagcctagaaaaccgnggacacggccgtgtattatgtatgtatagcagtgctcgagggtactacgtacgggatggaccgtcgtggggccaaggggaccacggtcaccgtctcctcacgcctccaccgaacgggcccagtccggtccttccccctggccncccctcctccaacgacgccaccgtcgtcgggggccacgacgccggcccgtggggcctcggccgtggtccgaaacgggtaccttaacccgttcctactcctaacctaccttaccgtacggacggccgggtcgtacgggaccgtaaacgggccggactaacgtaaggnacgtancgtcgcncgncngnnnnnnnnnnnnnnnnnnnnnnnnnnnnn

SEQ ID NO: 193198 - DNA, 455 bp, Homo sapiens
  misc_feature: GYAE6OF02JHWPV.37.46.E02.1.454.CMB.1.raw
  modified_base (433)..(455): a, c, t, g, unknown or other
  misc_feature (433)..(455): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggccacggtcaccgtctcctcagcctccaccaagggcccatcggtcttcccccctggccaccctcctccaacgagcacctctgggggcacagcggccctggggctcgcctggtcaaggactacttccatctacactactgacgcgggctggcaaggcgcatagnnnnnnnnnnnnnnnnnnnnnnn

SEQ ID NO: 193199 - DNA, 440 bp, Homo sapiens
  misc_feature: GYAE6OF02HDOGS.37.46.E02.1.454.CMB.1.raw
  modified_base (292)..(292): a, c, t, g, unknown or other
  misc_feature (292)..(292): n is a, c, g, or t
  modified_base (341)..(341): a, c, t, g, unknown or other
  misc_feature (341)..(341): n is a, c, g, or t
  modified_base (429)..(440): a, c, t, g, unknown or other
  misc_feature (429)..(440): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaaatgaacagcctgaaaaccgaggacacggccgtgtattattgtatgtatagcagtggctcagggtactactacgggatgggacgtctggtgccaagggaccacggtcacgtctcctnagcctcaccaagggcccatcggtcttccccctggcaccctcctccaagngcacctctggggcacagtcggccctgggctgccctggtacaaggctacttcatctacactactgacgcgggctggcaaggcgcatagnnnnnnnnnnnn

SEQ ID NO: 193200 - DNA, 536 bp, Homo sapiens
  misc_feature: GYAE6OF02JF45P.37.46.E02.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
  modified_base (510)..(536): a, c, t, g, unknown or other
  misc_feature (510)..(536): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctagaaaaccgnggacacggccgtagtattattgtatcggtatagcagtggctnagggtactactacgggatggacgtcgnggggtccaagggaccacggtcaaccgtctcctcaggccctccgaccaacgggccccatacggtcctttacccccgtcggcccacccctcctccaacgacgaccaccctcggtcgggggccacgtacgccggtcccgtagggcgtcgcctggtaccgagacctacttccatacctacactacgcgacgtcgggactcggactaacggggcnccgaatacggntacncgtnacgctagctcgnagcnnnnnnnnnnnnnnnnnnnnnnnnnnn

SEQ ID NO: 193201 - DNA, 501 bp, Homo sapiens
  misc_feature: GYAE6OF02GZ2BM.37.46.E02.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (465)..(466): a, c, t, g, unknown or other
  misc_feature (465)..(466): n is a, c, g, or t
  modified_base (468)..(469): a, c, t, g, unknown or other
  misc_feature (468)..(469): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(480): a, c, t, g, unknown or other
  misc_feature (478)..(480): n is a, c, g, or t
  modified_base (482)..(501): a, c, t, g, unknown or other
  misc_feature (482)..(501): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctcagagatgattacaaagaacacggtcgtttcgacaaatgaacagcctagaaaaccgaggacacggtcgtagtattatgatgtatagnaggtgctagagggtactagtacgggnttggacgtgtcgggggaccaagggacccacggtcaccgtctccncngccctccaccgaacggcccagtccggtcctccccgngccncccncacanacgtccacctcggnggggcacncggccgccgnggctcgacctggaccaggtactaccgtcatcgtacacgttactgagcgggtcagggaccgtaaggccgtcaagtcgnggacgngnncnngncgncngnnncnnnnnnnnnnnnnnnnnnnn

SEQ ID NO: 193202 - DNA, 459 bp, Homo sapiens
  misc_feature: GYAE6OF02JITFN.37.46.E02.1.454.CMB.1.raw
  modified_base (419)..(419): a, c, t, g, unknown or other
  misc_feature (419)..(419): n is a, c, g, or t
  modified_base (439)..(459): a, c, t, g, unknown or other
  misc_feature (439)..(459): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcaggggtactacgtacggggatgggacgtcgtggggccaagggaccacggtcaccgtctcctcagcctccaccaagggcccatccggtcttcccccctgggccacccctcctccaacgacgccacctctcggggggcacaggcggccctgggctgcctggtcaaggactactccatctacactacngagcggctggcaggcacatnnnnnnnnnnnnnnnnnnnnn

SEQ ID NO: 193203 - DNA, 490 bp, Homo sapiens
  misc_feature: GYAE6OF02JVEYT.37.46.E02.1.454.CMB.1.raw
  modified_base (329)..(329): a, c, t, g, unknown or other
  misc_feature (329)..(329): n is a, c, g, or t
  modified_base (452)..(452): a, c, t, g, unknown or other
  misc_feature (452)..(452): n is a, c, g, or t
  modified_base (459)..(490): a, c, t, g, unknown or other
  misc_feature (459)..(490): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaaatgaacagcctgaaaaccgaggacacggcctgtattattgtatgtatagcagtggctcagggtactacgtacgggatggacgtctggggccaagggaccacggtcaccgtctcctcagcctccaccaggcccagtcggccttccccctggccnccctcctccaagcgcacctcgtggggcacgagccggccctgggctcggcctggtaccgaaggacctacttccatcctactacgtactgacgccgggctcggctaaacggcgtaccgagtcgangctgcgnnnnnnnnnnnnnnnnnnnnnnnnnnnnnnnn

SEQ ID NO: 193204 - DNA, 511 bp, Homo sapiens
  misc_feature: GYAE6OF02HDDBJ.37.46.E02.1.454.CMB.1.raw
  modified_base (373)..(373): a, c, t, g, unknown or other
  misc_feature (373)..(373): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(511): a, c, t, g, unknown or other
  misc_feature (479)..(511): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgaggacacggccgtgtattattgtatgtatagcagtgctcgagggtactacgtacgggatggacgtcgtggggccaagggaccacggtcaccgtctcctcacgcctccaccaacggccccagtccggtccttccccctggaccctccctcctccaacgacgcacctcgtgggggcacncgccggcccctgggctcgccgtcggtacaacggtacttaccttccatccctactacctacgtaggcggcggggtctcgggacgaacgggtcgacgtaagtgnancnnnnnnnnnnnnnnnnnnnnnnnnnnnnnnnnn

SEQ ID NO: 193205 - DNA, 492 bp, Homo sapiens
  misc_feature: GYAE6OF02GIEWY.37.46.E02.1.454.CMB.1.raw
  modified_base (196)..(196): a, c, t, g, unknown or other
  misc_feature (196)..(196): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
  modified_base (463)..(492): a, c, t, g, unknown or other
  misc_feature (463)..(492): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggctttctgcaaaatgaacagcctgaaaacccgnggacacggccgtgtattattgtatgtatagcagtggctcgagggtactatacgggatggacgtctggggccaagggaccacggtcacccgtctcctcagccctccaccaacggcccagtccggtcttcccccctggccaccctcctccaacgacgccacctcgtgggggacacacggccggccccgtgggcctcggcccgtggtaccaaggactacttccatcgtaaccnctactgaggccggtcgtgcgaggtcgcactagcngcnnnnnnnnnnnnnnnnnnnnnnnnnnnnnn

SEQ ID NO: 193206 - DNA, 544 bp, Homo sapiens
  misc_feature: GYAE6OF02IGAE2.37.46.E02.1.454.CMB.1.raw
  modified_base (196)..(196): a, c, t, g, unknown or other
  misc_feature (196)..(196): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (509)..(510): a, c, t, g, unknown or other
  misc_feature (509)..(510): n is a, c, g, or t
  modified_base (512)..(519): a, c, t, g, unknown or other
  misc_feature (512)..(519): n is a, c, g, or t
  modified_base (521)..(523): a, c, t, g, unknown or other
  misc_feature (521)..(523): n is a, c, g, or t
  modified_base (525)..(528): a, c, t, g, unknown or other
  misc_feature (525)..(528): n is a, c, g, or t
  modified_base (530)..(537): a, c, t, g, unknown or other
  misc_feature (530)..(537): n is a, c, g, or t
  modified_base (539)..(543): a, c, t, g, unknown or other
  misc_feature (539)..(543): n is a, c, g, or t
tcagtagtgtagatcacgaccggtgctcgatttagactcatctacagggaaagggctggagtgggttggccgaattagaagtaaagctaacagttacgcgacagcatatgttgcgtcagtgaaaggcaggttcacatctccagagatgattcaaagaacacggcgtttctgacaaatgaacagcctagaaaaccgnggacacggccgtgtattatgtatgtatagcagtgctcagggtactacgtacgggatggacgtcgtggggccgaaagggaccacgggtcaaccggtctccgtcagcctccaccaaggcccatccggtcttccccctggccacccctccgtccaaagtcgcacctcgtgggggccacgacggccggcccgtggggaccttcggcgtcggtaccgtaacgggtaactaccgtttccattcctaacctaccgttaactcggacggccgggtaccgtcggaccgaaacgggcgaacgaattcggacngtacngacncnngnnnnnnnngnnnannnngnnnnnnnncnnnnnc

SEQ ID NO: 193207 - DNA, 434 bp, Homo sapiens
  misc_feature: GYAE6OF02FUFGW.37.46.E02.1.454.CMB.1.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
  modified_base (415)..(434): a, c, t, g, unknown or other
  misc_feature (415)..(434): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctgaaaaccgaggacacggccgtgtattattgtatgtatagcagtggctcgagggtactactacgggatgggacgtcgtggggccaagggaccacggtcaccgtctcctcagcctcaccaggccatcgtctcccctgcacctctccagancacctcgtggggcacacgcgccngggctgctggcaagactactcactctacactactgagcgggctggnaaggcgcatgnnnnnnnnnnnnnnnnnnnn

SEQ ID NO: 193208 - DNA, 529 bp, Homo sapiens
  misc_feature: GYAE6OF02JDNYE.37.46.E02.1.454.CMB.1.raw
  modified_base (184)..(184): a, c, t, g, unknown or other
  misc_feature (184)..(184): n is a, c, g, or t
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
  modified_base (493)..(529): a, c, t, g, unknown or other
  misc_feature (493)..(529): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctcagagatgattacaaaggaacacggtcgtttctgcaaatgaacngacctagaaaaaccgaggacacggccgttagtattattgtatgtaagtancaggtggcctgtagggtaacctacgtacgggntgggacgtgtacgggggaccaagggacctaccggtccaccgttctccgtacncgtccctaccgaccgtaacggccctagtccgtcctccccgtcggccctccctctaccgacgatcccgaccgtcggtgggccaacgngtacccggtcccgnggctacgccgttgacgaactcactcactctacnctacgtcggacgcgggtctacggcgaacgccganacgtagcnnnnnnnnnnnnnnnnnnnnnnnnnnnnnnnnnnnnn

SEQ ID NO: 193209 - DNA, 578 bp, Homo sapiens
  misc_feature: GYAE6OF02G4DUU.37.46.E02.1.454.CMB.1.raw
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
  modified_base (545)..(546): a, c, t, g, unknown or other
  misc_feature (545)..(546): n is a, c, g, or t
  modified_base (549)..(578): a, c, t, g, unknown or other
  misc_feature (549)..(578): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgttttctgcaaatgaacagcctagaaaaccgaggacacggccgtagtattattgtatgtatagcagtggctcgaggtactacgtacggagtggacgtcgtcgggccgaagggaccgacggtcgaccgttaccgtcctcgtacgcctcccaccaacgggacccgactccggtccttccccccgtcggccnccccctcccttccaacgacgacccnccgtaccgttcgggggccgacgacggccggtcccgtcggggccgttacggtcccgttacgggtccgaaacggggtaacctttaaccgtttacccgtacgtacccttacctaaccctaacgttcggaacggccgggtacggtcggacggtaacggcggaccagtganncgnnnnnnnnnnnnnnnnnnnnnnnnnnnnnn

SEQ ID NO: 193210 - DNA, 650 bp, Homo sapiens
  misc_feature: GYAE6OF02FNQLW.37.46.E02.1.454.CMB.1.raw
  modified_base (177)..(177): a, c, t, g, unknown or other
  misc_feature (177)..(177): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (570)..(570): a, c, t, g, unknown or other
  misc_feature (570)..(570): n is a, c, g, or t
  modified_base (583)..(583): a, c, t, g, unknown or other
  misc_feature (583)..(583): n is a, c, g, or t
  modified_base (614)..(615): a, c, t, g, unknown or other
  misc_feature (614)..(615): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
tcagtagtgtagatcacgaccggtgctcgatttagactcatctacagggaaagggctggagtgggttggccgaattagaagtaaagctaacaggttacgcgacagcatatgttgcggtcggtgaaacggcaggttcaccatcctccagagatgattcaaagaacacggtcgttttcngacaaatgaaaccagccctagaaaaccgnggaccacgggccgtgtattagttgtatgtataggcgagtggctacgagggtactacgtacgggatcgggacgttcgngggccgaaggaccgacggtccaccgtctcctaccacgcctaccaccgaacgggcccctaagttccggttaccctttccccccgtcggtaccctaccccgttcccctaccgaaacggaccgcctaacccgtccgttcgggggaccaccgaccggcggtcccgtcggggtccgtcggcccgtttagggacctaaacgggaccgtttaacgtttaccctaacgtacttaaccgtaacttaaccgtggaacggcgggtctacggtacgtaaacgggcgtacgtaagtacgngacactcgagcgngcgcgagcgcgacgcgcgacgtcgcgcgacnncncgcngcgtcgctctcgcgcncncncncncnncg

SEQ ID NO: 193211 - DNA, 491 bp, Homo sapiens
  misc_feature: GYAE6OF02F73DD.37.46.E02.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (467)..(491): a, c, t, g, unknown or other
  misc_feature (467)..(491): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaaatgaacagcctgaaaaaccgaggacacggacgtgtattattgtattatagnagtgngtcaggtacgtaactacgggagtagtacggtcgtcgggcggaacggaaccggaccgtcgaccgtactcctctagcctcccaccaacggaccgctacgtccgttcccctccggcgaccctccctccaacgacgcacctcgtcgggacgcacgcggcccgcggtcgcnccgtcgtcgaacggaactacttcctactctaccactacacgnggcggnggtcgcgaagcgctacagtnnnnnnnnnnnnnnnnnnnnnnnnn

SEQ ID NO: 193212 - DNA, 519 bp, Homo sapiens
  misc_feature: GYAE6OF02HU26K.37.46.E02.1.454.CMB.1.raw
  modified_base (300)..(300): a, c, t, g, unknown or other
  misc_feature (300)..(300): n is a, c, g, or t
  modified_base (483)..(485): a, c, t, g, unknown or other
  misc_feature (483)..(485): n is a, c, g, or t
  modified_base (487)..(519): a, c, t, g, unknown or other
  misc_feature (487)..(519): n is a, c, g, or t
tcagtagtgtagatcacgaccggtgctcgatttagactcatctacagggaaagggctggagtgggttggcagaattagaagtaaagctaacagttacgcgacagcatatgttgcgtcggtgaaaggcaggttcaccatctccagagatgattcaaaagacacggcgttttctgcaaaatgaaacagcctagaaaaccgaggacacggccgtgtattattgtatgtatagcagtggctcgaggggtactacgtacgggatggacgttcgtggggccgaagggaccacggtcaccgtctccncagcctccaaccgaacggcccacgtcggtccttcccccgtggcctacccctcctccaacgacgcacctcgtggggcacgacgccggccgtgggctgccgtggtacgaacggtacttacttaccgatacgtaacctactacgtcgaaggtcgggcgtacgggcgaacgggcgacgagtagcgannngnnnnnnnnnnnnnnnnnnnnnnnnnnnnnnnnn

SEQ ID NO: 193213 - DNA, 478 bp, Homo sapiens
  misc_feature: GYAE6OF02IPXBY.37.46.E02.1.454.CMB.1.raw
  modified_base (462)..(478): a, c, t, g, unknown or other
  misc_feature (462)..(478): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgttttctgacaaaatgaacagccctagaaaaccgaggacacggccgtgtaattattgtatgtatagcagtggctcagggtactacgtacgggatggacgtcgtggggccaagggaccacggtcaccgtctcctcacgcctccaaccaagggcccagtccggtccttcccccgtcggccaccctcctccaagagccacctcgtcgggggcacgacgcggcccgtcgggctcgccgtggtacaaggactactccatctaccactactgcgtcgggactcgggacaaggcgacagtagnnnnnnnnnnnnnnnnn

SEQ ID NO: 193214 - DNA, 552 bp, Homo sapiens
  misc_feature: GYAE6OF02IR8CD.37.46.E02.1.454.CMB.1.raw
  modified_base (263)..(263): a, c, t, g, unknown or other
  misc_feature (263)..(263): n is a, c, g, or t
  modified_base (512)..(512): a, c, t, g, unknown or other
  misc_feature (512)..(512): n is a, c, g, or t
  modified_base (517)..(552): a, c, t, g, unknown or other
  misc_feature (517)..(552): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcgagggtactacgtacgggatggacgtcgnggggccaagggaccacggtcaccgtctcctcacgcctccaccaacggcccatcggtccttccccctggccacccctcctacccaacgacgccaccgtcgtcggggggccacgacggccggcccgtcggggcctcggtcccgtgggtacgaacgggaccttaaccgttcccacttaccttacccaccgttacctacgggacgggcccggggtaccgttgggaccgaacggggtccgacctaaaggtacgngcagnnnnnnnnnnnnnnnnnnnnnnnnnnnnnnnnnnnn

SEQ ID NO: 193215 - DNA, 520 bp, Homo sapiens
  misc_feature: GYAE6OF02G6RHX.37.46.E02.1.454.CMB.1.raw
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (489)..(520): a, c, t, g, unknown or other
  misc_feature (489)..(520): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaagggggcaggttcaccatctccagagatgattcaaagaacacggcgtttctgcaaatgaacagcctgaaaaaccgaggacacggccgtgtattattgtatgtatagcagtgctcagggtactacgtacgggatggacgtcgtggggccaagggaccacggtcacccgtcctcctcacgccctccgaaccaaacggggccccaacgtccggtcccttccccccgtcggcccacccctccctccgaagacgcccacctcgtgggggccacacggccggcccgtggggctcgccgtggtcaaggtacctacttccatctaccacgtactgacggcgggtctcgggacgaagggccncaagtagacgntnnnnnnnnnnnnnnnnnnnnnnnnnnnnnnnn

SEQ ID NO: 193216 - DNA, 533 bp, Homo sapiens
  misc_feature: GYAE6OF02I15FV.37.46.E02.1.454.CMB.1.raw
  modified_base (197)..(197): a, c, t, g, unknown or other
  misc_feature (197)..(197): n is a, c, g, or t
  modified_base (332)..(332): a, c, t, g, unknown or other
  misc_feature (332)..(332): n is a, c, g, or t
  modified_base (496)..(496): a, c, t, g, unknown or other
  misc_feature (496)..(496): n is a, c, g, or t
  modified_base (499)..(501): a, c, t, g, unknown or other
  misc_feature (499)..(501): n is a, c, g, or t
  modified_base (503)..(533): a, c, t, g, unknown or other
  misc_feature (503)..(533): n is a, c, g, or t
tcagtagtgtagatcacgaccggtgctcgatttagactcatctacagggaaagggctggagtgggttggccgaattagaagtaaagctaacagttacgcgacagcatatgttgcgtcggtgaaaggcaggttcaccatctccagagatgattcaaaagaacacggcgtttctgcaaatgaacagcctagaaaaccgnggacacggccgtgtattattgtatgtatagcagtggctcagggtactacgtacgggatggacgtcgtggggccaagggacccacggtcacccgtctcctcacgcctccaccaaggcccatccggtccttcccccnggccaccctcctccaagagccacctcgtgggggaccacacgccggcccgtgggcgtcgccgtggtcgaacggacttaccgttacccactaccgttacctacctacgttacggaaggccgggtccgtagggtcccgaaacgggccggacctaagttagacgctgntannnannnnnnnnnnnnnnnnnnnnnnnnnnnnnnn

SEQ ID NO: 193217 - DNA, 623 bp, Homo sapiens
  misc_feature: GYAE6OF02IF5IQ.37.46.E02.1.454.CMB.1.raw
  modified_base (165)..(165): a, c, t, g, unknown or other
  misc_feature (165)..(165): n is a, c, g, or t
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (467)..(467): a, c, t, g, unknown or other
  misc_feature (467)..(467): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (580)..(580): a, c, t, g, unknown or other
  misc_feature (580)..(580): n is a, c, g, or t
  modified_base (584)..(585): a, c, t, g, unknown or other
  misc_feature (584)..(585): n is a, c, g, or t
  modified_base (588)..(589): a, c, t, g, unknown or other
  misc_feature (588)..(589): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
  modified_base (606)..(609): a, c, t, g, unknown or other
  misc_feature (606)..(609): n is a, c, g, or t
  modified_base (611)..(623): a, c, t, g, unknown or other
  misc_feature (611)..(623): n is a, c, g, or t
tcagtagtgtagatcacgaccggtgctcgatttagactcatctacagggaaagggctggagtgggttggccgaattagaagtaaacgctaacagttaccgcgacagcaagtatgttgcgtcggtgaaaggcaggttcaaccatctcagagatgatcaaaagtacncggtcgtttcngactaaatgaacacgtcctaagaaaacccgnggaccacgggtccttagttaatttacgttggtatgttaatacggcgtaggttcggtctacgggaagggttacctaacggttacggggatgggaccgtggtagggggacctaacggggtaccacggttccaccggttcctccgtacacggtacccctaccgaaccggtacgggtaccctagtttcccggtcccttcccccggtaggaccctcccgttaccctacgaaacggtccaccctacggtcgggtaccgggggcacnccgggccgtccggtggcctagtccgtaggtaaccaacggtccttacgtaccagtactaactcgtacgagggtccgcggtcgtacggacagggccagttagcgnacgnannacngcanncgnncgnattcgnagccancnnnncnnnnnnnnnnnnn

SEQ ID NO: 193218 - DNA, 487 bp, Homo sapiens
  misc_feature: GYAE6OF01BVX3Q.10.2.A02.1.454.CMB.1.raw
tcagcatagtagtgcacgaccggtgctcgatttagactcatctacaggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgctagtttatactgtcagcagtataatagctggcccgcgacgttcggccaagggaccgaggtggaattcgaaagactgtggctgcacatctgtctc

SEQ ID NO: 193219 - DNA, 493 bp, Homo sapiens
  misc_feature: GYAE6OF01A0LQL.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctccaggctcctcgtatatggtgcatccaccagggccactggtatctcaggcaggttccgtggcaggtgggtctgggacagagttcactgtcaccatcagcagcctgcagtctgaagtattttgctagtttattactgtcagctagtataatagctggcccgcgacgttcggaccgaagggaccgaggtggaagttcgaaagactgtgctgcacatctgtctc

SEQ ID NO: 193220 - DNA, 491 bp, Homo sapiens
  misc_feature: GYAE6OF01CBNED.10.2.A02.1.454.CMB.1.raw
  modified_base (388)..(388): a, c, t, g, unknown or other
  misc_feature (388)..(388): n is a, c, g, or t
  modified_base (431)..(431): a, c, t, g, unknown or other
  misc_feature (431)..(431): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagnttttgctagtttattactgtcagcagtataatagctggcccgngacgttcggccgaagggccgaggtggaatcgaaacgactgtggctgacacatctgtcttc

SEQ ID NO: 193221 - DNA, 487 bp, Homo sapiens
  misc_feature: GYAE6OF01E066I.10.2.A02.1.454.CMB.1.raw
  modified_base (390)..(390): a, c, t, g, unknown or other
  misc_feature (390)..(390): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacaggagttcactgtcaccatcagcagcctgcagtctgaagtntttgctagtttatactgtcagcagtataatagctggcccgcgacgttcggcaagggccgaggtgaattcaaacgactgtggctgcacatctgtcttc

SEQ ID NO: 193222 - DNA, 499 bp, Homo sapiens
  misc_feature: GYAE6OF01ACV6F.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagtatttgctagtttattactgtcagcagtataatagcgtcggcccgtcgacgttcggaccgaagggaccgagggtggaagttcgaaacgtactggtggctgcacatctgtcttc

SEQ ID NO: 193223 - DNA, 551 bp, Homo sapiens
  misc_feature: GYAE6OF01CF3DA.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcatgttagcctggtaccagcagaaacgtggccaggctcccaggctcctcgtatagtggtgcatcccaccgagggccacgtggtatctcgaggctaggttccgtggcaggttgggtcgtggggacaggagtttcagttgtaccaccatcagcagcctgcagtctagtaagtattttgcttagttttacttacgtgtacagtctaagttataatagtcgtggcccgtggtacgttcggaccgtaagggaccggtaggtacggtaaattacgaaaacggtcgtaggtacggacttcggacaccgtattcgtggttccc

SEQ ID NO: 193224 - DNA, 599 bp, Homo sapiens
  misc_feature: GYAE6OF01CQZH7.10.2.A02.1.454.CMB.1.raw
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcaagaaacgtggccaggctccaggctctcgtatatggtgcatccaccgagggccagtggtatcgtcaggcaggttccgnggcaggtggtctgggacaggtacgttcacgtgtacaccatcagtcacgcctgctagtcgtagtaagtnttttgacttagtttatactggtacaagtctaagttaataagtacggtccgttacgggaccccgtacggttaaccggtttccggaaccggtaaacggggtacccgtaggggttacgtaaacgtttaacccggaaaaggttacgttgggtacggtaccgttacggaccctaacctagttccgttgttcccgtttaaccg

SEQ ID NO: 193225 - DNA, 486 bp, Homo sapiens
  misc_feature: GYAE6OF01DF29O.10.2.A02.1.454.CMB.1.raw
  modified_base (470)..(470): a, c, t, g, unknown or other
  misc_feature (470)..(470): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcaatctccagccaccctgtctgtgactccaggtgagagagccaccctctcttgcagggcagtcaggggatcagcagcaatttagcctggtaccaacagaagcctggccaggttcccagactcctcatatatgaagcctcttccagggcccacgtggacgtcccagccaggttcagcggcggtgggtctgggacagacttcactctcacatcagcagcctgcagtctggagtaccttggagtttatactgtcagcagtatcatactgcctcgtgacgttcgccgaaggaccgaggtcggaccgtcaagactgngctgcacatctgtctc

SEQ ID NO: 193226 - DNA, 498 bp, Homo sapiens
  misc_feature: GYAE6OF01AU2TL.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcaggtgggtctgggacaggagttcactgtcaccatcagcagcctgcagtctgaagtatttgctagtttattactgtcagcagtataatagctggcccgcgtacgttcggaccgagggaccgtaggtaggaacgtcgaaagacgtgcggctgcacatctgtctcg

SEQ ID NO: 193227 - DNA, 560 bp, Homo sapiens
  misc_feature: GYAE6OF01BL1V8.10.2.A02.1.454.CMB.1.raw
  modified_base (333)..(333): a, c, t, g, unknown or other
  misc_feature (333)..(333): n is a, c, g, or t
  modified_base (393)..(393): a, c, t, g, unknown or other
  misc_feature (393)..(393): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctccaggctctcgtatatggtgcatcccaccgagggccactggtatctcgaggctaggttccgnggcaggtgggtctgggacaggtagttcactgtcaccatcagcagcctgcagtctgaagtntttgacttagtttattactgtacagtctaagttataagtacgcgtcgggcccgtggtaccggttccgggaccgaaaggggtacccgtagggtaggtaaacgttaccgaaaacggtacgttggtacgggtctacggaccgtaccaagtttccttcggttccgttaccg

SEQ ID NO: 193228 - DNA, 527 bp, Homo sapiens
  misc_feature: GYAE6OF01DPEIY.10.2.A02.1.454.CMB.1.raw
  modified_base (337)..(337): a, c, t, g, unknown or other
  misc_feature (337)..(337): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcaagaaacgtgccaggctcccaggcctcctcgtatagtggtgcatcccaccgagggccactggtatctcaggcaggttccgnggctaggtgggtctgggacaggagttcactgtccaccatcagcagcctgcagtctagaagtatttgcttagtttattactgtcagtctaagtataatagcgtcggcccgtgtacggttcggaccgaagggaccgagggtagtaagttacgaaacgtacgtggtcggctcgaccactattcgtgtcttacg

SEQ ID NO: 193229 - DNA, 489 bp, Homo sapiens
  misc_feature: GYAE6OF01CIXXK.10.2.A02.1.454.CMB.1.raw
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgnggcaggtgggtctgggacagagttcactgtcaccatcagcagcctgcagtctagaagtntttgctagtttattactgtcagcagtataatgctggccngacgtcgcaagggccgaggtgaagttcgaaacgactggngctgacacatctgtcttacg

SEQ ID NO: 193230 - DNA, 527 bp, Homo sapiens
  misc_feature: GYAE6OF01BXYIM.10.2.A02.1.454.CMB.1.raw
  modified_base (331)..(331): a, c, t, g, unknown or other
  misc_feature (331)..(331): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctccaggcctcctcgtatatggtgcatccaccgagggccactggtatctcaggcaggttcgnggctaggtcggtctgggacaggacgttcacgtgtcaccatcagcagcctgctagtctgaagtatttgacttagtttattactgtcagtactagtataatgtcgtggcccgtcgtacgttccggacgaaggggaccgtagggtaggtaacgttacgaaacgtacgtcggtaggctcgaccacatccgttgtccttcg

SEQ ID NO: 193231 - DNA, 522 bp, Homo sapiens
  misc_feature: GYAE6OF01EM8HH.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatagtggtgcatccaccagggccactggtatctcaggcaggttccgtggcagtgggtctgggacagagttcactgtcacatcagcagcctgcagtctagaagtattttgctagtttattactgtcagctagtataatgcgtcggcccgtcgacgttcggaccgaagggaccgagggtaggaaacgttcgaaaacggtacgtggtacggctacggtccaaccattcgtgtcttaccg

SEQ ID NO: 193232 - DNA, 627 bp, Homo sapiens
  misc_feature: GYAE6OF01D1YDZ.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctccaggcctcctcgtatagtggtgcactccaacgaacgggccacgtggtaactccccgagccaggttcaggtggacaggtgggtctgggacaggtacgttcgcttctcaccatcagcagtctgcagtctagtagtattttgacttagtttacttacgtgtacgtaaggtaattagtcgtaagttcgggtacgttcggtcccgttaccggttaaccgttaccgttttacgggacccgttaaaacggggtacccgttaaagggtttcgggtaaacctaaggttaaacccggtaaaacggttaaccgttagggttacgggtaccgttacggaaccgtaacccttacgttccgtttacgg

SEQ ID NO: 193233 - DNA, 537 bp, Homo sapiens
  misc_feature: GYAE6OF01D3QRK.10.2.A02.1.454.CMB.1.raw
  modified_base (225)..(225): a, c, t, g, unknown or other
  misc_feature (225)..(225): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagngtgttggcagcaggttagcctggtaccagcagaacgtgccaggctccaggctcctcgtatatggtgcatccaccagggccacgtggtatctcaggcaggttccgtggcaggtggtctgggacaggtagtcactgtcacatcagcagcctgcagtctagaagtattttgctagtttattacgtgtctagtctagtaataagtagctcggcccgtacgtacgttcggaccgtaagggaccgtaggtaggtaaacgttacgaaaacggtacgtcggtcgggtcctagacctaaccgtattccgttgtccttaccg

SEQ ID NO: 193234 - DNA, 623 bp, Homo sapiens
  misc_feature: GYAE6OF01C7ANE.10.2.A02.1.454.CMB.1.raw
  modified_base (292)..(292): a, c, t, g, unknown or other
  misc_feature (292)..(292): n is a, c, g, or t
  modified_base (403)..(403): a, c, t, g, unknown or other
  misc_feature (403)..(403): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacacgccaccctctcctgcagggccagtcagagtgttggcagcaggttagcctggtaccagcagaacgtgccaggctccaggctcctcgtatatggtncatccaccgagggccacgtggtatctcgaggctacgggttccgtggctaggtcgggtctgggacaggtagttcacgttgcaccgatcagcagtcctgctagtctagaagtnttttgcttaagtttacttacttgtactagtacctaaggttaataaagttcggtaccgtacgggtccccggtacgtaccgggtttaccgggacccggtaaacggggtacccggtaaggggttacggtaaaccgtttaaccggaaaaaccggttaacggttcggtacgggacccgtttacgggaccctaaacccgtagtttcccgttaggttccctttaccg

SEQ ID NO: 193235 - DNA, 543 bp, Homo sapiens
  misc_feature: GYAE6OF01EAAAZ.10.2.A02.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (418)..(418): a, c, t, g, unknown or other
  misc_feature (418)..(418): n is a, c, g, or t
  modified_base (534)..(534): a, c, t, g, unknown or other
  misc_feature (534)..(534): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccaccctctcctgcagggccagtcagagtgtggcagcaggttagcctggtaccagcagaacgtggccaggctccagactcctcatctcgtggtnctatcgttcggaggtcctacgtggtcgtcccgagcccgtaggttcaggttggcgtaggttcgggtctagggaactaggtacgttcactctacacctatcgagccgcctgactagtctagaagttntttgacttagtttactactgtctagactagttataagtgtagttggtttatcgtacgtttccggccgtaggaacctaagtgtacgttcgagtacgtacgtgtggactggactactnttcgtgtcg

SEQ ID NO: 193236 - DNA, 578 bp, Homo sapiens
  misc_feature: GYAE6OF01D65I7.10.2.A02.1.454.CMB.1.raw
  modified_base (340)..(340): a, c, t, g, unknown or other
  misc_feature (340)..(340): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaacgtggccaggctcccaggcctcctcgtatagtggtgcatcccaccgagggcctacgtggtatctcgaggctaggttccgnggctaggtgggtctgggactaggtacgttcacgtggtacaccgatcagcacgcctgctagtctagaagtatttgactagtttacttctgtactagtactagttaactaagtacgtcgtcgggaccccgtaggtaccggttaccggaccgaaacggggacccggagggttacggtaaacgttaccgaaaagtacgttggtacgggtctacgaccgaactacgttccgttcgtcttaccg

SEQ ID NO: 193237 - DNA, 549 bp, Homo sapiens
  misc_feature: GYAE6OF01DTI9M.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggaaacagccaccctctcctgcagggccagtcagagtgttggcagcaggttagcctggtaccagcagaaacgtggccaggctccgaggctcctcgtatagtggtgcatcccaccgagggccagtggtactctcgaggcaggttccgtggcgaggtgggtctgggacaggagttcactgtacacatcagcagcctgcagtctagaagtatttgacttagtttacttacgtgtcagtatagtaattaatacgtcgtcggcccgtacgtaccggttccggaccgaacgggtaccggtagggtaggtaacttaccgaaacgtacgtggtacggtcgtacgccaacctattacgtggtcttaccg

SEQ ID NO: 193238 - DNA, 511 bp, Homo sapiens
  misc_feature: GYAE6OF01BAMCA.10.2.A02.1.454.CMB.1.raw
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctcccaggctcctcgtatatggtgcatcccaccgagggccacgtggtatcctcgaggcagggttccgtggcaggtgggtctgggacagngttcacgtgtccaccatcagcagcctgcagtctgaatntttgctagtttatactgtcagctagttataatagcgtcggcccgtcgacgttcggccgaaggccggaggtggtaatcgaaacgacgtggtcgctacgcacattctgtcttacg

SEQ ID NO: 193239 - DNA, 520 bp, Homo sapiens
  misc_feature: GYAE6OF01AG1QN.10.2.A02.1.454.CMB.1.raw
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcaggaaacgtggccaggctccaggctcctcgtatagtggtgcatcccaccgagggccactggtatctcaggcaggttccgtggcaggtgggtctgggacagagttcacgtgtcacctatcagcagcctgcagtctgaagtnttttgctagtttntactgtcagtntaagtataagtcgntcgggcccngtacggttcgcgtaaacgggccgagggtagaacgttcgaaagtacgtggtcggtctagcctacattcgtgtcttaccg

SEQ ID NO: 193240 - DNA, 501 bp, Homo sapiens
  misc_feature: GYAE6OF01EF99S.10.2.A02.1.454.CMB.1.raw
  modified_base (390)..(390): a, c, t, g, unknown or other
  misc_feature (390)..(390): n is a, c, g, or t
  modified_base (482)..(482): a, c, t, g, unknown or other
  misc_feature (482)..(482): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctccaggctcctcgtatatggtgcatccaccgagggccactggtatctcaggcaggttccgtggcaggtggtctggggacagagttcactgtcacatcagcagctgcagtctagaagtntttgcttagtttattactgtcagctaagtataatagcgtggcccgtcgacgttccggacgaagggccgaggtagaagttacgaaagactggngctgacacatctgtcttac

SEQ ID NO: 193241 - DNA, 839 bp, Homo sapiens
  misc_feature: GYAE6OF01ATDJM.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaacagccaccctctcctgcagggccagtcagagtgttggcagcaggttagcctggtaccagcaagaacgtggccaggcctccgaggtcctccgtcgtatagtggtcgccactcccgaccgacgggccctacgtcggtactccgtcgacgggtcctacggggttcccgtgggccgtagggttcggggtcgtagggggacctaggtacggtttcccaacgtttcggtaccaacccgtattccgaacggcccgtaacggtccccgttagggaccgtaacgggttaccgttaagggtaaacggttttacgttttttacgggacccgttttaaagggttttttaaccgttttaacccggttcgggtttaacccgtaagggttacccgttaaagggttttaaacttaaacggtttaccgggtacccggttacccgggggtaccccccggttacggggttaacccgggtttacccggggaacccgggtaaaaccgggggggtacccgggttaagggggttaaacgggtaaaacccgtttaaccggtaaaaacccggggttaaccggtttcggggttaccgggtaacccgtttaaccgggttaaacccgttacggtttacccgtttaccgggtttccctttaccggttaaccccg

SEQ ID NO: 193242 - DNA, 664 bp, Homo sapiens
  misc_feature: GYAE6OF01DK55C.10.2.A02.1.454.CMB.1.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgcagtctccagcccaccctgtctgtgtctccgagggaacngccacctctcctgcagggccagtcagtagtgtggcagcgtaggttagcctggtaccagcaagaacgtggccaggcctcccaggcctcctacgtatagtggtncactcccacgacgggccagttggtactctgacggtcgtacgggtttccgngggcgtagggtcggtcgtgggactaggtacgtttcacgttgtaccaccgtagtccgagctacgccgtagccgtaggttctaaggtaaacgtttgtttttacggacttttaaggttttaacttacgttcggtacctaaggtcgttaaagtttataaacgttcggtcgttccggggaccccgtagggttacccggttaccggaaccggtaaaggggccggttaaagggtacggtaaaaccgtttaccggaaaacgggtaacgttcgggtacggtacccttagggaaccctacgttatcggtttcgttcccttaacg

SEQ ID NO: 193243 - DNA, 566 bp, Homo sapiens
  misc_feature: GYAE6OF01BKMUD.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaacgtggccaggctcccaggcctcctcgtatatggtgcatccaccgagggccatggtatctcaggctaggttcccgtggctaggtgggtctgggacaggacgttcacgtgtccaccatccagcacgcctgcagtctagaagtattttgctagtttatatgtcagcagcgtacgccgtacgtttcggcggtacggtcgtacccgtacgtttccgggacgggtaacgggaaccgtaaaaggtacggtacgggtaaccgtaaaccggaaccgttaggtacggtaccgtacgacccaacccgtgtacgttccgg

SEQ ID NO: 193244 - DNA, 536 bp, Homo sapiens
  misc_feature: GYAE6OF01BW46L.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctccaggctcctcgtatatggtgcatccaccagggccatggtatctcaggcaggttccgtggctaggtggtctgggacagagttcactgtcacatcagcagcctgcagtctgaagtatttgctagtttattactgtactagctagtataatagctcggcccgcgtacgttcggaccgtaaggggacccgtagggtacggtaacgttacgaaacggtaacgtggtacggtaccgtcggacctacctagttccgttgttccgttaccg

SEQ ID NO: 193245 - DNA, 514 bp, Homo sapiens
  misc_feature: GYAE6OF01DWVY1.10.2.A02.1.454.CMB.1.raw
  modified_base (356)..(356): a, c, t, g, unknown or other
  misc_feature (356)..(356): n is a, c, g, or t
  modified_base (511)..(511): a, c, t, g, unknown or other
  misc_feature (511)..(511): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgacgacgcagtctccagccaccctgtctgtgtctccaggggaaacagccaccctctcctgcagggccagtcagagtgttggcagcaggttagcctggtaccagcagaaacgtggccaggctccaggctcctcgtatagtggtgcatcccaccgagggccactggtatctcaggcaggttccgtggcaggtgggtctgggacaggngttcacgtgtcaccatcagcagcctgcagtctagaagttatttcgactagttttactacgtgtacagctaagtataagtagcgtcgggcccgcgtacgttcggaccgaagggaccgaggtgaattcgaaacgtatggtgcctgcacatctgtctntac

SEQ ID NO: 193246 - DNA, 694 bp, Homo sapiens
  misc_feature: GYAE6OF01DVF9A.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacngcccaccctctcctgcagggccagtcagagtgttggcagcaggtacgcctggtaccagcaagaaacgtggccaggctcccgaggcctccgtcgtatagtggtcgcactccgaccgagggcccagttggtactcgtcgaggtctacgggttcccgtggcgtaggttggggtctaggggaacctaggtacgttccacgttgtaccaaccgtagtcgacggcctaaggtcccttggaccgtaggttaccgtaggaaaggtttatttttacggaccgtttaagtttttaacgtttacgttcggttactaacggtcgtaaggtttaaagtaacgttacggtacccgttacggggaccccgtaccgggttaaccgggtttacccggggaacccgtaaaagggggacccggtagggttaaccggtaaacgtttacccggaaaaccggtacggttcgggtcgggtaacctcggaccctaaccgtattccgttcggttccttaccg

SEQ ID NO: 193247 - DNA, 650 bp, Homo sapiens
  misc_feature: GYAE6OF01EIKS0.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaacgtggccaggctccgaggctcctgtatagtggtgcatcccaccgacgggccctacgtggtactccgtcgaggccgtagggtttcccgtgggcgtagggttcggggtcgtggggaactaggtagttccacgttcggtaccaacctagtccgaacgccgtaacggtccctaggaccgtaggttccgtaggtaaacgttacgtttttggactttaaggttttaacttacgtgttacagtactaagttaacgtaagtcggtccgtaccgggtccccggtacggtaccgggttaccgggacccggtaaaggggtacccggtagggttaacggtaacgttaccgaaacggtacggtggtacggtctacgacctacctagttcttcggtcttacccg

SEQ ID NO: 193248 - DNA, 687 bp, Homo sapiens
  misc_feature: GYAE6OF01BN0BE.10.2.A02.1.454.CMB.1.raw
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctcagccacctgtctgtgtctccgagggaacngccacctctcctgcaggccagtcagagtgtggcagcaggttacnccgtggtaccagcaggaacgtggccaggcctaccgaggtcctccgtacgtatacgtcggtacgcctaacgttcccgaaccggtacgggtaccctacggttacgggttaactccggttacggacgggtaccgttaacggggttcccgtagggtaccgtaacggggttcggggttacctacgggggtaacctacggtacggtttaccgaccggtttcggaccctaccgtacgtacgacggtcctacgtccgtagacgtacgtacgttagtaacgttgtttacgcgtttaagtttactacgtgtacgtagtcgtaagttactaacggacgtccgttacgggacccgttacggtaccggttacgaccggtaagggtaccgtaggtacgtaacgttacgaaaccggttcggtggtacgtactacggaccttacgtagttccgtagttccttacg

SEQ ID NO: 193249 - DNA, 572 bp, Homo sapiens
  misc_feature: GYAE6OF01CN1GD.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctcccgaggcctccgtcgtatagtggtcgcatcccgaaccgtaggggccctaacgtcgggtactcgtacgagggtctacggggtttcccggtgggccgtagggttcggggtacgtcggggaacaggtacgtttccacgtgtaccaccatcacgcacgcctgctagtcgtagaatgtttgacttagtttatacgtgtcagtctagtaataatgcgtcggccgtcgtacgttcggaccgaagggaccgaggtaggtaacgttaccgaaacgtacgtgtcggctcgaccactatctgtcctacg

SEQ ID NO: 193250 - DNA, 615 bp, Homo sapiens
  misc_feature: GYAE6OF01EEHT6.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccaccctgtctgtgtctccgaggggaaagacgccaccctctcctgcagggccagtcagagtgttcgctacttcggttagggtgtatcaacataaatccggcaggctcccaggcctcctcattcttgattgctttcaacgcgggccctggccgtccaggtcaggttcaggtggctaggtgggtcgtggggactacggacttcgactctccacctatcacgcaacgtcctaggacgtcctagtaacgtattttacgacttaagttttacttacgtgtccagtcaggtcgtcgccgtacgtttcggccgggtaggtcgtccgtaccggtttcgggaccgggaacgggtaaccgtaaaaagttcggaacgggttaaccgaaaacgggtaccgtaggtacggtcgtacggaccaaccgtacttccgtagtttaccgttcgtacgttccccg

SEQ ID NO: 193251 - DNA, 642 bp, Homo sapiens
  misc_feature: GYAE6OF01DSQKB.10.2.A02.1.454.CMB.1.raw
  modified_base (198)..(198): a, c, t, g, unknown or other
  misc_feature (198)..(198): n is a, c, g, or t
  modified_base (326)..(326): a, c, t, g, unknown or other
  misc_feature (326)..(326): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccaccctctcctgcagggccagtcagagtgttggcagcaggttagcctggtaccagcagaaacgtggccaggcctccgaggtcctccgtcgtatagtggtgcatccacgagggccacgtggtactcncgaggtctacgggttccgtggcgtaggtcgggtcgtggggacaggtacgttccacgttggtaccaccgatacgacgcgagtcccgtgcctagttacgtagtaagttagttttcgactttaggttttaactttacgttggttacgtagtaccgtaagttaacttaagtacggtccggttaccgggacccggtacggtaaccgggtttccgggaaccgggtaaacggggacccggtagggtaacggtaaacgttaccgaaaacggtacgttgggtaccggtaccgtacgaccctacgtaattccttggttcttacccg

SEQ ID NO: 193252 - DNA, 524 bp, Homo sapiens
  misc_feature: GYAE6OF01CHLOQ.10.2.A02.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacngccaccctctcctgcagggccagtcagagtgttggcagcaggttagctggtaccagcagaaacgtggaccaggcctccgaggcctcctcgtatatggtncatccacgagggccacgtggtatctcgaggcaggttccgtggctaggtggtcgtgggacagtgtcacgtntccacatcagcagcctgacagtctagaagtattttgactagtttacttctgtcagacagttataatagcgtggacccgtcgtacgttcggaccgaagggtccgaggtacggaagttacgaaacgtacgtgtacggntcgacacctntcttgtcttacg

SEQ ID NO: 193253 - DNA, 597 bp, Homo sapiens
  misc_feature: GYAE6OF01AMJEF.10.2.A02.1.454.CMB.1.raw
  modified_base (295)..(295): a, c, t, g, unknown or other
  misc_feature (295)..(295): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccgagggaaacagccaccctctcctgcagggccagtcagagtgttggcagcgaggttagcctggtaccagcaagaacgtggccaggctccaggctcctcgtatagtggtcncatccacgacgggtccagtggtactccgtcgaggcgtacggttccgtggctaggtgggtcgtagggtaactaggtacgttcaacgttcgtaccaccgtatcgacgcacggtcctagctagtacgtagtaagttgtttgacttaagtttactacgtgtacagtacgtaagttataagtgaccgttcggacccgaggtaccggttacgggaccgaaggggtaccgtagggtacggaacgttaccgaaacggtacggtcgggacggttacgacgtaccctacgtactttcgttcgttccttaccg

SEQ ID NO: 193254 - DNA, 498 bp, Homo sapiens
  misc_feature: GYAE6OF01EWZDW.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagtatttgactagtttatactgtcagcagtataatagactggccgcgtacgtcggaccgaagggaccgaggtaggaagttcgaaaggaactggtgctgacacatctgtcttac

SEQ ID NO: 193255 - DNA, 529 bp, Homo sapiens
  misc_feature: GYAE6OF01BGRUT.10.2.A02.1.454.CMB.1.raw
  modified_base (506)..(506): a, c, t, g, unknown or other
  misc_feature (506)..(506): n is a, c, g, or t
tcagcatagtagtgcacgaccggtgctcgatttagactcatctacagggggaggaactgctcacttaggacccagacggaaccatggaatccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctcccaggctcctcgtatagtggtgcatccaccgagggccactgggtatctcaggcctagggttccgtggcagggtcgggtctggggactagtagttcacttggtccaccatcagcagcctgcagtcagaagtatttgctagtttatacgtgtacagtctagtataatggcgtcggcccgacgtacggttcgacgaagggccgaggtagaacgttcgaaacgacgtggcggtacngtaccactagtcttgttcttacg

SEQ ID NO: 193256 - DNA, 543 bp, Homo sapiens
  misc_feature: GYAE6OF01A5IXI.10.2.A02.1.454.CMB.1.raw
  modified_base (336)..(336): a, c, t, g, unknown or other
  misc_feature (336)..(336): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcactccaccagggccacgtggtactctcaggctaggttccgnggctaggtgggtctgggacaggagttcactgtcaccatcagcagcctgcagtctgaagtatttgctagtttatctgtcagcagtataatagcgtcggcccgtcgtacgttccgggaccgaaggggtaccgtagggtacggtaacgttaccgaaacgtaacgtggtacggtcgtacggacctacccgtattccgttgttccgttaccg

SEQ ID NO: 193257 - DNA, 801 bp, Homo sapiens
  misc_feature: GYAE6OF01BQXSK.10.2.A02.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacngccaccctctcctgcagggccagtcagagtgttggcagcaggttagccgtggtaccagcaggaaacgtggccaggcctccgaggcctcctcgtatagtggtncactccaccgagggccacgtggtactcgtcgaggtctacggggttccgtgggctagggttcggggtcgttagggggaacctagggtacgttccgacgtttcggtaccctaaccctagttccgaacggtcctaacggtccccgttacggaccgtaacggtttccgttaagggtaaaacggttttacgttttttacgggaccgtttttaaacggtttttaacttttacccggttagggttacccgtaacgggttaccgttaaaggtttaaactttaaacggtaacgggttcccgttaccgggggtacccccgttaaccgggttacccggggttttacccgggaaccccgggtaaaaccgggggggtacccggtacggggttacccgggtaaaccgtaaaccggttaaccccggtaaaacccgggttaaccgttacggggttacgggtaacccgttaccgggtaacccttaaacccggtactttcccggtttcggttttaccccg

SEQ ID NO: 193258 - DNA, 543 bp, Homo sapiens
  misc_feature: GYAE6OF01DVWVV.10.2.A02.1.454.CMB.1.raw
  modified_base (338)..(338): a, c, t, g, unknown or other
  misc_feature (338)..(338): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctcccaggctcctcgtatatggtgcactccaccgagggcctagtggtatctcgaggctaggttccgnggctaggtgggtctgggacaggtcgttcactgtccacatcagcacgcctgacagtcgtagtaagtatttgacttagtttattacgtgttacgagtctagtaataatagtcgtcggcccgtcgtacggttccggaccgtaagggtaccgaggtagaacgttaacgaaacgtacgtcgaggctacgactactatcgtgtccgttacg

SEQ ID NO: 193259 - DNA, 642 bp, Homo sapiens
  misc_feature: GYAE6OF01AMW5T.10.2.A02.1.454.CMB.1.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccaccctctcctgcagggccagtcagagtgttggcagcaggttacgcctggtaccagcaaggaacgtggccaggcctcccgaggcctcctcgtatagtggtncactcccgaccgacgggccagtggtactcgtcgaggtcgtagggttcccggtggcgtaggttcggggtcgtaggggacaggtacgttccacgttcggtacccaccgtatccgacgtccgacgtccgtcgcgtaggtaccgtaggtaagttacgttttagtacgttaagttttacgtttacgttacgtcgtagtacgtaagttaattaatacgtccgtcggcccggtacggtccggtaaaaaccggccggtaacgggaccggtaacgggtacggtaacgttacgtaaaccggtaacgttcggtacggtacgtacgtaccgacctagttcgtcgttcttaccg

SEQ ID NO: 193260 - DNA, 792 bp, Homo sapiens
  misc_feature: GYAE6OF01EGXTT.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagcccaccctgtctgtcgtctccgaaggggaaacacgccctaccctctcctgcgacgggccagtcgagtacgtggtcgcgagcgtaggttacgcctaggtaccagaccgaaggaaacggtcggaccgaggcccgtaccgacggtcctaccgttacggttatacgtcggtcgacctacgtacccgacggtacgggaccctaagttcgggtactaccgtacggacggtcgtacgggttccgtagggacgtagggttcggtgtacgggactaggtacgttcacgttcgtacaccgtactacgcgtaccgtacgccgttcggacgttacggttctaagggtaacgtttaggtttttacgacgttttaacggttttttacgttaccgttagtaccgtaacggtagtttaaacggtttaaacttaaacgggttcggtacccggttcccggggaccccggtttaaaccgggtccgggtttaacccgggaaacccgggaacggggtaaccgggtttaaaggttaaacccggggtaacgtttaacccgggaaaaacggttccgggttgggttacccggaagtttcccgaacccgtttacccgtaaagttttcccgttgtttaccccccgtaacg

SEQ ID NO: 193261 - DNA, 639 bp, Homo sapiens
  misc_feature: GYAE6OF01BPA7A.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctttgtctccgagggaaagagccacgctctcctgcagggccagtcagagtctagcagcaactacgtgcctgaccaagacgaacctggaccaggcctacccggctcctcactctagtcgtacatctagcaggccagtgcacgtacccagactaggttcgaggtcggacgtaggtcgggtcgtagggaccagtaccgttacaaccgttctaccactagtacgacgactaacgacgtaggtagtcgtagtaacgtagtttcgacgtaggttgttaacgtttagtttcggtacgtacgtaagttaacgttaggtacggtccgttaaccggttcgggttaaccgttttcgggaccggtaacggggtaaccgtaacggtacggttaagggtaacgtaacggtaaccgaaacgggtaacgttacgggtacgtacgtacggtacctaacccgtacgttcgttcgtttaccg

SEQ ID NO: 193262 - DNA, 677 bp, Homo sapiens
  misc_feature: GYAE6OF01DZDRY.10.2.A02.1.454.CMB.1.raw
  modified_base (212)..(212): a, c, t, g, unknown or other
  misc_feature (212)..(212): n is a, c, g, or t
  modified_base (334)..(334): a, c, t, g, unknown or other
  misc_feature (334)..(334): n is a, c, g, or t
  modified_base (388)..(388): a, c, t, g, unknown or other
  misc_feature (388)..(388): n is a, c, g, or t
tcagcatagtagtgcacgaccggtgctcgatttagactcatctacgagggggaggaactgctcacttaggacccagacggaaccatggaacgccccagcgcagcttctcttcctcctgctactctggcctcccagactaccacgtgggagaagtagtgatgacgcagtctccagccctacctgtctgtcgtccgtaccggaaggggaaaccncgcccaccctctccgtgacgacgggccagtcgaggtgtggtgcaggcgtaggttcgcgtaggaccagacgaaggaacgtcggaccacggcctccgacggtccttccgtagtatggtcggtcnccaccgtccgaccggcggcctaggttgtactcgcggtacggtcgtacggttcgnggtcgtagggtcggtacgtacgggactacggtcgttacgacgttcgacccgtactcgtacgacggcctacgcgtagactgttagtaacggtatttagttcgtaactttaatttcgtagtcggaactagggtacttaagtactaacggtccggccgggttaaccggaccggttagggtaaccggtacggggtaaaccgacggggtaacggttacggtaaaggttaaccgtaacgggaaggttacgtcggttacgactaccggtaccacttaggttcttcggtccttaccg

SEQ ID NO: 193263 - DNA, 615 bp, Homo sapiens
  misc_feature: GYAE6OF01AFI70.10.2.A02.1.454.CMB.1.raw
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagcccaccctgtctgtgtctccgaaggggaaacacgcccaccctctcctgcgagggccagtcagagtgtggcagcaggttagcctggtaccagacgaaggaaaccgtggaccaggcctcccgaggtcctccgtcgtatagtggtcncacgtccacgcggaccacgtggtactctacgaggtcgtaggttccgnggctagggtcggtcgtagggacaggtacgtcgacgtcgtccacgtactcgagcgacgccgtagacgtagtcgtaggaaagttgtttacgacttaagtttacttacgtcgtacgtagtacgtaagttataaacgtcgccgttaccgggcccgtggtaccgggttaccggaaccggaacgggccggtagggtaagtaacgttaaccggaaacgtacgtggtacggctaggtaccctacgtattccgtcgttcctacg

SEQ ID NO: 193264 - DNA, 691 bp, Homo sapiens
  misc_feature: GYAE6OF01C7KIA.10.2.A02.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagactaccactggagaagtagtgatgacgcagtcctccagccacctgtctgtcgtctcgagggaaacncgccaccctctcctgcgacgggccagtcagtagtgttggcagcgtaggttcgctggaccagcaagaacgtggccaggcctaccgaggcttccgtgtaatgtggtcnctacgtcccgacgtacggcctacgtgtactcgtacgacggcgtacggttccgnggcgtaggtcgggtcgtagggactaggtacgttcgacgtcgtaccaacgactcgagccgacgtccgtagacgtagtacgtaagtaagttgttttacgattttaacgtttacgttacgtacgtctaagtacttaaggttaattaacgttacggtacccgtaccgggtacccgtacgggttaaccggttccgggaaccgggtaaccggggtacggtaacggggttaaacggaaaccgtttaaacccggaaaacgggttaccgttacgggtaccgggtacctttaacgggaaccccttaacggttaccgtttacgttaccggttccctttaacccg

SEQ ID NO: 193265 - DNA, 683 bp, Homo sapiens
  misc_feature: GYAE6OF01ATWUQ.10.2.A02.1.454.CMB.1.raw
  modified_base (196)..(196): a, c, t, g, unknown or other
  misc_feature (196)..(196): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaacngccacctctcctgcagggccagtcagagtgttggcagcgtaggttacgcctggtacccagcaggaaacgtggaccaggcctcccgaggcctccgtacggtatacgtgggtcgccactcccgaaccgacgggccctacgttggtacttccgtacgacgggtcctaggggtttcccggtgggaccgtaaggggttcggggttaccgtcgggggtactaagggtacgtttcccaacgtttcggtaccctaacccgtagtcccgaggcccaacggtccccttaggaccgttagttcgtaggtaaagtttacgttttcgactttaaggttttacttacgtgtacctagtacgtaagttaagtaagtcggtacgtcgggacccgtacggtaccggttacggaccgtaacggggtaccgtagggtacggtaaacttaccggaaacgtacggtggtacggtcctaggaccctacgtacttcttcggttccttacg

SEQ ID NO: 193266 - DNA, 634 bp, Homo sapiens
  misc_feature: GYAE6OF01E269G.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctccgaggggaaacagcccaccctctcctgcagggccagtcagagtgttggcagcgaggttagcctggtaccagcagaacgtggccaggcctccgaggctcctgtatagtggtgcatcccaccgacgggccagtggtatcgtcgaggctagggttccgtggcagggttcggggtcgtggggacaggtagtttccgacgttgtacccaaccgtatccgacgccacggtccctggcctagttccgtaggtaaagttatttttcggacttaaggttttacttacgttagtactagtacgtaagttaacttaagtacggtcgtaccgggcccgtacggtaccggttccgggaaccgtaacggggaccggtaagggtacggtaaacgttaccgaaaacggtaacgttgggtacggaccgtacggaccctaccgtacgttcgttggttccttaccg

SEQ ID NO: 193267 - DNA, 578 bp, Homo sapiens
  misc_feature: GYAE6OF01DOZHB.10.2.A02.1.454.CMB.1.raw
  modified_base (335)..(335): a, c, t, g, unknown or other
  misc_feature (335)..(335): n is a, c, g, or t
  modified_base (403)..(403): a, c, t, g, unknown or other
  misc_feature (403)..(403): n is a, c, g, or t
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccagccaccctgtctgtgtctccgaggggaaacagccaccctctcctgcagggccagtcagagtgttggcagcaggttagcctggtaccagcaagaaacgtggccaggctccaggcctcctgatatggtgcactccaccgagggccagtcggtatctcgaggcaggttccgnggctaggtgggtcgtgggacaggtagttcacgtgtacacctatcagccagcctgctagtcagtaagtnttttgacttagtttactagtgtacagacttaagtaattaagtagtcgtacggcccgtacgtacggttcggaacccgtaaagggggtacctaggggttaacggaaactttaccggaaaacggtacgttgggacggtactacgggtaccctaacgtacgttcttggttccttacccg

SEQ ID NO: 193268 - DNA, 605 bp, Homo sapiens
  misc_feature: GYAE6OF01CG44M.10.2.A02.1.454.CMB.1.raw
  modified_base (245)..(245): a, c, t, g, unknown or other
  misc_feature (245)..(245): n is a, c, g, or t
  modified_base (439)..(439): a, c, t, g, unknown or other
  misc_feature (439)..(439): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagatacccactggagaagtagtgatgacgcagtctccagccaccctgtctgtcgtctccgagggaaacagccaccctctcctgcagggccagtcagtagtgtgcagcaggttacncgtgaccagcgagaacgtgaccaggcctaccgaggtcctccgtcgtatagtggtgcactccgacgacggcctagtggtactcgtacgacggacgtacggttccgtggacgtagggtcggtcgtaggacgtaggtacgttcacgtcgtaccaccagtcgacgaccagtccgtagacgagttacgtagtaacgttntttcgactttagtttacgtacttcgtagtagtacgtaagttaataacgtaccgtcggttaccggcccgtacgttacggttaccggaccggtaacgggaccgtagggtagtaacgttaccgaaagtacgtggcggtacgcgtacctactgttacgtcgttcttaccg

SEQ ID NO: 193269 - DNA, 666 bp, Homo sapiens
  misc_feature: GYAE6OF01CD5Q2.10.2.A02.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
tcagcatagtagtgcacgaccggtgctcgatttagactcatctacgagggggaggaactgctcacttaggacccagacggaaccatggaacgccccagcgcagcttctcttcctcctgctactctggcctcccagatacccacgtggaagaagtagtgatggacgcagtcctccagcccacctgtctgtcgtcaccgaagggaaacncgacccaccctctccngccgaggccagtcgagtagtgtcgnagctaggttacgccgttaggaccagacgaacgaacgtcgccgaggcctaccgagcctacgtcgtatacgtggtcactacgtccgacggacggtcctagtgtactcgtacgacgtcgtacggttcgnggacgtaggtcggtcgtacgggactaggtacttcacgtcgtaccaacgtacgtacgacgtacgcgtaccgtagacgtagtacgtaggttaacgttgtttacgatttacgtttactacgtacgtactaagtacgtaagtaacgtaagtacggtccgtaccggccgttacggtaaccggttaccgggaaccggtaacggtacggtacggttaacgtaaaccgttaacggaaaacgttacggtacggtacgtaccggtacgtaccgtaacgtcgttaccgttacgtccctttacg

SEQ ID NO: 193270 - DNA, 558 bp, Homo sapiens
  misc_feature: GYAE6OF01CS68H.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacagggggaggaactgctcacttaggacccagacggaaccatggaagccccagcgcagcttctcttcctcctgctactcaggctcccagaaaccactggagaaatcgtgatgacgcagtctccagccaccctgtctgcgtctccagggcaaaacngcccaccctctcctgctgggccagtccgagtgtggcagccgcttagcctggtaccagacaaaaaccgtggaccagccctccaggcctcctcgtctagtggtgcatccacgaacggccacgtggtactcccgagccaggttcaggtggcgaggtgggtcgtgggacaggtagttcgctctacaccatcagcagtctgctagtctagtaagttattttgacttagtttattacgtgtacgaaggtaatagtgtagtggcgtcggtccttcgttacttacgtttcggaccgtaaacgggtacctaaggttacggactagtaacgaaacgtacgttggtagctagaccactatctgttcttacg

SEQ ID NO: 193271 - DNA, 671 bp, Homo sapiens
  misc_feature: GYAE6OF01C54J8.10.2.A02.1.454.CMB.1.raw
  modified_base (196)..(196): a, c, t, g, unknown or other
  misc_feature (196)..(196): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacngcccaccctctcctgcagggccagtcagagtgttggctagctaggttagccgtggtaccagacaaggaaaccgtggaccaggcctcccgaaggcctccgtacgtatacgtggtcacacgtcccaccgaggggcccaacgttgggtaacttccgtacgacgggtctaacgggtttcccggtagggcctagggttcggggtactaggggaacctaggtacgttccaacgttcgtaccgaaccacttcgaacgtccacgtccgtaggacctacggttctaggtaaacgttgttttagacttagttttatacgttagttacgagtactaagttaattaacgtacggtccgtacggtcccggtacgttacggttaccggaaccggtaacggggtacggagggttacggtaaacgttaccgaaacggtacgtcggtacggtactacggtaccctaacctagttccgtcgttcgttaacccg

SEQ ID NO: 193272 - DNA, 658 bp, Homo sapiens
  misc_feature: GYAE6OF01CZM4G.10.2.A02.1.454.CMB.1.raw
  modified_base (199)..(199): a, c, t, g, unknown or other
  misc_feature (199)..(199): n is a, c, g, or t
  modified_base (360)..(360): a, c, t, g, unknown or other
  misc_feature (360)..(360): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctccgaggggaaacngcccaccctctcctgcagggccagtcagagtgttggcagcaggttacgccgtggtaccagcaggaaacgtggccaggcctcccgaggcctccgtgtatagtggtcgctactcccaccgacgggccctacgtggtactcctacgaggtctacgggtttccgnggcgtagggtcgggtcgtagggacaggtacgttcgacgttgaccacctagtcagcacggtcctagcgtagtcgtaggtaagttgttttacgactttagttttacttacgtgtacagtacgtaagttaataacgtacgtccgttaccgggcccgtacggttacccggttccgggaacccggtaacggggtacccgtaaggggttacggtaaaccgtttaaccggaaaacggtacggttggttacgggacccttacggtacccgtaacccgttagttcccgtttcgttcccgtttaaccg

SEQ ID NO: 193273 - DNA, 557 bp, Homo sapiens
  misc_feature: GYAE6OF01A4M7Q.10.2.A02.1.454.CMB.1.raw
  modified_base (374)..(374): a, c, t, g, unknown or other
  misc_feature (374)..(374): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagcccaccctctcctgcagggccagtcagagtgttggcagcaggttagcctggtaccagcagaaacgtggccaggctccaggctcctcgtatagtggtgcatccaccgagggcccactcggtatcctcgaggtcaggttccgtggcaggtgggtctgggacagtgttcactgtcaccntcagcagcctgctagtctgaagtatttcgctagtttacttacgtgtactagctagttaagtaatagcgtacgggccccgtggtaccgttcgggaccaaggggtccgaagggttacgaaacgtttacaaacgggtacttcgggtacggtacttcggacctaccgatttccgtcgttcgttaccg

SEQ ID NO: 193274 - DNA, 784 bp, Homo sapiens
  misc_feature: GYAE6OF01BWWKZ.10.2.A02.1.454.CMB.1.raw
  modified_base (199)..(199): a, c, t, g, unknown or other
  misc_feature (199)..(199): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctccgaggggaaacncgcccaccctctcctgcagggccagtcaggagtgtggcagcgaggttacgccgtggtaccaggacgaaggaaaccggtcggccgacggccctacccgaggtcctccgtacgttagtagtgggtcgaccactacccgaaccgacggggaccctacgttgggtactcgtacggacgggtccgtacggggttccggtagggtcgtaggggttcggggtacgtaggggaacgtaggtacgttaccgacgttcggtacctaacctagtaccgtacggaccgtaccggtccgtacggactacggttaccggttaaggtaaacgtttacgtttttacggtaaccgttttaaggttttaacgtttaccgtaggttaccgtaagggtacttaaaggtttaattaacgtacgggttccggttaccgggaccccgggttaacggtaaccgggtttacccggggaacccgggtaaacgggggtacccgggtaagggttaaccgggtaaaccgttaaccgggtaaaccggtaacggttcgggtaccggtaccgtacggtaccctaacccgttagtttccgttcggtttacccttaccg

SEQ ID NO: 193275 - DNA, 854 bp, Homo sapiens
  misc_feature: GYAE6OF01D7TP6.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccggccaccctgtctgtgtctccgaggggaaancgtccaccctctcctgcacgggccagtcagtactattacgtacaaacttggcctaggtaccagacaactaaccgtggaccaggcctaccgaggtcctcctacactccgtagtcggtcgacctacgttccccgtaccggacgggaccctaacgttaacttaccgtaccccgtaacgtacccgttaacgggttcaacgggttcggggtaccggtaacggggggtttcgggggggttacccgggggttaacgtaacggggtttaaccggtttaccgtacccgtttaacccgtaaccccgaaaccccgtaacggttacccggaaacggtacccgtaaccgggtcccgttacggacccgttaacgttacggttaaggttaaacggtttacgttttacggtacgtttaacggttttaactttaccggttacgtaccgtaacggtacgttaacggttaacgttacggtaaccgttacccggttcccgggttacccccgtttaaccggtttacccggtttaacccgggttttaccggggacccggggtaaccgtaacggttacggtaaacgtaaacgtaccgtaaacggtaccggttaacgttcggtacggtacgtaccgtaccgtaaccgttaccgttacgttccgttccttaccgttaccccg

SEQ ID NO: 193276 - DNA, 825 bp, Homo sapiens
  misc_feature: GYAE6OF01DUFPC.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacncgcccaccctctcctgccgagggccagtcagtagtggttggctagcgtaggttacgccgtaggtaccgagcgaacggaaacgtcggaccacggcctcccgagtcctcctcgtatagtggtcgcactcccgacgacgggcctacgttggtatccgtacgacggccgtacggttccggtcggcggtaggttcggggtcgtgggacgaggtacgttccgacttcggtccaaccgtactcgacgtccgacgcccgtgacgtcggttacgtaaggttaagttacgttttacggacgttttaaggtttttaactttaccggtttacgttaccgtaacgggtaccgttaaacgggtttaaactttaaagggttacccggtaccgggttacccggggtaccccccgggtttaccgggggtttaacccccggggtttacccgggggtaaaccccggggtaaaaaccgggggggttaacccccggggttaaaggggtttaacccgggttaaaaccgggtttaaaacccgggaaaaaacccgggttacggtttaacggggtaccgggttcccgttaacccggtaccccgggtaaccccttacggtttaaccccggttccgttttaacccgttacccgg

SEQ ID NO: 193277 - DNA, 857 bp, Homo sapiens
  misc_feature: GYAE6OF01BH3IC.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggcctccagtattccacgtggaagtaaattagttttgacgcaactctccacgccacctgtctgtcgactcgaggtgagagacgcctacctctctgcgacggccagtcgagggactcgagacagtactaagtttaccgacctacggtaaccaacgacggaacgccgttacggaccgttacggggttacccaacggtacccttacctactaacgttaagtaacgtacggtaaaccttcccttaccggttacccggaacgggtcccctaaggttccgggaaccgttacccgaacggtcccggttaggttaccgacggggtccgggttcgggtacggggtacgtacggggaacctacggtacctttccggaccttcctacccgtaaccgtactccgaacggaccgtaccgtccgtacgtacgtacgttaccggtacgggttaacgggttacccgtttagggttaaacgttttacggttacgttacggtaccggtaacgtacgttaaacgttacttaaccgtaaccgttaccggtaccggttaccccggtaccgggttaccggttaacccgggtttaaccgggaacccggtaacggggtaacccgtaaccggggtaccggtaaaaccccgttaacggtaaaacccgggtacggttaccgggtacggttaccgtaccgggtaaacccttaccgttaccgtccggtttaccgtttacccgttacccgttccgttacccccg

SEQ ID NO: 193278 - DNA, 804 bp, Homo sapiens
  misc_feature: GYAE6OF01BLU3E.10.2.A02.1.454.CMB.1.raw
  modified_base (196)..(196): a, c, t, g, unknown or other
  misc_feature (196)..(196): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaacngccaccctctcctgcgacgggccagtcagagtgttggcagcgtagggttacgccgtggtaccagacgaacggaaacggtggaccagggcctacccgacggtcctccgtcggtatagtcggtgaccactcccgaaccgacgggccctagttcggtactcgtcgacggtcgtacggggttccgtgggacgtacgggttcgggtacgttaggggaactagggttaccgtttccgaccgtttcggtaaccaaccccgtagtaccgacggtccgtaacggtccctacggtaccgtaacggttaccgttacggtaaacggtttacgtttttacggaccgttttacggttttaacgtttacgttacgttaccgaacggttaccgttaagttaaagttaacgttaccgggtaccggttcccgggtaacccggtaccgggttaaccgggtttccccggggaaccgggtaaaccgggggtaccggttaacgggggtaacgggttaaaaccggttaacccggtaaaaccgggtaacggtttcggggtacccggtaccggtacccgggttaaccctaacccgggttacgtttaccccggttggttttaacccgttacccg

SEQ ID NO: 193279 - DNA, 771 bp, Homo sapiens
  misc_feature: GYAE6OF01DSJQL.10.2.A02.1.454.CMB.1.raw
tcagcatagtagtgcacgaccggtgctcgatttagactcatctacagggggaggaactgctcacttaggacccagacggaaccatggaacgccccagcgcagcttctcttcctcctgcctactctggcctcccagatacccacgtggaagaagtagtgatgaccgcacgtcctccacgccctaccctgtctgtcgtccgtaccggaagggaaccacgccctacccttcctccgtcgacggacggcctagtacgagtgttggtcggacaggctaggtacgccgtacggaccgagtaccgaaggtaacggtcgaccgtcggtacctcccgacggtccttaccgtagtaagtgtcggtcacctaccgacccgtacggaccgtacctagttcgactccgcggacggtccgtcggtccggtggtacgtgggtcggtacgaggacgtagtccgtacgtacgttccgacctaacgcgtaccgacgtcgtaccggtcgtacgtaccgtagttaaccgttaggttaacgtttacgtttacgttaacggttttacgttaaaccgttcgttaacgtacgttaaggtaaccgttaaaggttaaccgttaacggtcgggtaccccggtacccgggttacccgggtaccgggttaacccgggtaccgggaacccgggtaaagggtaccggtaggggttaaaccgtaacggttaaacccggaacggttcggtaccggtacgtacgtaccgtaccctaacgttctaccggttcttccttaaccccgg

SEQ ID NO: 193280 - DNA, 751 bp, Homo sapiens
  misc_feature: GYAE6OF01BASQ0.10.2.A02.1.454.CMB.1.raw
  modified_base (198)..(198): a, c, t, g, unknown or other
  misc_feature (198)..(198): n is a, c, g, or t
  modified_base (450)..(450): a, c, t, g, unknown or other
  misc_feature (450)..(450): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctccgagggaaacncgcccaccctctcctgcgacggccagtcagtagtgttcggcagcgtaggttacgccgttacggtaaccaggtaccgaacggaaaccggttcgggacccgacggggtcccttaccccggaagggtccccttacccgttacggttaagttacgtcgggttacgacctaaccgttaccccgaacccggtacggggtacccctaacgttcgggttaacttcccgtacggaacgggtccgtacggggttttcccggnggtaccgtagggttcggggtacgtagggacctaggtacgttccacgtcgtccaacctagtccgagccacgtcctgacgtacgtacgtaggtaagtttcgtttcgactttagtttaactacgtcgttacgagtaccttaagttaacgtaagtcggtaccgtcggtaccccggtaggttacccgggttaccgggaacccggtaacggggaccggttagggtaaccggttaacgtaacccgtaaacgggtcgttcggacggtccctacggaacccaccgttacttccgttcgttcctttacccg

SEQ ID NO: 193281 - DNA, 770 bp, Homo sapiens
  misc_feature: GYAE6OF01BA7MN.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgtggcagcaggttagcctggtaccagcgagaacgtggaccaggctccgaggcctccgtcgtatagtggtgcactcccaccgacgggccacgtcgggtatcctacgacgggtccgtacggggtttcccggtggggtccgtacgggttcgggggtacgtggggaacgaaggtacgtttccgaacgtttcggaccctaccctaacgttccgaacggtccgaacggtcccgtaggccgtaaggttccgtaagggtaaacgtttacgtttttcgacgtttaaaggttttatttaaccgttggttaccgtaaggtaccgttaaggtttaacgttaacggttaaccggtccgttacccggggtaccccgggtacgggttaaccccgggttccggggtaaacccgggtaaacgggggtaccccgggttaaggggttaaccgggttaaacgtttaacccggaaaaccggttaacgggttcgggttaacgggtccgttaccgggtaacccgtaacccgttacgttacccgttaggtttcccgtttaacccgg

SEQ ID NO: 193282 - DNA, 629 bp, Homo sapiens
  misc_feature: GYAE6OF01B2GYB.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacagccaccctctcctgcgagggccagtcagagtgttggcagcgaggttagcctggtaccagcgagaaacgtggccaggcctaccgaggcctccgtcgtatatggtgcactccacgagggcccaagtcggtaatcgtcgaggtactacggttccgtgggctaagggttgggtccgtggggaacctaggtacgtttccaacgttcgtaccaaccgtataccgagacgacgccgttgacgacgttacgtagaaagtttagttttacgtacgttaaggttttacttaaccgttgtaccgtagaccttaagttaataagttacgccgttacgggcccgtacgtacgttccggaaccggaagggaccgtagggtagtaaccgttacgaaacggtacgttcgtcggtacgtacgacctactaagttcttcggttcttaccg

SEQ ID NO: 193283 - DNA, 723 bp, Homo sapiens
  misc_feature: GYAE6OF01DG10R.10.2.A02.1.454.CMB.1.raw
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
tcagcatagtagtgcacgaccggtgctcgatttagactcatctacgagggggaggaactgctcacttaggacccagacggaaccatggaacgccccagcgcagcttctcttcctcctgctactctggcctccagataccactggagaagttagtgatgacgcagtcctccacgcccacctgtctgtacgtctccgaaggggaacncgtcccaccctctccgtcgcgacggccagtcgagtagtgtggacgaggtcgtaggtcgtaccgtcggtaaccgaggtacgaacggtaacggcggtaccgacgtccaccgcggaccttcgtacgtataggtcgctacnccgtaccgacggcggtactaggtcgtactcgacgacgtcggtacggttcgnggtacgtagggtcgtcggaggtcgtacgtacgtcgactacgtacacgtaccgtcgacgtccgacgtcgtacgtacgtacgttacgtagttacgttagttacgtcgtttaatttaacgtcgttagtacgaagttacttaaggttaacgtacgtccggttacgggacccggtaccgggtaccggtttaaccgggacccgggtaacggtacccggggtaaaggttaccggtaaaacgggtaccgtaaacgggtaaacccggtagttccggggtaccgtacccgttacgtaaccgttacgttccgtttacggttaacccctttgttaacccccg

SEQ ID NO: 193284 - DNA, 747 bp, Homo sapiens
  misc_feature: GYAE6OF01CINRH.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccacgcccacctgtctgtgtctccgaagggaacncgcccacctctccgtgcgacgggccagtcgagtagtggtggcagtcgtaggttacgccgtacggtaccagaccgaaggtaacggtcggaccgacggtcctacccgacggtcctaccgtacgtagtacgtggtcacctacgtacccaaccggtacgggaccctaggttcgtactccgtacgacggtcgtacgggttccgtaggcgtagggttcgggtcgtagggactaggtcttcgtacgtcgtacctactacgtacgacgccgacgtcccgtagtaccgtagtacgtaaggtaagtttcgtttacgaacgttttaatttacgttacgtacgtaaccgagttaacgtaaattacgttaaacgtccggtaccggtccgggtacccggttacggttacccgggttacccgggaacggtaaccgggggtacggtaaacgggttaacggtaaaacccgtttaacgggaaaaccggttcgggttcgggtaacccggtacgttacccgtaaacccgtaaccctttggtttaccgtttaccgtccgtttaaccccgg

SEQ ID NO: 193285 - DNA, 750 bp, Homo sapiens
  misc_feature: GYAE6OF01ETVCZ.10.2.A02.1.454.CMB.1.raw
  modified_base (516)..(516): a, c, t, g, unknown or other
  misc_feature (516)..(516): n is a, c, g, or t
tcagcatagtagtgcacgaccggtgctcgatttagactcatctacaggggggaggaactgctcacttaggacccagacggaaccatggaagccccagcgcagcttctcttcctcctgctactctggctcccagataccactggagaagtagtgatgacgcagtctccagccaccctgtctgtgtctcgaggggaacacgccaccctctcctgcgacgggccagtcaggagtggttcggcgagcgtaggttacgccgtaggtaccgagtacgaacggaaaccggtcgggacccgaacggcctacccgacggtccttcccgttacggttaactaggtcgggtgaccacgttacccgacccggacggggtaccctaccgttcgggttactccgtacggacgggtaccgtacgggttcccggtgggacgtagggttcggggtcgtacgggaacgtaggtacgttacgacgtcgctaccacgtcgagcctacggctaggcttagtcgtaaggtaacgtttntttacggtactttaagttttacgttaacgtcggtaacgtacgtataaggttaattaaacgtcggtaccgttacgggccccgtagggttaccgggttaccgggaaccgggtaaacggggtacccgggtaagggttaaccggtaaacgttaaacccgggaaacgttaccgggttagggtccgtaacggttcggtaaccccgactttaacggtttccggttgttacccgtttacccg

SEQ ID NO: 193286 - DNA, 855 bp, Homo sapiens
  misc_feature: GYAE6OF01EYANO.10.2.A02.1.454.CMB.1.raw
  modified_base (199)..(199): a, c, t, g, unknown or other
  misc_feature (199)..(199): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctccgaggggaaacngcccaccctctcctgcagggccagtcagagtgttggcagcaggttacgccgtggtaccagacaaggaaacgtggccaggcctcccgaggcctccgtcgtatagtgggtgaccacgtccccgaaccggtagggccctacgttggtacttccgtacgagggtccgtacggggtttccggtagggcgtaacggggttcggggttccgtagggggtaacctagggttagtttacccgacggtttccggtacccaacccgtagttaccgaggacccgtacggacccgttgggacccgtaggttaccgtaagggtaagtttacggtttttaggaccgtttaaacgtttttacgtttaccgttggttacgtaaccggtaccgttaaaggtttaactttaaacggttaccggtaccgggttacccggggtacccccgggttaacgggttaaccccggggtttacccgggggtaaaccccgggaaaacggggggttaccccgggggttaaagggttaaccggggtttaaaaaccgtttaaacccgggaaaaaccccggggttaacgtttcggggggttaaccggttacccgttaacccgggtaaccccccgtaacgttaacccgggtttccggtttacccgggtttaaccccgttttacccccgg

SEQ ID NO: 193287 - DNA, 680 bp, Homo sapiens
  misc_feature: GYAE6OF01DBF88.10.2.A02.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
tcagcatagtagtgcacgaccggtgctcgatttagactcatctacgaggggggaggaactgctcacttaggacccagacggaccatggaagccccagcgcagcttctcttcctcctgctactctggctcccagataccactggagaagtagtgatgacgcagtcnccagcccacctgtctgtgtctccgagggaaacncgccaccctctctgcaggtccagtcagagtgtgcagcgaggttagctaggaccagcaaggaacgnggccaggcctccgaggctccgtacgtatatgggtcncactccacgagggcctagtggtactcacggagtcgtagggttccgtggactagggtcgggtacgtaggggacctaggttcgttacgtaaccgtggtacccaacgtntccggacgtacccgaggtcccgtggaccttaggtaccgtaggtaaacggttnttttcgggactttaaggttttactacgtttgtaacgtaggtacgtaaaggttacttaaggtacgggtaccgttccgggggaccccttacgggttaccgggttaccgggtaaccgggaacggggtacccggtaggggttaaacggtaacgtttaacccgaaaacgggtttcgttcgggacgggtcctacggacctaacccgttgtccggtttcgtccttaccgg

SEQ ID NO: 193288 - DNA, 853 bp, Homo sapiens
  misc_feature: GYAE6OF01DL51D.10.2.A02.1.454.CMB.1.raw
  modified_base (186)..(186): a, c, t, g, unknown or other
  misc_feature (186)..(186): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtcnccgaggggaacacgcccaccctctcctgcgacgggccagtcagagtggtggcagcgaggttacgccgtaggtaccagcgagaaacgtggaccaggcctccccagactccctacgtactccttcgtgggtcgtactacgtccgtttacgggacgggtccctaacgttcgggtccgtaccccacggtccgtacgggttacgagggttcgggacgtacggttgggggtaccttagggaacgtagggtaacgtttccgtaaccgttcctaccgaacccgtacgttaccgaacgggcccgggtaccttcggaacccgttaggttccgtaaggttaaacgtttagttttttcggtacctttaaaggttttttaacgttaccgtttacggtttaccgtacggttaccttaaaggtttaacgttaaacggtttacggggtttaaccggttttttagggggtttttttaacctttaacccggtttacccgttttttacccgggggtaaccccggttttaaccggggtaaaacccgggtttaaagggtttaacggggtttacctttttaaaccgggaaacgggttaaacgggtttaaaccgtttacgggggtacccgtttaccgggttccgggtaaccttaaccccggttaactttccggttttccgttttaccccg

SEQ ID NO: 193289 - DNA, 851 bp, Homo sapiens
  misc_feature: GYAE6OF01DDQAT.10.2.A02.1.454.CMB.1.raw
  modified_base (133)..(133): a, c, t, g, unknown or other
  misc_feature (133)..(133): n is a, c, g, or t
  modified_base (203)..(203): a, c, t, g, unknown or other
  misc_feature (203)..(203): n is a, c, g, or t
tcagcatagtagtgcacgaccggtgctcgatttagactcatctacgagggggaggaactgctcacttaggacccagacggaaccatggaacgccccagcgcagcttctcttcctcctgctactctgcctccanataccatggagaagtagtgatgacgcagtctccacgcccacctgtctgtcgtcgtaccggaagggaaccncgccctaccctctccgcgcgacggcctagtcgagtagtgtggcagcgtaggtcgccgtacggtaccaggacgaaggaacggtcggaccgacggtcccgtacccgacggtccttccgttacgttaagttacggttcggtaccgtcctaacccgtacccgaacccggtaccgggacccgttaacggttacgttacgtccgtaccggtaacgggtccggttaccggggttccggtacggtacgggttaggggtccgggttacggtacgggtaaccgtaggttaccggtaccgttacgttaccgtaacccgtaaccgtaacgtccgaaccggtaccgaccgttcccggttaacggaccgtttaacgggtttagtaaacgtttaaacggtttacggttttacgttaatttttaacggttttaccgttacgttcggtaaacgtacgttaacgttaagttaaacggttaaccttcgggtaccccgggtcccgggtacccggttaacgggtttacccggggacccggtaaccggggtaaaaccggggtggttaaaaccgggttagttaaaaccggttaaccggaaacggtttcggtacggacccggtacgtacccgtaaaccgtaccgttactttccgttacgtttcccgttaccg

SEQ ID NO: 193290 - DNA, 607 bp, Homo sapiens
  misc_feature: GYAE6OF01A6HXU.10.2.A02.1.454.CMB.1.raw
  modified_base (340)..(340): a, c, t, g, unknown or other
  misc_feature (340)..(340): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacaggccacctctcctgcagggccagtcagagtgttggcagcaggttagcctggtaccagtcagaacgtggccaggctccaggctctcgtatagtggtgcatccacgagggccagtgggtactcgtacagggctagggtttccgnggctaggtgggtactggggacaggagttccacgttgtcactatcagcagcctgcagtctagaagtattttgactagtttactagttggtcaggctaagtataatgcgttacgggcccgtcggtaaccggtttccgggaccggtaacgggggtaccgtaaggggttaacgggttaaaccgtttaccggaaaaaccggttacgttcgggttacgggaccctttagggacccgtaacccgttaagttacccgttgggttcccgtttaccg

SEQ ID NO: 193291 - DNA, 715 bp, Homo sapiens
  misc_feature: GYAE6OF01EQJLB.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccacgcccaccctgtctgtgtctccgagggaacncgcccaccctctcctgcgacggccagtcagagtgtgcagcgtaggtacgcctaggtaccagacgaacggaaacgtcggaccgacggcctacccgacggtccttcccgtcgtaactaggtgggtcgacctacgtcccgaccggacgggacctacgttacgtactcgtcgacggtccgtacgggttccggtcggcgtacgggtcgggtacgtcgggactaggtacgttccgacgttcgtaccaccgtatccgagccgacgtccgtggacgtaggttacgtaaggtaagtttacgttttcgagttttattttacgtttacgtcgttacacggtacttaaagttacttacgttacggtccggttaccggaccccggtacggttaacccgggttaccgggaacccggtaacgggggtaacccgtaggggttaacgtaaaccgttaaccggaaaacgggttccggttgggaccggtacgttacccggaccgttaccgtagtttccgttaccgttccgttacccg

SEQ ID NO: 193292 - DNA, 770 bp, Homo sapiens
  misc_feature: GYAE6OF01CZC4G.10.2.A02.1.454.CMB.1.raw
  modified_base (212)..(212): a, c, t, g, unknown or other
  misc_feature (212)..(212): n is a, c, g, or t
  modified_base (411)..(411): a, c, t, g, unknown or other
  misc_feature (411)..(411): n is a, c, g, or t
tcagcatagtagtgcacgaccggtgctcgatttagactcatctacaggggggaggaactgctcacttaggacccagacggaaccatggaagcccccagcgcagcttctcttcctcctgcctactctcggctcccagataccactggagaagtagtgatgacgcagtctccacgccctaccctgtcgtgtcgtccgtccgaaggggaaaaccncgccccaccctcctctcggcgacggggtccaggtacgagtaggttgttcgacaggacgtaggttacgccgttaggtaccagacgaaggaaccgtcggccaaggtcctcccggacggtcctaccgtacgtatacgtggtcacaccgtacccgaaccggtacggccctagtcggtactcgtacgcggtacgtcggttcggnggcgtgggtcggtgtacggacgtggttactctagtccgtactaaccgtcgacgtaccgtaccgacgtcccgtacgtcgtaccggttacgtaaggtttaagttaacgttttcggttaccgttttaagttttaccgtttaacggttacgtaacggtaccgttaagttaacggtttaaagttaaccgttaccgggtacccggtaccgggttcccggtaacggttacccggggtacccgggtaaacccggaaccgggggtaccgttaaacggggttacgtaaaaccgttaacggaaaaccgtttcgggtacggttaccggtacgcgttacccgtaaccgtcgtttacgtcctttccgtaaccg

SEQ ID NO: 193293 - DNA, 783 bp, Homo sapiens
  misc_feature: GYAE6OF01A2A08.10.2.A02.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (507)..(507): a, c, t, g, unknown or other
  misc_feature (507)..(507): n is a, c, g, or t
tcagcatagtagtgcacgaccggtgctcgatttagactcatctacaggggggaggaactgctcacttaggacccagacgaacatggaacgcccagcgcagcttctccttcctcctcgctactctggcctccagactaccactggagaagtagtgatggacgcagtcctccacgcccacctgtctgtcgtctaccgacgggaacncgccaccctctccgngcgacggccagtcgagagtcggttggcgaggtacgtaggtacgccgtcggtacagacgaagaacgtcggaccgacggccgtaccgacggtccgtaccgtacgtaagtacgttcggtacgacaccgtcccgaaccggtaccgggtacctacggttacggttactaccggtacgtacggtacgggtaccgggttcgggcggttaccgggtaggggttccgggtacggtacgggaacgtacgtacggttactacggtcgtaccacgtacgtacgagtaccgtacggtaccncggtcgtaagtcggtaaaggttacggtttacttcgggtactttaaggttaacttcggtacgtcgtaacgtagttaacgggttaacttacggttacgccgggttacccgggaccgggttacggtaaccccgggtaccgggtaacggtaaaccgggggtccggtaaaggtttaaacccggggaaaccgtttaacggaaaccgggttacgggttaacgtacggggtacccgtacgttaaccccggagtttaccgttacgggttaccgttcgttaacccg

SEQ ID NO: 193294 - DNA, 702 bp, Homo sapiens
  misc_feature: GYAE6OF01AOKEK.10.2.A02.1.454.CMB.1.raw
  modified_base (195)..(195): a, c, t, g, unknown or other
  misc_feature (195)..(195): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccaggggaacngcccacctctcctgcgagggccagtcagagtgttggcagcgaggttagccgtaggtaccagcagaacgtggccaggcctacccgaggtcctacctcgtatagtggtcgacacgtcccgaccgacgggccctaacgtggtactctcgacggctacggggttcgtgggctagggttcggggtactaggggaacctaggtacgtttaccacgttcggaccaccgtactcgaacgcgacgtccgtagtacctaggttacgtaagtaacgtttagtttacgtacgtttaacgttttacgtacgttcgtacgtaacgtacgtaagttaacttaacgttacggtacccggtaccgggtaccccggtaccgggttaacccgggttcgggaaacccggtaacggggtacccgggtaagggtaccggtaaaccgtttaccggaaacgggttacgtcgggttacgggtacctacggtacccgaaccgttacgttacccttagggttccctttaacccg

SEQ ID NO: 193295 - DNA, 770 bp, Homo sapiens
  misc_feature: GYAE6OF01CTOSK.10.2.A02.1.454.CMB.1.raw
  modified_base (214)..(214): a, c, t, g, unknown or other
  misc_feature (214)..(214): n is a, c, g, or t
  modified_base (273)..(273): a, c, t, g, unknown or other
  misc_feature (273)..(273): n is a, c, g, or t
tcagcatagtagtgcacgaccggtgctcgatttagactcatctacgagggggagaactgctcacttaggacccagacggaaccatggaacgcccagcgcagcttctcttcctcctgctactctggcctccagactaccacgtggaagtaagtagtgatcggacgctagtcctccacgccctaccgtgtctgtcgtaccgtacggaagggaaccncgcccacccgtctaccgcgcgacgggccagtcaggtaggtggtacgcagcgtaggtacnccgtacgacgagacgaacggaacgtcggaccacggtccgtaccgacggtccctacgttcgtagtacgtcgtcgactaaccgtaccgacggtcggtccgtaacgttacgggtaccttaccggacggtacggttaccggttacggggttccggtacggggaccggttagggggttcgggttaaccggtaacggggaacttacggtttaacccggttcgacgtttccgaaaccgtacgacggttaccgacgtaccgtacgtcccgtacgtaccgtaagttacgaagggttaacgtttacgtttacggtacttttaaggtttacttcgtacgttaacgtgtaaccgttaagttacctacggtaccgtcgtaccggaccggttacgttaccgggtacgggaaccgggtaagggtaccggtaggttaacggtaaacgtaccgggtaactacggtacggttcgaacgtaccgtacgtaactacgttccgttcgtacgtttaccg

SEQ ID NO: 193296 - DNA, 740 bp, Homo sapiens
  misc_feature: GYAE6OF01CESD8.10.2.A02.1.454.CMB.1.raw
  modified_base (149)..(149): a, c, t, g, unknown or other
  misc_feature (149)..(149): n is a, c, g, or t
  modified_base (224)..(224): a, c, t, g, unknown or other
  misc_feature (224)..(224): n is a, c, g, or t
  modified_base (722)..(722): a, c, t, g, unknown or other
  misc_feature (722)..(722): n is a, c, g, or t
tcagcatagtagtgcacgaccggtgctcgatttagactcatctacgagggggagaactgctcacttaggacccagacggaaccatggaacgccccagcgcagcttctcttcctcctgctactctggcctcccagactaccacgtggaanaagtagtgaatgacgctagtcctccacgccctacctgtctgtcgtctccggaagggaaaccccgcctcctctcgngacgacggctagtcgaggtgttcgtcggacaggtacgtacggtccgcgttacggaacaggacgtaaacgacggtcgaccgtaccgtccgtaccgtcgtccttacgtacgtagtcggtcggaccacctaccgtaccgaccggtacggtcctacggttacgtacctcggtccggacgggttaccggttcgggttccggaggtacgggtagggtccgggttacgacgggtaacgttggttaccgttaccgtcgttaccgtacaaccgttacgacgacgtccgtacgtcgtacgacgttacgtagtagttacgtttagttacgttaagtttaacgtttacgtcgtacgtaacgtacgtaacttaagttacgtaacggtccggttaccgggtaccggtaccgttaccgggttaccggtaccgggaacgggttacgggtacggtaaacggttacgtaaccgtaaggtacgttacgggcgttaccgcgtaccgtacgttacgttntttccgtccttacgtacc

SEQ ID NO: 193297 - DNA, 670 bp, Homo sapiens
  misc_feature: GYAE6OF01EECHC.10.2.A02.1.454.CMB.1.raw
  modified_base (204)..(204): a, c, t, g, unknown or other
  misc_feature (204)..(204): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
  modified_base (642)..(642): a, c, t, g, unknown or other
  misc_feature (642)..(642): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctccagataccacgtggagaagtagtgatgacgcagtctccacgcccaccctgtctgtgtcctaccgaaggggaaccncgcccaccctcgtcctcgcgacgggccagtcaggagttggttcggcacgcgtaggttacgccgttacggaccagacgaacggaaacggtcggacccgacggtcctaccgacggtccttccgtacgttagtagtcggtcncacnccgaaccgcggcctagtcgtacttccgtacgaggtaccgtacgggttcgnggtacgtacgggtcggttacggacgggaacgtaggtaccgttacacggttacgtaccaccgttagtaccgagaccgtacgtccgtacgggtacttaacgttcgtaaggttaacggttttagtttcgtacgtttaattttacttacgtgtacctagtcgtaagtactaagtcggccgtacggcccgtacggtccggtacggaacgtacgggacgtggaacgtacgtaacggaagtgtcggcgtacncgtaccgtctacgtcttacgtcctaccg

SEQ ID NO: 193298 - DNA, 791 bp, Homo sapiens
  misc_feature: GYAE6OF01DD0S0.10.2.A02.1.454.CMB.1.raw
  modified_base (216)..(216): a, c, t, g, unknown or other
  misc_feature (216)..(216): n is a, c, g, or t
tcagcatagtagtgcacgaccggtgctcgatttagactcatctacgagggggaggaactgctcacttaggaccagacggaaccatggaagcccagcgcagcttctcttcctcctgctactctggctcccagactaccactggagaagtagtgaagcgacgcgtactccacgaccaccctccgtgtcgtcgtcgtaccgaacggggaaaacggaacnccacccctacctccgtcggacgaccgggaccgtacgtacgacgtaaggttcggttggtacggacgtacggacgggttacggtaccgtcggtaaccggaacgacgaaacggtaaacggtaccggaccggacggaccgtacccgtacggccgttccttaccggtaattaaggtcggtacggtaccacgtaacccgaccggacggggtaccgtaccgttacggttacgtactcgacggtcggtaccggtttacggtcggtagcgggttaggggttcggtacgggaacgatacggttacgtacgtacgtacgtaaccgacttacgacgtacgaccgtcgtacgtacgacggttacgtagtaaagttaggttttactacggttattttaacgttccgttagtacgaacgtacgtaacttaagtaaacgtaggttccggtccgggtacccggtcggtaccggtaccggggtacgaaaccggggtacgggaacggtaggtaccgttaaacgtaaaacgggtaacgtcgggttcgggtacgtaccgtacaaccgttacgttagttcccgtatttcccgtaacg

SEQ ID NO: 193299 - DNA, 755 bp, Homo sapiens
  misc_feature: GYAE6OF01APZ8Y.10.2.A02.1.454.CMB.1.raw
  modified_base (208)..(208): a, c, t, g, unknown or other
  misc_feature (208)..(208): n is a, c, g, or t
  modified_base (570)..(570): a, c, t, g, unknown or other
  misc_feature (570)..(570): n is a, c, g, or t
  modified_base (702)..(702): a, c, t, g, unknown or other
  misc_feature (702)..(702): n is a, c, g, or t
tcagcatagtagtgcacgaccggtgctcgatttagactcatctacagggggaggaactgctcacttaggacccagacggaacatggaacgcccagcgcagcttctcttccgtcctgctactctggcctccgagactaccacgtggagaagtagtgatgacgcagtcctcacgcctacccgtgtcgtgtacgtcctccggaagggaacncgtcccaccgtctccgtgcgacggccagtcaggtacgtggtcggccaggtctaaggttccgccgttaacggtacccgaaggtacgaacggtaaacggtcggaccggtacggtccgtacccgcggtccgtaccgtcggttaagtcggtaccggctaccgtaccgtacccgaccggtcggtactacgtgttaactcgtacggacgtacggttcggtcgtgaccggtcgggtgtaccggtaggtctacggtacggtttcacgtacgtaccacgtcgacacgcgtacggtcgacggtccgtggttaacgttacgtaacgtttcggttttacgactttacgttttacgacgttacgtacggtagttnttaaaccgttagtccgtaggtttacccgacccggttccgggtacttaccccgggtagggtaaacccgggtaacggtccgggtaaattaccggttaaccggttaaccgaacggttacggtcggtttaacccgngtaaccccggtaactaaccgttccgtttacccggtatttcccgggttaccccc

SEQ ID NO: 193300 - DNA, 740 bp, Homo sapiens
  misc_feature: GYAE6OF01DFRC3.10.2.A02.1.454.CMB.1.raw
  modified_base (140)..(140): a, c, t, g, unknown or other
  misc_feature (140)..(140): n is a, c, g, or t
  modified_base (197)..(197): a, c, t, g, unknown or other
  misc_feature (197)..(197): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagactaccnctggagaagtagtgatgacgcagtctcagccacctgtctgtgtctccgagggaaacngcccaccctctcctgccgacgggcctagtcagtaggtgttcgggcaggcgtaggttcgccgtcggtaccagccgaacggaaacggtcggaccgacggtcctacccgaggccgttccgtacggttaagttacgttgggtctaccgacttacccgaccggtacgggaccctacgttcggtaactccgtacggacgggtctacggggtttccgtggcgtagggtcgggtcgtgggacgtaggtacgtcgtacgacggttacacctagtccgaacgtcgaacgtcccgtggaccgtagttacgtaggttaaagttgttttacgtaccgtttaagttttacttaccgttaggtactaacggtcttaaaggttaacgtaacgttaccgggcccgtttacggggcccccgttacgggttaacccggttccgggaacccggtaaaccggggtacggtaacgggttaacggtaaacgttaaccggaaaccggttacgttacgggacggtacttaccggacctaaaccgttgtcccgtttgttcccgttaccc

SEQ ID NO: 193301 - DNA, 981 bp, Homo sapiens
  misc_feature: GYAE6OF01APH9U.10.2.A02.1.454.CMB.1.raw
tcagcatagtagtgcacgaccggtgctcgatttagactcatctacgagggggaggaactgctcacgttaggacccagacggaaccagtggaacgccccagcgcagcttctcttcctcctgctactcgtcggcctcccagactaccacgtaggagtaagtgtagatcggacgcacgtcctcgacgccctaccgtgtctggtcgttcgaccggaacgggaacaccgcctaccctcctccgtgcgacggacctaggtcgaggtaggttcggtacggacgtacggacggttacgggtaaccgtccggtacggtaacccgaggtaaccggtaaacggtaaaccgggttccgggaccctaaccgggtccccgttaccccgggaacggtttcccgttacccggttaacggttacgtttacgggttaccggtaccgtaacccgtaacccggtacccggaaccgggtaaccggggtccccttaaacggggtccgtttaccgtcccggtaccgggtaccggggttaccgggttacggggttttaccccggtgggaccggggtttacgggggtccggggtttaccgggaacgggttaacgtaccggtttagttacccgtacggtttacccgtaaaccggtaccgtaccgtaccgtaccgtaccggtaccggtaccgttcgtaacgggtacggtttaacggtaggttaacgtttacggtttaggtttaaccgttttacggttttaaccgttcggttacgttaacggtacgttaaagttaacggttaaacgttaaccggtacccgggttccggttaccggggtacccggtttacgggtaacccgggtaccggggtaaaccgggaacgggttaaccgggttaacggtaaaccggtttaaccgggtaaaaccgacccgggttaacgggtccggtaccggttaaccgtaccggttaccggtacccgttacggtttccgttaccgtttccgtacccgg

SEQ ID NO: 193302 - DNA, 751 bp, Homo sapiens
  misc_feature: GYAE6OF01B4SNU.10.2.A02.1.454.CMB.1.raw
  modified_base (271)..(271): a, c, t, g, unknown or other
  misc_feature (271)..(271): n is a, c, g, or t
  modified_base (399)..(399): a, c, t, g, unknown or other
  misc_feature (399)..(399): n is a, c, g, or t
tcagcatagtagtgcacgaccggtgctcgatttagactcatctacgagggggaggaactgctcacttaggacccagacggaaccatggaagccccagcgcagcttctcttcctcctgctactctggcctcccagtactaccacgtggagaagtagtgatcgacgcagtctccgacgccacctgtctgtcgtcctacggaagggaacacgccctaccctcgtcctgccgacgggacctagtcgagtaggttgtcggcgcggagtagggtacnccgttcggaaccgtacgacgaacggtaacggtcggcctacgccctaccgacggtcctaccgtacgttagttacggcgttactaccgtaaccgcccgaccggacggtacctcggtacgtactcgtacgnggtaccggtcggttcgaggtcgtacgggtcggtacggtacggcgtacggtacgtctaccgtacggtacctaaccgtacgctaaccgtccggactccggttcgtgaaccggttacgggtaagtaccgtttcggttttactaaccgtttttagtttaccgtttacgtagttacgtacgttaagttaacggtacgtaacggtttccggtacgggaccccgggtccgttaccggggtaccgtccgggaaacgggtacccgggtaacggttacggaaccggtaaataccgggtaaccgtacggttacggccggttaaccgcgttaacccgtacttaccgcgtttaccgtcctacccg

SEQ ID NO: 193303 - DNA, 834 bp, Homo sapiens
  misc_feature: GYAE6OF01CXFQD.10.2.A02.1.454.CMB.1.raw
  modified_base (220)..(220): a, c, t, g, unknown or other
  misc_feature (220)..(220): n is a, c, g, or t
tcagcatagtagtgcacgaccggtgctcgatttagactcatctacgagggggaggaactgctcacttaggacccagacggaaccatggaacgccccagcgcagtcttctcttcctcctgccttactcgtggcctcccagactaccacgtggaagaagtagtagatggaccgcagtcctccgacgcccaccttgtctgtcgtccgtaccggaagggaaccnccgaccctaccctcctacctggaccgtacggtcctacgtcgtaggtagttggttacggcaggtacgttagggttaccgaccgttacggtacccaaggaccgaaacggtaaaccggtcggacccgacggcccttacccggacggtccccttccgtaagttagttacggtcggtcacctacccgtacccggaccggacgggtacctagtttcgtactaccggacgtacggtcgttaccggggtttcgaggtaccgggttgggttcgggtacggtacgggaacgtacggttacgtcctacggtccgtaccaacgtccgtacgacgaccgtaccgccgtacgacggttcgttaaggttaacggttaacgttttagtttccgtaacggtttttaagtttacccgtacgttaggtaaccgtagtttaacgtaagttttaaccaagggttacccgttcggaccccgggttccggttaaaccggttccggggttaacccgaaacgggggttaacccggtacgggttacggtaaacggttaacccgtaaacggttaaccggtacggttcggtcccgtaaacgtcggtaacctaccgttagtttccgttacgttccgttacccg

SEQ ID NO: 193304 - DNA, 726 bp, Homo sapiens
  misc_feature: GYAE6OF01A3PXN.10.2.A02.1.454.CMB.1.raw
  modified_base (256)..(256): a, c, t, g, unknown or other
  misc_feature (256)..(256): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
tcagcatagtagtgcacgaccggtgctcgatttagactcatctacagggggaggaactgctcacttaggacccagacggaaccatggaacgccccagcgcagcttctcttcctcctgctactctggcctccagactaccactggagaagtagtgatgacgcagtctccagcccaccctgtctgtgtctcgaaggggaacacgccaccctctcctgcgacgggccagtcaggagttggtcggacaggctaggttacnccgtggtaaccagacgaagtaacgtcggaccaggcctaccgagtcctccgtagtatagtggtacactacnccacgacgggtacctacgtaggtacnccgtacgacggtcctagggtccgtggacgtagggtcggtcgtagggactaggtcttaccgtacgtcgtaccactacgtacgcggacctacggtccgtagaccgttaggttacgtaagtaacgtttagtttacgtacgtttaattttaagttacgtttactacggtataaccggtacgtacgttacgggtacggtacggggttcccgttaccggttttaaccggtaaccgggttaccccgggggaacccgggtaaaacgttaaccgggtaaaggtaaacccggtaaaccgaaaccgggtaacgtttcgggtaacggtacccgtagtaaacccgtacggttaccttacggtttacccgtacctttcggttaacccc

SEQ ID NO: 193305 - DNA, 665 bp, Homo sapiens
  misc_feature: GYAE6OF01DFOQN.10.2.A02.1.454.CMB.1.raw
  modified_base (160)..(160): a, c, t, g, unknown or other
  misc_feature (160)..(160): n is a, c, g, or t
  modified_base (450)..(450): a, c, t, g, unknown or other
  misc_feature (450)..(450): n is a, c, g, or t
  modified_base (633)..(633): a, c, t, g, unknown or other
  misc_feature (633)..(633): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgnagtctccagccaccctgtctgtgtctccgaggggaaaacacgcccaccctctcctgcacgggccagtcagagtgttggacagcaggttacgctacggtacaagcaagaaacgtggaccaggcctacccgaaggtcctacccgtcgttaagtaacgtggtacgtcacttacccgaccgtaacggggcctacgttagggtactcctacgtaacggcgtaacgggtttccggtgggacctaagggtggggttctaggggaaccagtacgttcactggtaacaccagttcgaanccgagccgtgtacctagttcgtaagaaagtgttttagcctttaagtttattacgttgtacgagtacgtaagttaaatttaaacgtaggtaccgttccgggcccggtaccgttaacgggtttcggaaccgtaaaacggggacgtacgggttagaaacgttaaaccgaaacggtcgtaggccggntacggccaaccgcttaacgtgttccgtaaccg

SEQ ID NO: 193306 - DNA, 679 bp, Homo sapiens
  misc_feature: GYAE6OF01BF042.10.2.A02.1.454.CMB.1.raw
  modified_base (331)..(331): a, c, t, g, unknown or other
  misc_feature (331)..(331): n is a, c, g, or t
  modified_base (636)..(636): a, c, t, g, unknown or other
  misc_feature (636)..(636): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccgaagggaacagcccaccctctcctgcgacgggccagtcacgtagtggttggcaggcgtaggttacgccgtaggtaccgagacgaacgtaaacggtggaccgacggtcctacccgacggtcctacccgttacgtattagtcggtcnccgtactcccgaccggacgggacctacgttagggtactaccgtacggacggtaccgttcggggttccggtgggacgtaggggttcgggtcggtacgggtacgtacggtacgttacgaccgtacgtaccgaacgtactacgaccgtaggtaccgcgtacgggtacacgtgttaagacgtttagtttcgtacgttaacgttttgtacgtgtactaggtactaagtaacgtaaggtacgtcggtccgtaccggtacggtaccggtacggaaccggaagggtccgtacgggtaataacgtacgtaaacncgggtacgtcggactacgtacctactacgttctgttcgtaccg

SEQ ID NO: 193307 - DNA, 694 bp, Homo sapiens
  misc_feature: GYAE6OF01ESLFK.10.2.A02.1.454.CMB.1.raw
  modified_base (661)..(661): a, c, t, g, unknown or other
  misc_feature (661)..(661): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaacagcccaccctctcctgcgagggccagtcagtagtgttcggcagtcgtaggttacgccgtaggtaccgagtacgaaggaaacggtcggaccacggtcctacccgaggccttccgttacgtagtacgtgggtctcgtactacccgaaccggcgggaccctacgtggttactcgtacggacggtacgtacggggtttccgcggtacgtagggttcggggtacgtaggggtaactaggtaacggtttcgaacgttggtacccacctaacgtccgagacctacggtccgtagtccgtaacggttacctaaggtaacgtttacgttttacgtcgttttaaacgttttacttcggttacgtacgtaacgttagtaagttaacttaaggtacgtccggtcggcccggtagtacccggtacggaaccgggttacggaacgttagggaacgttaacgtaccgaaggttacgtcggngtactacgacctacgtattcgttcgttctaccg

SEQ ID NO: 193308 - DNA, 671 bp, Homo sapiens
  misc_feature: GYAE6OF01C54A5.10.2.A02.1.454.CMB.1.raw
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (325)..(325): a, c, t, g, unknown or other
  misc_feature (325)..(325): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgnagtcnccagccaccctgtctgtgtctccgaagggaacacgcccaccctctcctgccacgggccagtacaggagtgttggcaggcaggttgcctacggtaccagacgaagtaaaccggtcggaccgacggcctacccgaggtcctccgtacgtactgtggtcgacncgtacccgaccggacgggccaacgttggtactccgtcgaacggcgtacggttccggtggagtacgggtgggtacgtagggtacaggtacgtctactcgtaccactagcagccncgcctgcgtagtcgtaaggtaacgttntttagacgtttagtttaacttcgtacgtacgcgacgtacggtccgtacgtaccgttacggtttcggggacggtcgggtaccgtaccgttaccggttaccgggacggtaacgggtaaaccgaaaggtaacggtaacgggaaaaccgtaacgtaaacggtcgggttaacggtaccgtacgtaacccgtaaccctgttccggttaaccg

SEQ ID NO: 193309 - DNA, 673 bp, Homo sapiens
  misc_feature: GYAE6OF01BRPCH.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccacgtggagaagtagtgatgacgcagtctccagccacctgtctgtgtctccgagggaacncgcccacccgtctcctgcgaggccagtcagagtgtgcagctaggttacgccgtagtaccagcgaagaacggtcggaccgaggccctccgaggtccttcccgtacgtataggtcggtacgacctacgtacccgaacggacgggtacccctaggttacggttacctcgtacgacgggtccgtaacggggtttccgacgggacgtacggggttcgggtacgtaccggggaactacggtacgttaccgtacgttaccggtacccaaccttacgacgacggtacccgacggtccgtaccggacgttacgtacgtaaggttaacgttagttttcgaaccgtttagtttactacgttgtccgatacgtaacgttataacgtcgcgtcggccgtacgtcggtaccggacgtaacgggcggaggttagaaccgttcgaacgtacgtcggtacgcgtacggacctacgcgttcgtcgttcgtaccg

SEQ ID NO: 193310 - DNA, 732 bp, Homo sapiens
  misc_feature: GYAE6OF01CQ8EU.10.2.A02.1.454.CMB.1.raw
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
  modified_base (323)..(323): a, c, t, g, unknown or other
  misc_feature (323)..(323): n is a, c, g, or t
tcagcatagtagtgcacgaccggtgctcgatttagactcatctacagggggaggaactgctcacttaggacccagacggaaccatggaacgccccagcgcagcttctcttcctcctgctactctcggcctccagactaccacgtggagaagtagtgatgacgcagtctccagcccacctgtctgtcgtccaccggaagggaacncgccaccctctcctaggcgtacgggccagtcaggtagtgtgactagctaggttacncgttaggaccagacgaaaggtaacgcggaccacggtccctaccgacggtcctcctacaacttnttacgcgtataccgcctaacgtaacccgaacgggtacggccttaacggcggacctaacctcccggaacgtccggtaggttacgaggggtacgtacggtagggttccggggtacgtacgggtaacgtacccgtttaacctttccgaaccctcgtaacccacttacgaccgaacgacgaccgtaacgttaccgggaactacgtaaggttaacgtttagttcgtaacgttagtttagtttacgtttaggttccggtaacgttaagtaaggtttacggttacggtaccgggttaccttacggggtttacgtttacgggttaccggacgggtaccgggaacgtaggttacggtaggtaacgtacgtaaccggtagtaaccggttggcgtaccgttaccgaccttagtcgttccg

SEQ ID NO: 193311 - DNA, 739 bp, Homo sapiens
  misc_feature: GYAE6OF01ERL6L.10.2.A02.1.454.CMB.1.raw
  modified_base (477)..(477): a, c, t, g, unknown or other
  misc_feature (477)..(477): n is a, c, g, or t
  modified_base (566)..(566): a, c, t, g, unknown or other
  misc_feature (566)..(566): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccacgtggagaagtagtgatgacgcagtctccagccacctgtctgtgtctccgaagggaacacgcccaccctcgcctgccacgggccagtcgagtagttggttggcagacgtaggtacgtcgtggtaccaggtaccgaaggaaacgtcggaccacggcctacccgacggtcctccgtacgtacgtagtcggtcgacctacgtccgaaccgacgggtcctaacgtcgggtaactccgtacgacgtaccggtacgggttccggtaggtcggtaggttcgggtcggtacgggtacgtacggtcgttaccgtacgtcggtaccaaccgtacgtcgacggtaaccngggccttaggtaccgttacggtaacgttaggtaaacgttacgttttacgaccgtttaaattttaccgttagtaccgtacgtaacggttntaaacgttacttaaacgggctaccgggtcgggtacccggtaaggtccgggttaccggaaaccgggacggtaacgggtacgggaaacgttaaaccggtaaacggaattaaacccgggttggtacggcccgtaaaccgtcctaaccgtacgtttccttacggttccttaacccgg

SEQ ID NO: 193312 - DNA, 874 bp, Homo sapiens
  misc_feature: GYAE6OF01A0SLJ.10.2.A02.1.454.CMB.1.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (418)..(418): a, c, t, g, unknown or other
  misc_feature (418)..(418): n is a, c, g, or t
tcagcatagtagtgcacgaccggtgctcgatttagactcatctacagggggaggaactgctcacttaggacccagacggaaccatggaagccccagcgcagcttctcttcctcctgcctactctggcctcccagataccactggagaagtagtgatgacgcagtctccacgccctacccgtgtctgtcgtcctccgaaggggaaccngcccaccctctcctgcgaggccagtcagtagtgtcgcagtcgtaggttcnccgtgtaccagacgaaggaaccgtggcccgacggtccctcccgacggtccttacccgttacgtaagtacgttcggtccgaccgtactaccccgaaccggtacgggccctaacgttcgggtaaccttccgtacgacgggtaccgttaccggggtttcccggnggtaccggtacggggttaggggtcccgttaacgggggtacctaacgggttacgtttacccacgggttacgttacccctaaccgtactacccggaacgtcccgtaccggtaccgtaccgtaccgtaacggttaccttaacgggtaagtttttaaccggttttccgggttaacgtttaacgtttttaaccgtttaccggtttcgttaccgtaacggtaccttttaaacggtatttaaaaccggttcccggttaccggttaccccggggtcccggttaaccggggtaacccgggtttaccggggaaaccccgggttaaaccgggggtaccggttaaacggggtaaacccggttaaacgttaaacccggtaaaaccgggttaccggtttcgggtacccggtaacggttaccgtacccccgtaacggttacctttccgggttacctttccggttaaccccg

SEQ ID NO: 193313 - DNA, 779 bp, Homo sapiens
  misc_feature: GYAE6OF01EJIVF.10.2.A02.1.454.CMB.1.raw
  modified_base (195)..(195): a, c, t, g, unknown or other
  misc_feature (195)..(195): n is a, c, g, or t
  modified_base (388)..(388): a, c, t, g, unknown or other
  misc_feature (388)..(388): n is a, c, g, or t
tcagcatagtagtgcacgaccggtgctcgatttagactcatctacagggggaggaactgctcacttaggacccagacggaaccatggaagccccagcgcagcttctcttcctcctgctctctggctcccagactaccactggagaagtagtgatgacgcagtctcacgccacctgtctgtgtctcgaagggaacncgcccacctctcctgcgacggccagtcagtagttgtgcagcgtaggttacgccgtcgtaccagtacgaaggaacgtcggaccgacggcctcccgacggtcctccgttacgtagtacgtcggtacgccacgtacccgaaccggcgggtacctacgtaggttactccgtacggacggtccggtacgggttccggnggaccgtaggggttcgggtacggtgggtaaacgtcggtacgttacccaccgttcctaccgtaacccgtacgtcggacccggtccgggtccctaggacccgttaacgttacggtaaggttaaacgtttcgtttacggtaacgtttttcgttttaaccgttacgttcgtaacgtaggtttaaccgtaagtttaacggttaaacgtttcggttttaaccggttttaggttttttaacccgttccggtttacccggttttaccccggggtaccggttaacggggtaaaaccttacggggtttaccgttacgtttaccgggaaccggttaaacgtacggttggtaccggttacctaccggtaccttacccgttagttccttcggttcccttacccg

SEQ ID NO: 193314 - DNA, 752 bp, Homo sapiens
  misc_feature: GYAE6OF01D8DKA.10.2.A02.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
tcagcatagtagtgcacgaccggtgctcgatttagactcatctacgaggggggaggaactgctcacttaggacccagacggaaccatggaagccccagcgcagcttctcttcctcctgctactctggctcccagataccactgggagaagtagtgatgacgcagtctccagccacctgtctgtgtctccgagggaacncgcccaccctctcctgcgagggccagtcagtgtgttggcagcgtaggtcgccgtacggtaccagcaaggaacggtggaccaggcctccgaggcctccgtcgtatagtgggtcncacgtacccaccggcgggcctacgtgggtactcgtacggacggtcgtacgggttccggtggtacgtagggtcggggtcgtacgggacgtaggtcgttaccacggttcgtaccaaccgtgtaccgacgacgtacgccgtagcgtacgttacgtaggttaagttacgttttacgacgttttaagtttacgtttaccgttagtacgtaacggtaacgtaaggttaacgtttaacggttacggtttaacgggtttttacgggtttttaccgtttaccggtttacccggttttccccggggttaacccggttaaacggggtaaccggttaaacgggttcgggtttaacgtttaccggtaaacgggttaaccggttaaacgggttgggttaacccgggtcgttaacccggacccgttaaccgtcgttcccggtttacgtttacccgg

SEQ ID NO: 193315 - DNA, 814 bp, Homo sapiens
  misc_feature: GYAE6OF01CZKDR.10.2.A02.1.454.CMB.1.raw
  modified_base (220)..(220): a, c, t, g, unknown or other
  misc_feature (220)..(220): n is a, c, g, or t
  modified_base (618)..(618): a, c, t, g, unknown or other
  misc_feature (618)..(618): n is a, c, g, or t
tcagcatagtagtgcacgaccggtgctcgatttagactcatctacaggggggaggaactgctcacttaggacccagacggaaccatggaagccccagcgcagcttctcttcctcctgctactctggctccagataccactgggagaagtagtgatgacgcaggtctccagccacctgtctgtgtaccgtccaagggggaaacacgccaacccgttctccnggccaggggccaggtcaggacgttggttacgggcctaaggaccgtagggttaacgccccggttaggtaacccgacggtcgaaagggtaaaacggtggtaccgaacgggccttacccgacgggtccttccgtaccggtagtaacgtcggtcgtaccaacgttacccgaacgaccggggacctaagtcgggtaacttcgtaccgaagggccgtaaccggtttccggtgggacgtacggggttacggggtcgtacggggaactagggttagttaccagttcggtacacccgagttacgaacgacgtacgtccggttagaccggtaacggttacgaaggttaaaacgggttctttttaacgacgggttaatttttacgttaaccgttacggtaacccggtanaccgttaaggttaaccttaaaggtccggtaacgtccgggaaccccggttggttaacccggtcggggtaaacccgtaaaggggggtaacccgtggggtaaacggttaaacggttaacccggaaaaacggttacggttacggtacgggttacgtacctaccggacgttaacttcccgggttagtcccttttaaaccgg

SEQ ID NO: 193316 - DNA, 907 bp, Homo sapiens
  misc_feature: GYAE6OF01CQQ29.10.2.A02.1.454.CMB.1.raw
  modified_base (209)..(209): a, c, t, g, unknown or other
  misc_feature (209)..(209): n is a, c, g, or t
tcagcatagtagtgcacgaccggtgctcgatttagactcatctacagggggaggaactgctcacttaggacccagacggaaccatggaacgccccagcgcagcttctcttcctcctgctactctggcctcccagactaccacgtggagaagtagtgagtgaacgcacgttctccagcccaccgtgtctgtcgtcgtaccgaagggaacncgcccaccctcgtcctgacgacgggccagtcgagagttcggtggcaggtacgtacggttacgcgtacggtaccagacgtaacgaacggtcggaccgtcggaccgtacccgaggtcccttaccgtacggttagtacggttacggtccgaccgtaaccgaccccgtaccggtaacggtcccgtaacgtttacggtacgtccgtaccgggtacgggtaccggtacggggtttacggtcggtacggttacggggttacgggttcggtagggaaccgttaacgggttaaccggttacgtacggttaccgtacccgtaaacgtaccgtaccggtacgtaccgtacccggtaccgttcggtaaccgttaaacggtttaggtaacggttaacggttttcgttttaaccgaaccggtttaaggttttaacggttaacggtttttaacgttaaccgggtcgttaaaacgtttaaggtttaccggggttaacgggttaaccgggttaccgttacccggggttttacgggtttaaccggttttcgggaacccggggtaaccgggtaacccgttaaagggttcccgggaaaggttaaccccggttaaacgttaaacccggggttaaaactccggggttttagggaacccccgggttagggtacccctaaaccggtaccctttaacgggttccgttttcccgttaaccccgg

SEQ ID NO: 193317 - DNA, 825 bp, Homo sapiens
  misc_feature: GYAE6OF01CPPQ9.10.2.A02.1.454.CMB.1.raw
  modified_base (217)..(217): a, c, t, g, unknown or other
  misc_feature (217)..(217): n is a, c, g, or t
tcagcatagtagtgcacgaccggtgctcgatttagactcatctacgagggggaggaactgctcacttaggacccagacggaaccatggaacgccccagcgcagcttctcttcctcctgcctactctggacctccagactaccacgtggaagtaagtagtgatcgacgcacgtcctccagccctaccctgtctgtcgtccgtaccggaagggaaaccncgccccctacccttcgtcccgtcgaccggacggggaccctaggtaccgaggtaggttcggttacgggcctaacggtccgtaggggttttaaccgcccggttacggtaacccgacggtaaccggaacggtaaaaccggtcgggaccccgtacggtcccgtaccccgacggtccttcccgttaacgttagtacgtgggtccacctacccgtacccgaaccggacgggtaccctaggttacggtacctacgtcgtacgggtccgttacgggttcgtggccgtagggttccggtcggtagggacgtaggttacgtccgacgttaccgaccgtaccgtacgacgtaccgccgtacgccccgtgtacgtaccgttagttaaggtaacttttcgtttacggtacttttacgttttaactcggtttacgcgttacgtaacgttaattaacgtaggtaccggtacccggtcccgggttaccgtcgggttacccgggtacggggaacccggtagggttaccggtaaaggttaccgtaaccgtaaccggtaacgtaccggttgggtacccgacgttaccgaaccgtacccttacgttaccgttccggtacctttacccg

SEQ ID NO: 193318 - DNA, 510 bp, Homo sapiens
  misc_feature: GYAE6OF02HX8WZ.10.2.A02.1.454.CMB.1.raw
  modified_base (330)..(330): a, c, t, g, unknown or other
  misc_feature (330)..(330): n is a, c, g, or t
  modified_base (388)..(388): a, c, t, g, unknown or other
  misc_feature (388)..(388): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccaggggaaacagccaccctctcctgcagggccagtcagagtgttggcagcaggttagcctggtaccagcagaaacgtggccaggctccaggctcctcgtatatggtgcatccaccagggccactggtatctcaggcaggttccgnggcaggtgggtctgggacagagttcactgtcaccatcagcagcctgcagtctgaagtnttttgctagtttattactgtcagcagtataatagctcggcccgcgtacggttcggaccgaaggggaccgagggtaggaacgttacgaaacgtacgtggtaggctgctaccatcttgtcttac

SEQ ID NO: 193319 - DNA, 499 bp, Homo sapiens
  misc_feature: GYAE6OF02HUAGE.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccacaagggccactggtactcccagccaggttcagtggcagtgggtctgggacagagttcgctctcaccatcagcagtctgcagtctgaagtattttgctagtttattactgtacaggtaatatgatggctggcctcgtactactttgcctaagggtactaagttggactatacaaacgtactgtggctagacactatctcg

SEQ ID NO: 193320 - DNA, 531 bp, Homo sapiens
  misc_feature: GYAE6OF02H0SV8.10.2.A02.1.454.CMB.1.raw
  modified_base (389)..(389): a, c, t, g, unknown or other
  misc_feature (389)..(389): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggctcctcgtatatggtgcatccaccagggccactggtatctcaggcaggttccgtggcaggtgggtctgggacaggagttcactgtcacatcagcagcctgcagtctgaagtnttttgctagtttattacttgtcagcagtataatagcgtcggcccgtcgtacggttcggaccgaaggggcccgtagggtcggaacgtttacgaaaaccgtacgtggtaggccgttaggcctaaccgtagtcgttcgtcttacg

SEQ ID NO: 193321 - DNA, 564 bp, Homo sapiens
  misc_feature: GYAE6OF02G8052.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgtggcagcaggttagcctggtaccagcagaaacgtggccaggctcccgaggcctccgtcgtatatggtgcatccaccgagggccacgtggtactctcgaggtcaggttccgtggcaggtgggtctgggacaggagttcgactggtcaccatcagcacgcctgcagtctagaagtatttgcttagtttattactgtcagtctagtataatagtcgtcggcccgtacgtaccggttccggaccgaaggggtaccgtagggtacggtaacgttaccgaaacggtacgtaggtacggtaccgttacggaccgtaacccgagttaccgtcggttccttaccg

SEQ ID NO: 193322 - DNA, 504 bp, Homo sapiens
  misc_feature: GYAE6OF02GYIEB.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcaggtgggtctgggacagagttcactgtcaccatcagcagcctgcagtctgaagtattttgctagtttattactgtcagcagtataatagctggcccgcgtacgttcggaccgaagggaccgaggtacggaagttacgaaacgtacgtgtggctgcaccatcgtgtcttc

SEQ ID NO: 193323 - DNA, 566 bp, Homo sapiens
  misc_feature: GYAE6OF02JI01G.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcaagaacgtggccaggctcccgaggctcctcgtatactggtgcatcccacgagggccactggtatctcgaggcaggttccgtggcagtgggtctggggacaggtagttcactggtcaccatcgagcagcctgcagtctagaagtatttgcttagtttatactgtcagctaagttataagtcgtacgtcggtcccgtgtacggttccggaccgtaacggggtacccgtagggttaggaacgtttaccggaaaacggtacggttcggacgggtacgtcggtaaccacccgttaagtccgttacgttccttaccg

SEQ ID NO: 193324 - DNA, 520 bp, Homo sapiens
  misc_feature: GYAE6OF02HBYX4.10.2.A02.1.454.CMB.1.raw
  modified_base (517)..(517): a, c, t, g, unknown or other
  misc_feature (517)..(517): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggcctcctcgtatagtggtgcatcccaccgagggcccaacgtggtactcgtcagggctagggttccgtggcaggtgggtctggggacaggtagttccagtgtcaccatcagcacgcctacagtctagaagtattttgcttagtttatactgtcagtcagtataatagctggcccgtcgtacgttcggacgaacgggcgaggtcgaattacgaacgtactggtgctgcacctatcgtgtctntac

SEQ ID NO: 193325 - DNA, 544 bp, Homo sapiens
  misc_feature: GYAE6OF02IYLXQ.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggctcctcgtatagtggtgcatccaccgagggccacgtggtatctcagggcaggttccgtgggcaggttcgggtctgggacaggtagttcacgtgtcaccatcagcacgcctgccagtctagaagtattttgctagttttattacttgtacagcagttaataatagctggcccgcgtacgttccggaccgaagggaccgtaggtaggtaacgttcgaaacggtaacgtggtaggctacggccgtaaccgtagtccgttggttccttacg

SEQ ID NO: 193326 - DNA, 516 bp, Homo sapiens
  misc_feature: GYAE6OF02FQXDA.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcaggtgggtctgggacagagttcactgtcaccatcagcagcctgcagtctgaagtattttgcttagtttattactgtcagcagtaataatagctggcccgcgtaacgttcggaccgtaagggcccgagggtaggaactttccgaaacgtaacgtgtaggctcgcaaccatctgttcttaccg

SEQ ID NO: 193327 - DNA, 482 bp, Homo sapiens
  misc_feature: GYAE6OF02H1VE1.10.2.A02.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccacagggccactggtatctcaggcaggttccgnggcagtgggtctgggacagngttcactgtcaccatcagcagcctgcagtctgaagtnttttgctagtttattactgtcagcagtataatagctggccgcgacgttcggcaagggaccaggtgatcaacgtatgtcgctgcacatctntntc

SEQ ID NO: 193328 - DNA, 656 bp, Homo sapiens
  misc_feature: GYAE6OF02J0FBB.10.2.A02.1.454.CMB.1.raw
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
tcagcatagtagtgcacgaccggtgctcgatttagactcatctacaggggaggaacgtgctcacttaggacccagacggaaccatgaagccccagcgcagcttctcttcctcctgctactctggctccagataccactggagaagtagtgatgacgcagtctccagccaccctgtctgtgtctccaggggaacagccaccctctcctgcagggccagtcagagtgttggcagcagggttanccgtggtaccagcagaaacgtggaccaggcctccgaggctccgtcgtatacgtggtncagtcccaaccgacggggcccacgttgggacttccgtcgacgggcctagggttccccgtgggacccaggttccgggtcgtacgggaacgaggtacgttccgacgtttggacccgaaccngttaccgacgaccaacggtaccctaacgtacggtactaggtaaagtagtttttcgacgttagttttaacgttacgttggttaccgacgtacgtaacgttaagttaaagttacggtacgtcgggacccgtacggtacgtttccgggaccgtaaacggggaccgtagggtacgtaacgttacgaaacgtacgtaggtcggtaccgtagcccgtaactaccgtacgtcgttccttagtaccg

SEQ ID NO: 193329 - DNA, 502 bp, Homo sapiens
  misc_feature: GYAE6OF02IBPK2.10.2.A02.1.454.CMB.1.raw
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtgccaggctcccaggctcctcgtatatggtgcatccaccagggccactggtatctcgaggcaggttccgnggcaggtgggtctgggacaggtgttcactgtcacctatcagcagcctgcagtctgaagtnttttgcttagtttatctgtcagcagtatatncgtgcccgngacggttcgaccgaagggccgaggtggactacgaacgtacgtggtgtcgtgacacgatcgtcgtcttacg

SEQ ID NO: 193330 - DNA, 583 bp, Homo sapiens
  misc_feature: GYAE6OF02F1HM5.10.2.A02.1.454.CMB.1.raw
  modified_base (335)..(335): a, c, t, g, unknown or other
  misc_feature (335)..(335): n is a, c, g, or t
  modified_base (396)..(396): a, c, t, g, unknown or other
  misc_feature (396)..(396): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccgagggcccacgtggtatctcaggcaggttccgnggcaggtgggtctgggacagagttcactgtcaccatcagcacgcctgcagtcgtagaagtnttttgacttaagttttatttacgtgtactagtctaagttaataaattaggtccgttcgggaccccgtcggtaaccggttccgggacccgtaaggggacccgtagggtacgggaaacgtttacgaaaaccggtacgttggtacggtccgttacggacctaacccgtattccgttacggttccttaccg

SEQ ID NO: 193331 - DNA, 567 bp, Homo sapiens
  misc_feature: GYAE6OF02GDCTK.10.2.A02.1.454.CMB.1.raw
  modified_base (293)..(293): a, c, t, g, unknown or other
  misc_feature (293)..(293): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaacgtggccaggctcccaggctcctcgtatatggtncatccaccgagggccactggtactctcaggcagggttccgtggcgtaggtgggtcgtgggacaggtagttcacgttgtacaccatcagcagcctgcagtctagaagtatttgcttagtttattactgtcagtctaagttataagtagtcgtcgggcccgtcggtaccggtttcggaccgaacggggacccgtagggtacggaacgttaaccgaaaccggtaacgttggtacggccgttacggaccgtaacccgtacttccttcggtccttaccg

SEQ ID NO: 193332 - DNA, 554 bp, Homo sapiens
  misc_feature: GYAE6OF02HTWSU.10.2.A02.1.454.CMB.1.raw
  modified_base (412)..(412): a, c, t, g, unknown or other
  misc_feature (412)..(412): n is a, c, g, or t
tcagcatagtagtgcacgaccggtgctcgatttagactcatctacagggggaggaactgctcacttaggacccagacggaaccatggaagccccagcgcagcttctcttcctccttctactctggctcccagataccactggagaagtagtgatgacgcagtctccagccaccctgtctgtgtctccaggggaacagccaccctctcctgcagggccagtcagagtgttggcagcaggttagcctggtaccagcaagaacgtggccaggctcccaggcctcctcgtatatggtgcatcccaccgagggccacgtggtatccgtcgaggcacggttccggtggcctaggttcggggttctggggacaggtacgttcacgttgtccaccatcagcacgcctgcagtctgaagtntttgcttagtttattactgtcagctagttataatagcgtcggcccgtcgtacggttccggacgaagggacgaggtaggtacttaccgaaacggtacgttcggtaggtctggacctaccgtagttccgtacgttccttctacg

SEQ ID NO: 193333 - DNA, 546 bp, Homo sapiens
  misc_feature: GYAE6OF02G0TNN.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggcccagtggtatctcgaggcaggttccgtggcaggtgggtctgggacagtagttcactgtcacatcagcagcctgcagtctagaagtatttgcttagtttattactgtcagtcagtataatagtcgtgggcccgtacgtaccgttcggaccgaacggggaccgtagggttacggaaacgttcgaaaccggtaacgtcggttacggaccgttgacctaccgtagttcgttggttcctttacg

SEQ ID NO: 193334 - DNA, 554 bp, Homo sapiens
  misc_feature: GYAE6OF02GJ3PT.10.2.A02.1.454.CMB.1.raw
  modified_base (400)..(400): a, c, t, g, unknown or other
  misc_feature (400)..(400): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccacctctcctgcagggccagtcagagtgttggcagcaggttagcctggtaccagcagaaacgtggccaggcctccaggctcctcgtatagtggtgcatccaccgagggccacgtggtatcctcgaggctaggttccgtggcaggtgggtctgggacagtagttcactgtacaccatcgagcacgcctgcagtctaggaatntttgacttagtttatacttgtctagctagttaataagtgcgttcggcccgtacgtacggttccggaaccgaagggtaccggtagggtacggtaacgttccgaaaacggtacgtggtacggtctacggaccacctagtccgttcgttcttacccg

SEQ ID NO: 193335 - DNA, 547 bp, Homo sapiens
  misc_feature: GYAE6OF02GOUIA.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctccaggctcctcgtatatggtgcatccaccgagggccactggtatctcgaggcaggttccgtggctaggtcgggtctgggacaggacgttcactgtcaccatcagcagcctgcagtctagagtatttgacttagtttattactgtcagtctaagtaataagtagcgtcggcccgtagtacgttacgggaccgaaggggtaccgaggtaggtaacttacggaaaaccggtacgtggtaggaccttggacctaacctagttcgttacgttccttaccg

SEQ ID NO: 193336 - DNA, 773 bp, Homo sapiens
  misc_feature: GYAE6OF02H75CV.10.2.A02.1.454.CMB.1.raw
  modified_base (309)..(309): a, c, t, g, unknown or other
  misc_feature (309)..(309): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagccgtggtaccagccgaaggaaacgtggaccaggcctacccgaggtcttaccctcgtatatgggtnccactcccgaccgacgggccccagttacgggtactccgtacgagggtccgtagggtttcccggtgggtaccgtaggggttcggggttaccgtagggggaaccgtaagggttacggtttaccaaccggtttcgggttacccaacccgtaagttcccgaaggtcccgaaccggtccccgtttaggaacccgtaggtttacccgttaagggtaaaacggtttacgtttttttagggacccgttttaaaggttttttacgttttaaaccgttggtttaccgaaggtaccttaagggttaaacctttaaagttacggtaccgtacgggtccccggtaacggttacccggttacgggaacccgtaaacggggtacccggtaagggttacggttaacgttaaaccggaaacggtacggttacggttacggaccgtaggaccctaaccgtacgttcgttacgttcttacccg

SEQ ID NO: 193337 - DNA, 682 bp, Homo sapiens
  misc_feature: GYAE6OF02HZLPT.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggcccagtcagagtgttggcagcaggttagcctggtaccagcagaaacgtggccaggctccaggctcctcgtatatggtgcatccaccagggcccacgtggtatctcgaggcctagggttcccgtgggcgaggttcggggtctcggggaaccaggacgtttcaaccttcgggtaccacccgtattaccagaccacggcccgttaggactagttctaggtaaagtcttttttaggacctttaaggtttttaatttaaccgttgttacgtagtaccgtaagttaaacgttaaagttcggtacgtccgggtaccccggaccggttaaccgggttaccgggtacccgaaaacgggggtacccggtaaggggttacggggtaaacctttaaccggtaaaaccggtaaccggttggttacgggacccgttacggacccgtaacccgtaatttcccgttacgtttacccttaccg

SEQ ID NO: 193338 - DNA, 536 bp, Homo sapiens
  misc_feature: GYAE6OF02H3U5Z.10.2.A02.1.454.CMB.1.raw
  modified_base (437)..(437): a, c, t, g, unknown or other
  misc_feature (437)..(437): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccaggggccacgtggtatcgtcagggcaggttccgtggcaggtgggtctgggacagtgttcatgtcacatcagcagctgcagtctagaagtattttgacttagtttattacttgtcagctagtataatagctggccnggtacgttcgggccgtaagggacccgagggtacggtaacgttacgaaaccggtacgtggtaggccttaggaccaaccgtagttccttggttccttaccg

SEQ ID NO: 193339 - DNA, 528 bp, Homo sapiens
  misc_feature: GYAE6OF02G3VYT.10.2.A02.1.454.CMB.1.raw
  modified_base (336)..(336): a, c, t, g, unknown or other
  misc_feature (336)..(336): n is a, c, g, or t
  modified_base (398)..(398): a, c, t, g, unknown or other
  misc_feature (398)..(398): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgggggaaacagccaccctctcctgcagggccagtcagagtgttggcagcaggttagcctggtaccagcagaaacgtggccaggctcccaggctcctcgtatatggtgcataccaccgagggccacgtggtatctcgaggcaggttccgnggcaggtgggtctggggacaggagttcacgttgtcaccatcagcagcctgcagtctgaagtntttgctagtttattactgtcagtactagtataatacgcgtcggcccgtcgacgttcggaccgaaggggaccgtaggtagaacttacgaaacgtacgtggtcggctgacactagtcgtcgttcttactacg

SEQ ID NO: 193340 - DNA, 741 bp, Homo sapiens
  misc_feature: GYAE6OF02H8GOR.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcatgttagcctggtaccagcagaaacgtggccaggcctccaggctcctcgtatagtggtgcatccaccgagggccacgtggtatcgtcgaggctaggttccgtggccgtaggtcgggtcgtggggaacctaggtacgtttccacgttggtaccctaaccgtagttccgaacggcctaacgggccccgttacggccgtaaggtttacccttaagggtaaacggttttacttttttacggacctttaaggttttttaactttaccgtttgttaccgtaaggtaccgtaaaggtttaaacttaaacggttacgggtaccgttcccggggtacccccgggtccgggttaacccgggttttacccggggaacccgggtaaacgggggtaccccgggttaagggggttaaccgggtaaacgttttaacccggaaaaccggttaaccgttacgggttacgggtacccgttacggaccccgttaaccctaagtttcccggttaggtttaccccg

SEQ ID NO: 193341 - DNA, 538 bp, Homo sapiens
  misc_feature: GYAE6OF02H3MWQ.10.2.A02.1.454.CMB.1.raw
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (405)..(405): a, c, t, g, unknown or other
  misc_feature (405)..(405): n is a, c, g, or t
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccagccaccctgtctgtgtctccgaggggaacagccaccctctcctgcagggccagtcagagtgttggcagcaggttagcctggtaccagcagaacgtgccaggcctccaggcctcctcgtatatggtgcatccaccgngggccagtggtatctcgaggctaggttccgnggctaggttgggtcgtgggacaggtacgttcgactgtaccaccgtatcgagcacgcctgcagtctagaagtnttttgattagtttattacgtgtacagctagttaataatagtcgtcggcccgtcgtacggttccggacgaacgggaccgtagggtagtaacgtacgaaacgtacgtgtcggcgtcgaccacctatctgttctac

SEQ ID NO: 193342 - DNA, 598 bp, Homo sapiens
  misc_feature: GYAE6OF02I1EQ2.10.2.A02.1.454.CMB.1.raw
  modified_base (389)..(389): a, c, t, g, unknown or other
  misc_feature (389)..(389): n is a, c, g, or t
tcagcatagtagtgcacgaccggtgctcgatttagactcatctacagggggaggaactgctcacttaggacccagacggaaccatggaagccccagcgcagcttctcttcctcctgctactcaggctccagaaaccactggagaaatcgtgatgacgcagtctccagccaccctgtctgcgtctccagggcaaacagccaccctctcctgctgggccagtccgagtgttggcagccgcttagcctggtaccagacaaaacctggccacgcctcccaggcctccgtcgtctatggtgcactccacgaacgggccactggtactcccgagccgtaggttcacggtggcaggtgggtcgtgggacaggagttcgctctcacagtcagcagtntcgactacgtctagtaagttagtttcgtacgtaagttttactttacgtgttacgtaaggtaattagtaggtagttggtcgttcgggtcccgtttaccgttacgttacgttttacggaccgtaacgggtactaaggttcggtaacgtacgtaacgtaaacgtaacgtcggtacggtacgtacgacctaaccgacttctacgttcttaccg

SEQ ID NO: 193343 - DNA, 568 bp, Homo sapiens
  misc_feature: GYAE6OF02G3YVA.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccgagggccactggtatctcgaggctaggttccgtggctaggtgggtctgggacaggggtattcactgtaccaccatcgagcgacgcctgcagtctagaagtattttgacttagttttattacttgtactagactagtaataagtagcgtacggcccgtacgtaccggttccggaccgaaggggaccgtagggtacggtaacgttaccgaaacggtacgtcggtacggtaccgtacggaccgtaccgtacgttcgtcgttacttaccg

SEQ ID NO: 193344 - DNA, 538 bp, Homo sapiens
  misc_feature: GYAE6OF02IGZGJ.10.2.A02.1.454.CMB.1.raw
  modified_base (445)..(445): a, c, t, g, unknown or other
  misc_feature (445)..(445): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtgccaggctccaggctcctcgtatatggtgcatccaccgagggccactggtatctcaggcaggttccgtggcaggtgggtctggggacaggtagttcacttgtccaaccatacagcacgcctgcagtctagaagtattttgctagttttatactgtcagctagtataatagcgtcggtcccgngtacgttccggaccgaaggggacccgtagggtacggtaacgttacgaaacgtacgtaggtggtaccgtagccactagtcgttcggtcttaccg

SEQ ID NO: 193345 - DNA, 504 bp, Homo sapiens
  misc_feature: GYAE6OF02G4JEC.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaaacgtggccaggctcccaggcctcctcgtatatggtgcatccaccgagggccacgtggtatctcgaggcaggttccgtggcaggtgggtctgggacaggagttcacgtgtcaccatcagcagcctgcagtctgaagtatttgcttagtttattactgtcagcagttataatagctcggcccgtcgtacgttcggaccgagggaccgaggtaggaattcgaaacgacgtgtgctgcacatctgtcttc

SEQ ID NO: 193346 - DNA, 670 bp, Homo sapiens
  misc_feature: GYAE6OF02IEDYU.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctcgaggggaacagccaccctctcctgcagggccagtcagagtgttggcagcaggttagcctggtaccagcaagaacggtgccaggctcccaggctcctagtatagtggtcgcactccaccgacgggccacgtggtactctcgaggctaggttccgtggcagggtgggtcgtaggggactaggtacgttcacgttcggtccaacctattcgaacggtccaacggtcccgttagaccgtaggttacgtaggtaagtttgtttttacggactttaaaggttttttacttacggttcgttacgacggtacgttaagttaactttaaacgtacggtaccgttaccggggtacccgtacgggtaccgggttacccgggaacccgtaaacggggtacccggtagggttaacgggtaacttaaaccggtaaaccggtacgttacggttacggtacgtcggaccgtaaccgtacgttacgttcgtccgtttaccg

SEQ ID NO: 193347 - DNA, 561 bp, Homo sapiens
  misc_feature: GYAE6OF02HBVDI.10.2.A02.1.454.CMB.1.raw
  modified_base (556)..(556): a, c, t, g, unknown or other
  misc_feature (556)..(556): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaaacgtggccaggctcccaggctccgtcgtatagtggtgcactccaccgcgggccacgtggtatctcaggcacggttccgtggctaggtgggtcgtgggaacaggtacgttcacgtggtccaccagttcaacggcacgcccgtgctagtctagaagtagttttgacttaggttttacttacgttgtctagctaggtccgtggaccctagtcggcccttggtcccgtttcccgttcggcccgttagggaccctaaggttcggaattacgtacaaacgtactgtacggctcgccaccgtntctcg

SEQ ID NO: 193348 - DNA, 720 bp, Homo sapiens
  misc_feature: GYAE6OF02FXZBL.10.2.A02.1.454.CMB.1.raw
  modified_base (332)..(332): a, c, t, g, unknown or other
  misc_feature (332)..(332): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcagggccagtcagagtgttggcagcaggttagcctggtaccagcagaacgtgccaggctcccgaggctcctcgtatatggtgcatccacgagggccactggtactcgtcaggcaggttccgnggctaggtcgggtcgtgggacaggtacgttcacgttcggtccacccgtagttaccgacgtccgaacggtccccgttaggaccgtaacggtccgttaagggtaaacggttagttttttcggaccgttaaaggttttttaactttaaccgttcggttaccgtaacggttaccttaagggtttaaacttaaacgttacgggacccgtttacggggccccccgggtacgggttaacccgggttttacccggggaaccgtaaaccggggggtacccgtaagggggttaccgggtaaacgtttaaacccggaaaaccggttaaaccggttcggttacgggtaaccgttcgggaaccctaacccgtaagtttaccgttacggttcctttaaccgg

SEQ ID NO: 193349 - DNA, 638 bp, Homo sapiens
  misc_feature: GYAE6OF02JCDMG.10.2.A02.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtatccagccaccctgtctgtgtctccaggggaaacngccaccctctcctgcagggccagtcagagtgttggcagcaggttancctggtaccagcagaacgtggccaggcctccgaggctcctcgtatagtggtgcatccgaccgagggccctacgtggtatctacgaggcgtaggttccgtggccgtaggttcggggtctaggggactaaggtagttccaacgttcggtaccacctagttccgacgtccgacgtccgtggacctaggttcctaggtaacgttagttttcgacgttaacggtttttattaccgttagttccgaagtacgtaagttagttaacgtaggtccgttccgggcccgtacggtaccggtttcccggaccgtaaggggacccgtagggtacgtaacgttaacgaaaccggtaacgttcggtcggacgttacgaccgaccgttacgtcgttcggttcttaacccg

SEQ ID NO: 193350 - DNA, 554 bp, Homo sapiens
  misc_feature: GYAE6OF02H9H1Q.10.2.A02.1.454.CMB.1.raw
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (420)..(420): a, c, t, g, unknown or other
  misc_feature (420)..(420): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccgagggaaacagccaccctctcctgcagggccagtcagagtgttggcagcaggttagcctggtaccagcagaacgtgccaggctccaggcctccgtgtatagtggtncactccaccgagggcctagtggtactcgtacgaggtcacgggttccgnggctaggtcgggtctagggacaggtgttacacgtgtaccaacctagtcagcgacgcctggacctagtctaggtaacgttnttttagacgttagttttagtacgtgttacagtactagttaataagtcgtcgtcggcccgtacgtaccggttcggaccgagggaccgtaggtcgtaatacgaacgtagtcgtgctgaccactagtcgttgtctac

SEQ ID NO: 193351 - DNA, 647 bp, Homo sapiens
  misc_feature: GYAE6OF02IYXQ8.10.2.A02.1.454.CMB.1.raw
  modified_base (198)..(198): a, c, t, g, unknown or other
  misc_feature (198)..(198): n is a, c, g, or t
  modified_base (354)..(354): a, c, t, g, unknown or other
  misc_feature (354)..(354): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngcccaccctctcctgcaggccagtcagagtgttggcagcgaggttagccgtggtaccagcaaggaaacgtcggaccaggcctcccgaggcctccgtcgtatagtggtgcactccgaccgagggcccacgtggtctcgtcgaggcgtacggttccgnggcgtagggtgggtcgtgggacgtagtacgttcacgtcgtaccaccgtatcgacgccacgtcctagctagttctaaggtaagttgttttcgacgttaaggtttttattacgtgtaccacggtacttaagttaacgttaaacgtcggtcgttaccggggtaccccgtacgggttaccgggttccgggaaaccggtaacgggggtaccgtaggggttacggtaacgttaaccggaaaccgttacggtggtacggcgtacggtacctaaccgttattccggttcgttcccttaccg

SEQ ID NO: 193352 - DNA, 543 bp, Homo sapiens
  misc_feature: GYAE6OF02GRBKC.10.2.A02.1.454.CMB.1.raw
  modified_base (197)..(197): a, c, t, g, unknown or other
  misc_feature (197)..(197): n is a, c, g, or t
  modified_base (346)..(346): a, c, t, g, unknown or other
  misc_feature (346)..(346): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacngccaccctctcctgcagggccagtcagagtgttggcagcaggttacgcctggtaccagcaagaaacgtggccaggctcccaggcctcctcgtatagtggtgcatcccaccgagggcccacgttggtactcgtcgaggctagggttccgngggctaggttggggtctggggactaggtacgtttcacgttgtaccacctatcgagcacgcctgcagtcgtagaagtatttgcttagtttattacgtgtcagtctagttataatagctcggccgtcgtacgttcggacgaacggacgaggtagtaacgtacgaaacgtacgtgtcgtgtcgacacctatcgtcgtctc

SEQ ID NO: 193353 - DNA, 611 bp, Homo sapiens
  misc_feature: GYAE6OF02GXP6E.10.2.A02.1.454.CMB.1.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccagggaaacngccaccctctcctgcagggccagtcagagtgttggcagcaggttagcctggtaccagcaagaaacgtggccaggcctcccgaggcctccgtcgtatagtggtgccactcccgaccgagggcccagtggtactcctcgaggcgtacggttccgnggcctagggttcgggtctggggacaggtacgttcacgtcgtaccaccatcgagcacgccgtgctagtcgtagtaagttattttcgactttaagttttacgttactgtacagtctaagttaataagtacgcgttacgggacccgtcggttaccggtaccggaaccgtaacggggaccggtaggttacggtaacgttaaccggaaacgtacggttggtacggtacgtacgaccgtacccgtacgttccgttacgttccttaccg

SEQ ID NO: 193354 - DNA, 636 bp, Homo sapiens
  misc_feature: GYAE6OF02I4VWZ.10.2.A02.1.454.CMB.1.raw
  modified_base (356)..(356): a, c, t, g, unknown or other
  misc_feature (356)..(356): n is a, c, g, or t
tcagcatagtagtgcacgaccggtgctcgatttagactcatctacagggggaggaactgctcacttaggacccagacggaaccatggaagccccagcgcagcttctcttcctcctgctactctgctcccagataccactggagaagtagtgatgacgcagtctccagccaccctgtctgtcgtctaccgagggaaacagccaccctctcctgcgagggccagtcagagtgtggcagcaggttacgccgtggtaccagcgagaaacgtggaccaggctacccaggctccgtcgtatagtggtgcatccaccgaagggtcccaatgggtactcctcgaacggcgtaccgggtttccgnggacgtacgggttcggtcggtagggaacgtaggtacgttccgtaccgtcggtacccaaccgtagtaccgacgtacgtacggccgttacgtaccgtaacgttacgtaaggttaagttacgtttacgtaacgttacgttttacgttacgttgtactacgtacgtaagttataacgtacgtccgtacggtcccgtacgtaccggtacggaccggaaggaccggtaggtacgtaacgtacgtaaacgtacgtcgtacgtcgtacgacacgtatcgtcgtctacg

SEQ ID NO: 193355 - DNA, 768 bp, Homo sapiens
  misc_feature: GYAE6OF02JF4VG.10.2.A02.1.454.CMB.1.raw
  modified_base (197)..(197): a, c, t, g, unknown or other
  misc_feature (197)..(197): n is a, c, g, or t
  modified_base (346)..(346): a, c, t, g, unknown or other
  misc_feature (346)..(346): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacngccaccctctcctgcaggccagtcagagtgtggcagcaggttacgcctggtacagcaagaacgtggccaggctcccgaggcctccgtgtatagtggtgaccatcccgaccgagggccacgtggtactcctcgaggcctacgggttccgnggacgtagggtcgggttcgtagggacgtaggtacgttaccgtaccgttggtacccaacccgtagttaccgacggtacccgtaacggtcccgttacggaccgttaaacggttaccgtaacgggttaaacggtttaacggttttttacggaaccgttttaaacggttttttaaacgtttacccgttaggttacccgttaacggaccgtttaaaggttaactttaaacggttaaccggtccgtttaaccggggccccgttaacgggttaccggtttacccgggaacccggtaacggggtacccgggtacgggttacgggtaaaccgttaaccggtaaaaccggttacggttaaccgggtacgggtaccgttaacgggtaccctaaacccggttacgtttaccgtttaccggttcctttaacccgg

SEQ ID NO: 193356 - DNA, 530 bp, Homo sapiens
  misc_feature: GYAE6OF02GAXRJ.10.2.A02.1.454.CMB.1.raw
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (523)..(523): a, c, t, g, unknown or other
  misc_feature (523)..(523): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatagtggtgcatccgaccgagggcctacgtggtatccgtcgaggcagggttccgnggcaggtgggtctgggacagtagtcactgtacaccatcgagcagtcngctgtctagaagtntttgcttagtttattacgtgtctaggtaatgtgatggtctggccttcgtactacgtttcggaccgtaaggacctagtacggaactagtacgtaaacgtacttggtcgtcgtgactaccgtntcttacg

SEQ ID NO: 193357 - DNA, 577 bp, Homo sapiens
  misc_feature: GYAE6OF02GUCK7.10.2.A02.1.454.CMB.1.raw
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
  modified_base (481)..(481): a, c, t, g, unknown or other
  misc_feature (481)..(481): n is a, c, g, or t
tcagcatagtagtgcacgaccggtgctcgatttagactcatctacgagggggaggaactgctcacttaggacccagacggaaccatggaagccccagcgcagcttctcttcctcctgctactctgggctcccagactaccactggagaagtagtgatgacgcagtctccagccaccctgtctgtgtctccgaggggaaacacgcccacccgttctcctgcgagggccaggtcagagtgttggcagcaggttacgcctgggtaccagcaagaacggtcgccgagggcctaccggagtcctctcgtatcgtgcgcactccgacgacggccacgtgttactctcgacgcgtacggttccgngcgtaggtcgggtcggtacggactaagtccggtttccnggttcgtcacccgtagtcgagtcacgtcagcagtcgtagagttactttggacttagtttacttacgtgtacagtcaagtataagngtcgcggtccgcgttacgtccggacgaacgggccggtaggtagtaacgtacgaaacgacggttgcgccgtacgctaccagttccttacgtcttaac

SEQ ID NO: 193358 - DNA, 577 bp, Homo sapiens
  misc_feature: GYAE6OF02H9NLD.10.2.A02.1.454.CMB.1.raw
  modified_base (235)..(235): a, c, t, g, unknown or other
  misc_feature (235)..(235): n is a, c, g, or t
  modified_base (344)..(344): a, c, t, g, unknown or other
  misc_feature (344)..(344): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcgagggccagtcagagtgttggnagcaggttagcctggtaccagcaagaaacgtggccaggctccgaggctcctcgtatagtggtgcactccaccgagggccacgtggtactcgtcgaggcgtaggttccgnggctaggtgggtcgtagggacaggtgttacacgtgttccgaactagtacagcacgcctgacagtcgtagaacgtattttgacttagttttattacgtgttcagtctagttataaagtgcgtcggccgtcggtacgttcggaccgtaagggtaccgagggttacggaacgtttacgaaaccggtacgtacggttgaccgtacgaccgaaccgtacgtcgttacgtctttacccg

SEQ ID NO: 193359 - DNA, 516 bp, Homo sapiens
  misc_feature: GYAE6OF02FQME3.10.2.A02.1.454.CMB.1.raw
  modified_base (206)..(206): a, c, t, g, unknown or other
  misc_feature (206)..(206): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctntcctgcagggccagtcagagtgttggcagcaggttagcctggtaccagcagaaacgtggccaggctcccaggctctcgtatatggtncatccaccagggccactggtatctcaggcaggttccgnggcaggtgggtctgggacagagttcatgtcaccatcagcagctgcngtctgaagtatttgctagtttattacgtgtcagtcagtataagtcgcgtggcccgtgtaccgttcggaccgaagggtaccgaggtacggaacgttacgaaacgtacgtgtaggtcgtcgctaaccgatctgtcttaccg

SEQ ID NO: 193360 - DNA, 555 bp, Homo sapiens
  misc_feature: GYAE6OF02HJKG1.10.2.A02.1.454.CMB.1.raw
  modified_base (333)..(333): a, c, t, g, unknown or other
  misc_feature (333)..(333): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcagggccagtcagagtgttggcagcaggttagcctggtaccagcagaacgtggccaggctccaggctcctcgtatatggtgcatccaccgagggccagtggtatctcgaggcaggttccgnggcaggtgggtctgggacaggtagttcactgtacactatcagcagcctgcagtctagaagtatttgacttagtttattacgtgtacagtctagtataagtgcgtcggcccgtcgtaccggttcggaccgaacggggaccgtagggtacggtaacgttaacgaaacggtaacgtcggtacggacgttacggaccgtaaccctagtttctacggttccttaccg

SEQ ID NO: 193361 - DNA, 570 bp, Homo sapiens
  misc_feature: GYAE6OF02FJJFN.10.2.A02.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacngcccaccctctcctgccagggccagtccagagtgttggcaggccaggttagcctggtaccagcagaaacgtggccaggcctcccgaggcctcctgtatatggncatccacagggccatggtatctcgagctaggttccgnggcaggtcgggtctgggacaggacgttacacgttgtaccacctagtacagtcacgtccctgcacgtcctagaagttatttgacgttagtttaacttcgtgtctagctaagtataagtcgcgtcggacccgtacgtaccggttacggaccgaaggggtacccgtaggtacggtaacttaccgaaacgtacgtacggtaggtacctaggcctaacgtacgttctaggtccttacg

SEQ ID NO: 193362 - DNA, 612 bp, Homo sapiens
  misc_feature: GYAE6OF02IAKPZ.10.2.A02.1.454.CMB.1.raw
  modified_base (247)..(247): a, c, t, g, unknown or other
  misc_feature (247)..(247): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacacgccaccctctcctgcagggccagtcagagttgttggcagcagggttanccgtggtaccagcagaaacgtggccaggctcgacggctctcgtatagtggtcgcactccaccgagggcccacgttggtattctcgaggctacgggttccgtcggcgtaggtggggtctggggaacagtacggttcacgttcggtacaccgtatcgacgctacggacccttgccgtaggttacctagggaaccgtttagttttcggacttaagtttttactaccttggtacacggtactaggttaactaagtcgacgtcggaccgtaccgtcggttacggacggaacggcgtaggtacgtaacgtcaaaccggtagtcggtacgacgttcgggaaccctaccgtattccgttacgtccgttacccg

SEQ ID NO: 193363 - DNA, 688 bp, Homo sapiens
  misc_feature: GYAE6OF02I57ZB.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaacagccaccctctcctgcacgggccagtcagagtgttggcagcaggttagcctggtaccagcagaaacgtggccaggctccgaggctcctcgtatagtggtgcactcccaccgacgggcccaacgttggtactccgtcgaggtccgtacgggttccgtgggcctagggttcggggtcgtaggggacgtaggtacgtttcgacgtcggttaccaaccgtatccgacgccacggtcccctggacctagttcgtaggtaacggtttacgtttttcggactttaagtttttacgttacgtttcggtacgtaagtacgtaaagtttaacgttaaagttacggtaccgttccggggaccccgttaccgggttaaccgggttaccggaacccggtaaacggggacccggttagggttacgggtaaacgtttaacggaaaaccgtacggttacgggtacggtacgtacgtaccgtaaccgtagttccgttcgttccgttaccg

SEQ ID NO: 193364 - DNA, 776 bp, Homo sapiens
  misc_feature: GYAE6OF02H2DXB.10.2.A02.1.454.CMB.1.raw
  modified_base (388)..(388): a, c, t, g, unknown or other
  misc_feature (388)..(388): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtgtctccgaggggaaacagcccaccctctcctgcgagggccagtcagagtgttggcaggctaggttacgccgttaggtacccagacgaaggaaaccggtggaccgacggcctacccgaggtccttccgtcgtattagtgggtcactacgtcccgaaccgacgggtcccagttgggtacttcgtaccgagggtccgtacgggtttcccgngggccgtagggtcgggtcgtaggggaactagggtacgtttccgaacgtttcggtacccaaccgtacgtaccgtacggccgtacggtcccgttaggaccgttacggtttaccgtaaggtaaaaggttttcgtttttaggaaccgttttaagtttttaacttacgttcgttaccgtaaggtaccttaaggttaaacgttaaaggttacgggtaccggttacccggggtcccggttacgggttaacccgggttaccggggtaaccggaaacgggggtcccggttaaggggttaacggttaaaccggtttaaaccgggaggtttcggggtacggttacccgtaacggtacgtacccggttatttaccggttcgtttaccttaccgtacccgg

SEQ ID NO: 193365 - DNA, 723 bp, Homo sapiens
  misc_feature: GYAE6OF02HSPKQ.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacacgccaccctctcctgcagggccagtcagagtgttgcagcaggtagcctggtaccagcagaacgtggccaggctcccaggctccgtcgtatagtggtgcctactcccaccgagggcctacgtggtactcgtcgaggctaggttccgtggacgtaggtcgggtcgtagggactaggtacgtttccacgttcggtaccaaccgtacgttaccgaagtacccgaacggtcccgttacggaccgtaaggttccgtaaggtaaacgtttacgttttttacggaccgtttaaaggttttttacttaacggtttcgttaaccgtaacgtaccgttaaagttaacgttaaacgtaccggtaccgttcccggggtaccccggttacggttaacccggggtttacccgggaacccggtaaacgggggtacccgggtaagggttaccgggtaaactttaacccggaaaaccggtacgttcgggtaacggtaccgttacgacccgtaaccgtacgttccgttacggttacctttacccg

SEQ ID NO: 193366 - DNA, 674 bp, Homo sapiens
  misc_feature: GYAE6OF02F7A8F.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngcccaccctctcctgcagggccagtcagagtgttggcagcgaggttcgccgtggtaccagcaaggaaacgtcggaccacggcctcccgaggcctcctcatctatgatcgcactaccgaacgacgggccacgtcggacaccgtcccgacgccgtaggttcaggtcggacgtagggtcgggtcgtacggggaacacgtaccttcacctccgtacacctactcgacgactacgtacgtacgacgtccgtagtaacgttagtttacggacgttaggtttagttaagtttacggtttacggttacggtaacttaaaggtttacggtttagggttaccggttacccgttaaccgggtttagggtttaaccggttttacggggaccggtaacggggaccgtaaggtccggtaagggtaacgtaacgttaaaccgaacggttaacggtgggtacggtcgtaccgtaccgtacgttacgttccgg

SEQ ID NO: 193367 - DNA, 555 bp, Homo sapiens
  misc_feature: GYAE6OF02HNUTQ.10.2.A02.1.454.CMB.1.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (526)..(526): a, c, t, g, unknown or other
  misc_feature (526)..(526): n is a, c, g, or t
  modified_base (549)..(549): a, c, t, g, unknown or other
  misc_feature (549)..(549): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctcaggggaaacagccacctctcctgcagggccagtcagagtgttggcagcaggttancctggtaccngacagaaacgtggccaggctccgaggctccgtcgatactggtgcactccgaccaagggccctaagtcggtactcgtccgaggctaaggtccgtaggctaggtgggtctgggacaggtcgttcactcgtacnccgtaatcacgcacgcgtgctagtctagaagtagtttnacttaggttttattacgtntacagtactagtaataatagctacggccgtacgtacggtcgaccgtaagggacgtaggtagtacgtaacgaaaggtacgtggtacgngtacgctaacgcttacgtcgttnttaccg

SEQ ID NO: 193368 - DNA, 604 bp, Homo sapiens
  misc_feature: GYAE6OF02FHOP1.10.2.A02.1.454.CMB.1.raw
  modified_base (352)..(352): a, c, t, g, unknown or other
  misc_feature (352)..(352): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatggacgcagtctccagccaccctgtctgtgtctccaggggaacagccaccctctcctgccagggccagtccagagtgttggcagcaggttagcctggtaccagcagaaacgtggccaggctccccgaggtcctcctcgtatacgtggtgcatccgaccgagggcccacgttggtactcctacgaggctacggttccgngggtcaggttcgggtcgtgggacaggtagttccacttgcctaccatcagcacgtccgtacgcgtagtcgtagtaagttagttttgacttagtttactttaacgtcgtacagactagtatgtacgttacgtcggtacccgttccgtaacttacggttttcggggacccgggggtaacctacgtaccgtagggtaaactccgaaacggtccgtaacgtggttacggtcgtacgacctaaccgtattccgttacg

SEQ ID NO: 193369 - DNA, 623 bp, Homo sapiens
  misc_feature: GYAE6OF02H5FN9.10.2.A02.1.454.CMB.1.raw
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccaccctgtctgtgtctccgaggggaaacagccaccctctcctgcagggccagtcagagtgttggcagcaggttagccgtggtaccagcagaacgtgcagctccaggctcctcgtatagtgtgcatccaccgagggcctacgtggtactcgtcaggctaggttccgnggcgtaggtcggtcgngggacaggtacgttcaacgtcgtaccacgtctcgacgtcgacgtccgtgactacgtacgtacgtaaagttgttttacgcgttaagttttacttacgtcgttacaagtactaagttaataaacgtcgtaccgtccgggaccccgttacggtacggttccgggaacccgtaaggggtaacccgtaggggttaaccggtaacgttaaccgaaaccggtaacgtcggttacggccgtacggaccgtaccgtacggttacgttcgttccttaaccg

SEQ ID NO: 193370 - DNA, 698 bp, Homo sapiens
  misc_feature: GYAE6OF02HBJI5.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacngccacctctcctgcgagggccagtcagagtgtgcagctaggttacgccgtggtaccagacaaggaaacgtggaccaggcctcccgaggcctccgtcgtatagtcggtgcactcccgacgtcgggcctacgtggtactcgtcgaggtccgaggggttcccgtagggccgtaggggttcggggtaccggtaggggaaccgtacgggtttaacgttaccgtacggtttacgtacccaaacccgttagtacccgaacgtacccggactcccggtagaccgtaggtccttaaggtacgtttactttcgaacgttttaattttacgttaccgttgtacgacgtaacttaagttaacttagtcggtccgtcgggtacccgtcgggttaacgtcccgggaaaggtaaccgggaccggtaggtaacggttaaaccgtacggaaaaccggttacgttacggtaccgtaggtacccgtaacctacggttacttaccgttcgttacttacccg

SEQ ID NO: 193371 - DNA, 736 bp, Homo sapiens
  misc_feature: GYAE6OF02I8UYY.10.2.A02.1.454.CMB.1.raw
  modified_base (198)..(198): a, c, t, g, unknown or other
  misc_feature (198)..(198): n is a, c, g, or t
  modified_base (366)..(366): a, c, t, g, unknown or other
  misc_feature (366)..(366): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccaccctctcctgcaggtccagtcagagtgttggcagcgaggttacgcctgggtaccagacgagaaacggtggccaggcctcccgaggcctccgtcgtattagtggtgcacgtccaaccgacgggcccacgtggtactccgtacgacgggccgtaggggtttcccgngggtactagggttcgggtaccgttggggaactagggttacgtttccaacgtttccggtaccgtaacccgaagttccgaacggccgtaacggtccccgtttaggacccgtaacggttaccgttaagggttaaaacgtttggtttttaccgggtactttaaacgggtttttttaacttaaccggtttcggttacctaaagggtaccgttaaacggttaaattaaacgttacggtcggttacccgggtaccccggtacgggttaccggttaccggaacccggtaaacggggccggtaacggtaggttaaacgtaccgtaaaacggtcggtaaggttaggcctacggtaccacgtacgttcgtcgttactaccg

SEQ ID NO: 193372 - DNA, 670 bp, Homo sapiens
  misc_feature: GYAE6OF02G28LJ.10.2.A02.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
tcagcatagtagtgcacgaccggtgctcgatttagactcatctacaggggggaggaactgctcacttaggacccagacggaaccatggaagccccagcgcagcttctcttcctcctgctactctggctcccagataccactggagaagtagtgatgacgcagtctccagcccacctgtctgtgtctccgaagggaacncgcccaccctctcctgcgagggcctagcagngtgtgcagctaggtcncgtggtaccagactagaacgtgccaggcctccgaggtcctccgtcgatacgnggtncgtacnccgaccgacgggacctacgttggacttcgtacgacggtcgtacggtccgtaggcgtgggtcggtcggtagggacctaggtacgtttcgacgttcgtaccaaccgtagttccacgtccgtacgacccgtggtacctacggttcgtaagtaacggttacttttcggtaacctttaacgttttaacgtttacgttagttaaccggtagttacgtaagtaatacgtagtaccggtccggtccgtaccgggttaccggttaccggaaccgaacggggtaccgtacgggtacggttaaacgtaaccggaaaccgttaggtacggtaccgtacgtaccggactaccgtacgtacgttcgtaccgttaccc

SEQ ID NO: 193373 - DNA, 830 bp, Homo sapiens
  misc_feature: GYAE6OF02JDXHJ.10.2.A02.1.454.CMB.1.raw
  modified_base (217)..(217): a, c, t, g, unknown or other
  misc_feature (217)..(217): n is a, c, g, or t
tcagcatagtagtgcacgaccggtgctcgatttagactcatctacgagggggaggaactgctcacttaggacccaggacggaaccatggaacgccccagcgcagcttctcttcctcctgctactctggcctccagactaccacgtaggagaagtagtgagtcgacgcacgtctcacgccacctgtctgtcgtctacgagggaacacgccacctctcngcgacggcagcagagtcgtgacagcgtaggtacgccgtcgtaccgagacgtaacggaacggtcggaccgaacggtccctacccgacgggtaccctaccgttacgtaacgttcggttacggaccgtaccgttaacccggtacccgggaacccccgggtcgtaaccgggtttcggtttacctaccgttaccgggtaacggtaccggttacgggttaaccggtggttacccggggaacgtagggggttcgggttaccgtaggggtacccgtaacggttaccctttaccgtacccgttccggttaacccacccgtaccggtaccccgaacccggtttaccgaaaccggtacccggttaaacgttcggttaaccttttaacggtacgtttaacggttttcccgtaacgttccgtactaccgtacgtacgttcggttaacgccggttaccgttcccggtccgttaccccgtttaccccgtccggttttaacccgaccgggttcccggggaaaggttaacccggtaacgggtaggttacccgggataccgaaccggttaacggtacggtcgacgggttctaccggaaccttgtaccggtaccgttcgtcccgtttaaccg

SEQ ID NO: 193374 - DNA, 701 bp, Homo sapiens
  misc_feature: GYAE6OF02H06OG.10.2.A02.1.454.CMB.1.raw
  modified_base (233)..(233): a, c, t, g, unknown or other
  misc_feature (233)..(233): n is a, c, g, or t
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccagcccacctgtctgtgtctcgaggggaacacgccaccctctcctgcagggccagtcagtagtgtcgcngctaggttagccgtggtaccagtacaacggaaacgtggcctaaggctacccgaggctccgtcgtatagtggtacgcactccgacgacggccctacgtcggttatccgtacggacggccgtacggtttcccggtgggacctagggtcgggtcgtaggggaactaggtcggttacgaacgtcggtacctaaccgattaaccgagtccgaaccgccttacggtccgaaggttcggtaacgtaacgttagttttacggacctttaagttttacgttacgttacggtacctagtaccgtaagttaaacgttaagtacggtacccgtcgggtacccggtacggttaaacccggttccgggtaaccggtaacggggtaccggtaacggggtttcggtaaaccgttaaccgtaaacccgggttagtcggtacggtaccgtcggtacctaccggtacgttcgttacgttccgttacg

SEQ ID NO: 193375 - DNA, 644 bp, Homo sapiens
  misc_feature: GYAE6OF02FSC5R.10.2.A02.1.454.CMB.1.raw
  modified_base (194)..(194): a, c, t, g, unknown or other
  misc_feature (194)..(194): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctcagggaacngccaccctctcctgcaggccagtcagagtgttggcagcaggttacgctcggtacagcaaggaaacgtggccaggcctcccgaggcctccgtgtatagtggtgcactccgacgaggccagtgtactctcaggctaggttccggtggctagggttggtcggtagggactacggtagttccgacgttcgaccaccgtagtcgacgacgtacgtcctaggcctacggttcgtagtaagttcgttttagtaccgttaagttttattaccggttcgtactacggtacgtaaagttaacgtaagttcggtcccttacgggccgttaccgggtaccgttacgggtaccggaaacggggttacccgagggttacggttaaaccgttaacggaaaaccggttaacgttcgggacggtacctacggtacctaacccgtagttcccgttagtcttaacccgg

SEQ ID NO: 193376 - DNA, 833 bp, Homo sapiens
  misc_feature: GYAE6OF02I3R14.10.2.A02.1.454.CMB.1.raw
  modified_base (199)..(199): a, c, t, g, unknown or other
  misc_feature (199)..(199): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgcagtctccagccacctgtctgtcgtctccgaggggaaacngccaccctctcctgcacggtccagtcaggtagtgttcggcaggcgaggttcgccgtgggtaccagcgaagaaacggtggaccacgggtcctcccgaggccttcccgtagtacgtagttggtcgactaacgtcccaaccggtacgggaccctacgttcgggtactccgttacgacgggtccggtaacggggtttcccggtagggtaccgtaggggttcggggttaccggtaggggtaaccacggggtacgtttacccgacgtttaccggtacctaaaccgtagtacccgaacggttaccgacggttccccgttagggaccgttacggttaccgtaacggttaaacggtttaacgtttttcggtaacgttttaacggtttttaacgttaccgttaggttaccgtaagtaccgttaaggtttaaacttacggttaccggtcgttaccgggaccccgggttacggttaacccggggtacgggtaacccggtaaaccgggggtaccgggttaggggttaaccggtttaaccgttaaacccgggtaaaccgttaccggggtaaacggtttccgggaaccggtttacggaacccgttaaccggttaccggttacccgtttacggttaccccgtttaaccgg

SEQ ID NO: 193377 - DNA, 831 bp, Homo sapiens
  misc_feature: GYAE6OF02JIHO1.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacgagggggaggaactgctcacttaggacccagacggaaccatggaagccccagcgcagcttctcttcctcctgctactctggcctcccagataccacgtggagaagtgtgatgacgcagtctccgagccacctgtctgtatctcgaagggaacncgccacctctcctgcgaggtccagtcgagtgtcgtaggcaggcgtagttcgccgtaggaccagcgaagaacgtcggcgacgccgtccgacggtctcgttacgtagtacgtcggtcgccgtaactcccgaccgtaccgggtaccttaccggtcggttaaaccgttccgtacggtaccggtacggttaaccgggttccggtacggaccggtacggttcgggtaccggtagggaacgttacggtacgttacgtaccgttaccggtaccgtaacgtacgttaccgtacggaccgtaacggtacccgtcgtacggttaccgtaaccggttagtttaacgttaccgttttacggtacgtttaacgttttaacgttaaccggttacgttccgttaaaggtccgttaaaagtttaacggtaaccgttacggtaccgtttaccgggtaccccggttaaccggttccgggtttaaacccggtaacccggggtaaaccggggtacccggttaaaccgggttacggttaaaccggtttaaacccgggtaaaaccggttacgggtttacggtaccggtttaccgtaaccgggtacccgtttaaacccggtccggtttaacccgtttacgtttcccggtttaacccg

SEQ ID NO: 193378 - DNA, 694 bp, Homo sapiens
  misc_feature: GYAE6OF02F31YR.10.2.A02.1.454.CMB.1.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccacctgtctgtgtctccgaagggaacngcccaccctctcctgcgaggccagtcagtagtgttggcagcgtaggttagcctggtaccaggcaacgaacggtggccaggcctcccgaggtccttccgtacgttataggtggtacgctactccgaaccgcgggcctacggtggtactcgtcgaggccgtacgggttccggnggcgtagggtcgggtcgtgggaactaggtacgttcgaacgtcggtaccaaccgtacgtccgacgtaccgacgtcccgtagtacgtacggttaccgtaggttaacgtttacgttttcggtactttaaggttttacttaccggttgttacgtaacgtacgtaacgtttaaagtaacgttcggccgttaccgggcccggttacggtaccgggtaccgggacggaaccggggtacggtagggtacggtaaaccgtaacggtaaaccggtacgttacggtcggtaccttacgggaccctaaccggtgttaccgttacgtttaccttacccg

SEQ ID NO: 193379 - DNA, 699 bp, Homo sapiens
  misc_feature: GYAE6OF02H2WOF.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctctgcaggccagtcagagtgttggcagcaggttagccgtggtaccagacaaggaacggtggccgaggcctacccaggcctccgttacgtacttagtgggtcacgtactccaccgacgggtcccaacgttcggtactccgtcgaacggcgtacgggtttcccgtgggccgtagggttcggggtccttaggggaacctagtacgtttccgacgttcgtaccaacctacttccgaacggcaacggtccccgtaggtcccgtacggttcgtaagggtaaacgttacgtttttacggtacttaaggttttttaacttacgtttagttacccgaagtacctaagttaattaagtacggtacgttccgggcccgtacgtaccgggttaccggaacccggtaaggggacccgtagggtacggtaacgttaacgaaacggtacgttcggtaacggtcgttacggaccgtaaaccgtcgtttaccgttcgtcctttaacccgg

SEQ ID NO: 193380 - DNA, 768 bp, Homo sapiens
  misc_feature: GYAE6OF02JMZ3H.10.2.A02.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagcatagtagtgcacgaccggtgctcgatttagactcatctacagggggaggaacgtgctcacttaggacccagacggaaccatggaagccccagcgcagctctcttcctcctgcctactctggctccagactaccactggagagtagtgagtgacgcgacgtctccagcccacctgtctgtcgtctccgagggaacncgccaccgtctccngcacggccagtcagagttgtgcacggcgaggttacgccttaggtaccaggcgtaagtaacggtggacccagggtcctaccccggaggacccttccgtacgttaacgtaggtcgggttacgcgtaacctcccgaaacccggcggggtacccctaagtttacggggttacctccgtaacggaaccggtccggttaaccggggttccgtcggggacctttaggggtccggtaccgggtacgggaactagggtacgtttcgaacccgttgtacccgaccggttaaccgtacggacctacggtcgtcggtaccgttaacgtacgtacggtaagttaccgttttaggtaccgtttaaggttacctttacggttacgacgtacggtcggtaaacgttacgtaacggttacgtaccgtaccgggtacggtacccgttaccgggttccggaaccgggtaaccgggtacggggtacgttaacgggtaccgttaaccggtaaacggtacggtaggtacccgggtaagttccggtaaccacgttctacccggtattttcgtaaccg

SEQ ID NO: 193381 - DNA, 706 bp, Homo sapiens
  misc_feature: GYAE6OF02GIQIG.10.2.A02.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaacngccaccctctcctgcgagggccagtcagagtgttggcagcgaggttacgcgtggtaccagacaaggaacgtggaccaggcctcccgaggtcctccgttacgtatagtggtacncctacgtcccacggacgggcctagtggtactctacgaggctacgggttccgtggtcgtagggttcggggtcgtacggggtactacggtacgtttaccacgttcgtaccacccgtagtccgacggtacgaccggtcccttaggaccgtacggttctaagggtaacgttagttttacggacttttaaaggtttactttacgtgtaccgaagttacgtaagttaaacgtagttacggccgggttaccggccccggttagtaacccgggttaccggaacccgggaaaggggtacccggtagggttacggtaacgttaaccggaaaacggtccggttaggtacgggtccgttaacggcccgttaaacccgttagtttcccgttacggttaccctttaccgg

SEQ ID NO: 193382 - DNA, 751 bp, Homo sapiens
  misc_feature: GYAE6OF02IR87R.10.2.A02.1.454.CMB.1.raw
  modified_base (198)..(198): a, c, t, g, unknown or other
  misc_feature (198)..(198): n is a, c, g, or t
  modified_base (411)..(411): a, c, t, g, unknown or other
  misc_feature (411)..(411): n is a, c, g, or t
tcagcatagtagtgcacgaccggtgctcgatttagactcatctacagggggaggaactgctcacttaggacccagacggaaccatggaagccccagcgcagcttctcttcctcctgctactctggctccagataccactggagaagtagtgatgacgcagtctccagccaccctgtctgtcgtctccgaggggaaacncgccaccctctcctgcgacgggccagtcagaggttgttcggacagcgtaggttacgccgtcggtaaccaggacgaaggtaaacgtcgaaccgaacgggtcctaccccgacggccttaccgtacgttaagtacggtgggtaccacgtttaccacccgtaaccggacgggtacctacggtcggtaactccgtacgacgggtccgtacggttccgnggtacgtagggttcggtcggtagggacgtacggttacgttaccagttccgtaccgaaccgtagtcgacgcgtacgtccgtcgacgtagttacgtaagtaacgtttacgtttacgtacgtttaagttttacgttacgtacgttcgtacgtacgttaagttaagttaaggtccgtacggttccgggaccgttacggttaccggtaacgggaacccgggtaacggggtaccggtaggttaaccggttaaacgttaaacggtaaccgggtacgtttacgggaccggttaccgtaccggtaccggttaaacccgttacggtttccgttaccgtttaccgttaccg

SEQ ID NO: 193383 - DNA, 665 bp, Homo sapiens
  misc_feature: GYAE6OF02FMXR6.10.2.A02.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacacgccaccctctcctgcagggccagtcagagtgttggcagcgaggttgcctggtaccagcaagaacgtgaccaggccnccgaggcctcctcgtaatagtcggtncgtactccgaccgcgggccaacgtggtactctacgaggcgtaggttcccgtaggcgtagggtcggtcgtagggacgtaggacgtttcacgttcggactaccgtatcgacgcgagtccgtgacggtacgttagtaacggtaaattacgtttacgtacgtttaacgtttaacgttacctgttaccgagtacgttaaagttaattaagttccggttaaggttttgggttttaactttccgtaaccgttttccggacccgtacgggttaaacgttacgggtagtttaacgtttaacggaacgttaaaccggtaacggtttaggtacggttactacgtacccgtacgtaaccttcggttaccctttaccg

SEQ ID NO: 193384 - DNA, 703 bp, Homo sapiens
  misc_feature: GYAE6OF02H0U5M.10.2.A02.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (683)..(683): a, c, t, g, unknown or other
  misc_feature (683)..(683): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtctctcgagggaaacngccacctctctgcagggcctagtcagtagtgtggcagngaggttanccgtggtaccngtacaaggaacggtggccgaggtcctcccgaggtccttaccgtgtacttagtggtacgcgacgttcccgacgacggtccctagttggtactcgtcgacggtcgttcgggtccgtggccgtagggtcgggtcgtagggtacacggtacgttacctacgtcggttaccaaccgtagtcgaacggcctacggtcccgttaggccgttaggttaccgtaaaggttaacgtttacgtttttcgaaccggttttaagttttacgtttacgttacgttactaacggtacctttaaggttaaacgttaacgtaccgggtcgtacccggtcccggtacgttaccgggttaccgaaacgggtaccggggtacggtaggttccgtaacgttaacccggaaaggtacggtcgttacggacgttcgaacccggtattaccgttnttacccggttaccttaccgg

SEQ ID NO: 193385 - DNA, 748 bp, Homo sapiens
  misc_feature: GYAE6OF02HKE6H.10.2.A02.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctcgagggaaacngccaccctctcctgcagggccagtcagagtgttggcagcgtaggttagccgtggtaccagcaagaacggtgccgaggcctccgaggcctccgtgtatagtggtnactactcccgaccggacgggccctaacgttcggtactccgtacgacgggtcctacggggttcccggtggtcgtagggttacggggttcgtaggggaactaggttacgttccgacgttcggtaccaccgtagtaccacggcacggtcctagaccgtagtaccgttaaggtaacgttaggtttttcgacgtttaaacgtttttacttaacggttcgttacgtaacggtaccgttaaagttaaacgttaacggttacgtacccggttaccgggtacccccggttaccggggttaacccggtttacccggggaaccggttaaaccgggggtaccggtacggggttaaacggttaacccgtttaaacggaaaccgggtttacgttacggggttaccgtaccgttacggacccgaaccgtttacgttccggtttaccgttccccgtttaacccg

SEQ ID NO: 193386 - DNA, 680 bp, Homo sapiens
  misc_feature: GYAE6OF02IDPYO.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggcctcccagactaccactggagaagtagtgatgacgcagtctccagcccaccctgtctgtgtctccgaggggaacacgccaccctctcctgcacgggccagtcagagtgttggcagcgaggtacgcctggtaccagacaaggaaccgtggccaggcctcccgaggcctccgtagtactagtggtacgcactccgaccgcgggccacggttgtacttctacgacggcgtacggttccgcggtcgaggtcggggtcgtgggacgagtacgttccacgtcggtaccacctagtaccgagccgtacgtccccgttaggacctaggttcgtaaggttaacggttagttttttacggaccgtttaagtttttacttacgttacggttcgtaagtaacttaagttaacgttaaagttcgtacggtccgggtaccccgtacgggttaccggtacccgggaccggtaacgggtaccggtaggttaacggtaacgttaaccggaaacggtacgttcgggacgtacgacgtaccgaacccgttgttccgttaccggttaccttaccg

SEQ ID NO: 193387 - DNA, 871 bp, Homo sapiens
  misc_feature: GYAE6OF02H4M0P.10.2.A02.1.454.CMB.1.raw
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
tcagcatagtagtgcacgaccggtgctcgatttagactcatctacagggggaggaactgctcacttaggacccagacggaaccatggaagccccagcgcagcttctcttcctcctgctaccctggctcccagactaccactggagaagtagtgatgacgcagtctccagcccacctgtctgtcgtctaccgagggaaacncgcccacccttctcctgcgacggaccacggtcaggagttcggtggaccagacgtacggttacggccttacgggtaccaggactaaggaaccgtggaccgacgccgtacccgaggtcctccgttactagttacgtggcncgtacncctaccggacggcctacggtgtatccgtacggcggtacgtacgggtttcgcggtcgtaggggtttcgggacggttacgggaacacgggttacgttaccgtacgtaccgtcccgtaacccgtagtaccgacgggccttacggacccgtttagccgttacggttaacggttaaaggtaacgtttaccgtttacgtttaacggtttaagtttttaaaccttacgggttacggtaacctaacggtaacgtttaaacgggtttaaataaagggttcccggttccccggggaaccgggttacccccggtaaccggggtttttaaaccccgggaaccccgggggtaaacggaaaacccgggggggttccgggttaaaagggggtttaccccggttaaaaacccgtttaaacccggggtaaaaccgggtttcccgggttttaggggaaacccgggttttacctacccgggaacgtaaccccgtttaccggttttaacgttacccgggtttttacccaaaccgtttttcccccggg

SEQ ID NO: 193388 - DNA, 637 bp, Homo sapiens
  misc_feature: GYAE6OF02JZ605.10.2.A02.1.454.CMB.1.raw
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (486)..(486): a, c, t, g, unknown or other
  misc_feature (486)..(486): n is a, c, g, or t
tcagcatagtagtgcacgaccggtgctcgatttagactcatctacagggggaggaactgctcacttaggacccagacggaaccatggaagccccagcgcagcttctcttcctcctgctctctggcctacccagtatacccagtggagaagtagtgatgacggcaagtcaccaggccctaccctgtcnggtntctccgaagggaaacccgccacctcncgagcgcggctagcgagtgtgtcgacnggacgtagtcgccgtaggtaccagacgaagtacggcgaccgtcggccctccgagtcctacgtagtagtgngtacnctaccgccgacgtacggtcctagtgtctcgacgngcgttcgggtcgagtcgtaggtcggtagnggtacgaggttactccgagtcggtcctaacgtctacgacgtacgcgtccgtgcgttacgtacgttaacggtagtttgttacgtaagtttacgttacgttacgtntacgagtacgtaagttaacgtacgacgtcgtaccggtaccgtacggtaccgtacggaaccgggtaaccggtaacggtaggtacgtaacgtaaccggtaacgtcggtacggtacgtcgtacgaccgtaacgtgttaccgttcgttaccgtcg

SEQ ID NO: 193389 - DNA, 779 bp, Homo sapiens
  misc_feature: GYAE6OF02H3GI2.10.2.A02.1.454.CMB.1.raw
  modified_base (121)..(121): a, c, t, g, unknown or other
  misc_feature (121)..(121): n is a, c, g, or t
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
tcagcatagtagtgcacgaccggtgctcgatttagactcatctacaggggaggaactgctcacttaggacccagacggaaccatggaagccccagcgcagcttctcttctcctgctactcnggctccagataccactggagaagtagtgatgaacgnagtctccagccaccctgtctgtgtctccgagggaacagccaccctctcctgcagggccnggtcagaatgttcggcgccgttcaagctggtaccaacacaaaacctggccaggctcccgaggcccctcgactcctaatggttcgctacgttccgaaacgacggggaccccaacttcgggacctacgttaccccgtacgaccccgtaagggtttccaacggttcgggaccaggtttaacggggtaattcgggggaaactacgggtaaccttttacgaaccgtttaccgtacctaaccgtaactccgtaaactccgaaacggccccgttaagggtaaccgtacccgttaacggtaaacggaactttcgggtacggttaaccggttaacgtttttaacccgtttaagtaacccgtttaacctaaacgtacgttaaccgggttaccggtaaaccggtttccggggacccggtttaacccggggggcccttaaaccggtttttcccgggaacccggttaaacgggtaaaccccgaaaaggtttacggaacgtactaaccggaaaacgttacgtaccgggtacgtaacctcggaacgtacctaacgttccttcggtttctaccctaccg

SEQ ID NO: 193390 - DNA, 652 bp, Homo sapiens
  misc_feature: GYAE6OF02G5AH5.10.2.A02.1.454.CMB.1.raw
  modified_base (258)..(258): a, c, t, g, unknown or other
  misc_feature (258)..(258): n is a, c, g, or t
  modified_base (520)..(520): a, c, t, g, unknown or other
  misc_feature (520)..(520): n is a, c, g, or t
tcagcatagtagtgcacgaccggtgctcgatttagactcatctacgagggggaggaactgctcacttaggacccagacggaaccatggaagccccagcgcagcttctcttcctcctgctactctggctcccagataccactggagaagtagtgatgacgcagtctccagccacctgtctgtgtctccgagggaacacgcccaccctctcctgcgacgggccagtcagagtgtggcaggctaggttagccgtggtaccngacaagaacgtgccgagctcccgagcctcttcgtatgtgtcgactacgaccacgagggcctaagttcggacttccgacgagggtccgtacgggttcccgagggccgtaggggttcgggttaccgagggggaacctaacgggttcgtttacccgaacggttttccggacctaacccggtattacgacggttccgaacggtccgttacgccgtaagttcgttaacgtaacgttagttttcggtactttaaggtttactttacgngtacctagctaagtataacgtagccgttaggcccgtaggttaccggtacggacgaacggggtaccgtaggtacgaagttacgaaccggtacgtgcggtactcggtaaccgtctactaccgttgcccttaccg

SEQ ID NO: 193391 - DNA, 648 bp, Homo sapiens
  misc_feature: GYAE6OF02JL79P.10.2.A02.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactgganaagtagtgatgacgcagtctccagccacctgtctgtgtctccgagggaaacngcccacctctcctgcgacggccagtcagnggtcgttggcagctagggttcgccgtcggtaccacgtcgaacggtaacggcgaccgacggcctcccgacggtccttacccgttaccggtagtacgtggtcgacctactcccgaccgacgggcctacgtggtactcgtacgacggtcgtacggtcgtaggcgtaggtcgggtcgtacggacgtaggtacgtcgacgtcggtacctacactcgtacgcgacggtctcggctagtcgacggttaatttcgtttcggacttagtttaactttacgtcggttacagtacgaagttacgtagtcggaccgttcgtcccggaacgttacgggttacccgacggggtaaccggacggttacggtaacgtacgtaaccggtaacgtacgtacggcgtacgtacgcccgtactcggtacgttcgttcgtaccg

SEQ ID NO: 193392 - DNA, 830 bp, Homo sapiens
  misc_feature: GYAE6OF02FME36.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacagccaccctctcctgcgagggccagtcagagtgttggcagcgaggttacgccgtggaccagcaagaaacgtggccaggctcccgaggcctcctcatctatgactgcactaccaacgacgggccacgtcggctactcccagccgtaggttcaggtcggacgtaggttcgggtacggtaggggaacctacggtaccttccgtaaccgtttccgttacccaaccgtacttaccgaacggtaccgtaaacgttaaccgtacggtaaccgtacccgttaagggtaaacggttttaacgtttttacgggaccgtttaagggtttacggtttaaacgtttttacggttttacgggtaccgggttaacttaaaagggtttaacgggttttacgggggtttaaaccgggtttacccgttaaacccgggggttttaacgggggttttaaacccggttttttaccggggggaaaccccggggttaaacggggggttaacccgtaaaacggggtccgggtttaaacgggggtaaacgttaaacccggtttaaacccgggaaaaacccgggtttaacggtttacggggttacccgggttaacccgttaccgggtaaccccgtttaaccgttacccggtttacccgg

SEQ ID NO: 193393 - DNA, 725 bp, Homo sapiens
  misc_feature: GYAE6OF02GRG29.10.2.A02.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctccagactaccacgtggagaagtagtgatagacgcagtcctaccacgcccaccgtgtcctggtcgtcnccggaagggaaacacgacccaacccgtctaccgtcgacgacggaccacgtacgagtagttggtcgganacgcgtaggttacgcctggtaacncganaacgaacgtcggacacggacctccgagtacctctacgtaacgtagtcggtgaacctacgtaccgaccggtacgggacctaggttagtactccggtaacagggtacctacggttccggtaggtaactcggtcgggtaacggnggtaccggtaagtaacggttcacgttacggtacaaccggtttanaccgtcgacgacgtccgactacggtaatccggtagtaaacgttcgtttacgtaagtttccgtttaagtaacgttgttaacgacgtatagttaaatacggttacgcgtaccggtccggtacggtaccgtaaccggggtacgtaaaccgggggacgtttacggggaaccgtttaccgaaacggtaaccgttaagggcgtaaccggtttgaacggtcctaacccgttagtaacggttcccttacgttacccg

SEQ ID NO: 193394 - DNA, 826 bp, Homo sapiens
  misc_feature: GYAE6OF02ILVXW.10.2.A02.1.454.CMB.1.raw
  modified_base (215)..(215): a, c, t, g, unknown or other
  misc_feature (215)..(215): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccaccctgtctgtgtctcgaggggaacacgcccaccctctcctgcncgggccagtcagagtgttggcagctaggttacgccgtggtaccagtcgaaggtaaaccggtcgggccacgggcccttaccccgagggtccctccccgttcggttaacgttacggttcggggtacgaccgtaacgttaccccgaaccggtacgggggtaccctaacggttcggggtaaccttccgtaccgggtacggtaccgggtaccggggtttcccggtacgggaccggttaacgggggttcgggtacggtagggggtactagggttactttaccggtacgttaccggtacctacccgtagttcccgaacgtaccgaacgggtcctacggaccgttacgtttaccgtaacggttaagtttaacgtttttacggtaacgtttacgtttttaacgtttacgttcggtacgtaacgtaacgttacgttaaagtacgttacggttacgtaccggggttaccccgtagggttaaccggttacccggggaacccgggtaaacggggtaccgggtaaggggtttacggtaaacgttaacccgggttaaaacggtccggttaggtacggttcgttaaccggaccgtacccgtagttccgtttcggttacccttacccg

SEQ ID NO: 193395 - DNA, 675 bp, Homo sapiens
  misc_feature: GYAE6OF02GJ2RZ.10.2.A02.1.454.CMB.1.raw
  modified_base (198)..(198): a, c, t, g, unknown or other
  misc_feature (198)..(198): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgaggggaaacngccaccctctcctgcgagggccagtcagtagtgttggcagctagggttacgccgtggtaccagcgaaggaaacggtcggaccagggccctacccgagggtcctcctacggtatagtcggtgacactccgaccgagggccacgtggtactcgtacgacggtctacgggttccgaggctagggtcggggtcgtaggggacaggtacgttacgtacgtcggtaccaaccgtacgtcgaacgtaccacggtccgtaggaccctaggttacgtaggtaacgttagttttacggacgttaaggttttacttacgtcgttaccaggtactaagttataaacgtcgtaccgtccggacccgttacggtaaccgttccggaacggtaacggggtaccgtagggttaacgtaacgttaaccggaaacggttacgtacgggtaggtaccgtacgccgtaaccgtacgttccgttacgttacttacccg

SEQ ID NO: 193396 - DNA, 631 bp, Homo sapiens
  misc_feature: GYAE6OF02JIC1U.10.2.A02.1.454.CMB.1.raw
  modified_base (106)..(106): a, c, t, g, unknown or other
  misc_feature (106)..(106): n is a, c, g, or t
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
tcagcatagtagtgcacgaccggtgctcgatttagactcatctacagggggaggaactgctcacttaggacccagacggaaccatggaagccccagcgcagcttcncttcctcctgctactctggctcccagataccactggagaagtagtgatgacgcagtctccagccaccctgtctgtgtctccgagggaaacngccaccctctcctgcacgggccagtcagagtgttggcagcaggttagcctggtaccagcaagaacgtcggcctaggcctccgaggcctacccgtgtatagnggtnctactccaccgaggaccctagtggtactcgtcgacggctacgggttccgtggccgtaggtcgggtacgtgggactaggtcgtttccgaactcggtaccaaccgtatccgagtaccgacgtcgttcgactacgttacgacggtaagttcttttacggcgttaacgttttattaccgtggtactagtaccgtaagttacgttaatacggtcgttaccgggacccgtccgggttacgttccggaccggtaacggggaccggtagggttacgtaacgtacgtaaaccgtagtcggtaggtcctcgaccgaccttagtcgttacttcgtacccg

SEQ ID NO: 193397 - DNA, 638 bp, Homo sapiens
  misc_feature: GYAE6OF02JW7UO.10.2.A02.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
  modified_base (395)..(395): a, c, t, g, unknown or other
  misc_feature (395)..(395): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
tcagcatagtagtgcacgaccggtgctcgatttagactcatctacagggggaggaactgctcacttaggacccagacgaaccatggaagccccgagcgcagcttctcttcctcctgctactctggctccagataccacgtggagaaggtagtgatgacgctagtctccagcccaccctgtctggtacttcctccgaggggaacagcccacctctcctgcgacgtccntcgagtagttgtagngacgtcgaggttacncgttacgtaccgagacgagtaaccggtggccaggtcctaccgacggtcctaccgttgtacgttacgngttaccgctacgaccgaaccggtcgggaccttcgttacgacgttccgtacgaggtacggcggtttaccggnggcgttaacgggttggggtacctacgggtacgtacggcttttaccgacgtacgttcaacggtntaccgacggtacncgttacgttgccgtaagngttaacggtaattcgttancgtttaattcgtatcgactcgtatagattagcgcttacgccgtggtaatccgaaggccgtagggacgtagacctaacgggtacaggttcgtaggcccttaggaccgtacttgggtacttcgtacgttccg

SEQ ID NO: 193398 - DNA, 699 bp, Homo sapiens
  misc_feature: GYAE6OF02FT38G.10.2.A02.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (665)..(665): a, c, t, g, unknown or other
  misc_feature (665)..(665): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccacctgtctgtntctcgagggaacngccacctctctgcaggccagtcagagtgttggcagcgaggttacgccgttggtaccagcgaaggtaaaccggtcggaccgtacggcccttcccgagggtccccttaccgtacggttaactaggttcgggtcgacccgtacgttaccccgaaccggtacggggtacccctaacggttcgggttacttccgtaccggtacgggcgtaacggggtttcccgngggtacgtagggttcgggtacgtcggggaactagggttacttacncgttacggtccaacctagtcgacgcgacgccgtcgtcgacgttcgtagtaagttacgtttcgactttaagtttacgttacgttcgtactacgtacgtaagttataacgttcgtccgtccggtacccggtagttaacggtccggaacgggaacgggtaccggtgggtacggtaaccttaacgggaaacgtcgttacggtacggttacncggtaccttacgtacttcgttacgtccttaaccg

SEQ ID NO: 193399 - DNA, 750 bp, Homo sapiens
  misc_feature: GYAE6OF02FJ3WI.10.2.A02.1.454.CMB.1.raw
  modified_base (197)..(197): a, c, t, g, unknown or other
  misc_feature (197)..(197): n is a, c, g, or t
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccgagggaaacngcccaccctctcctgcacgggccagtcaggagtgttacgctactttcggttagggtgtatcaactataaacgtccggaccaggcctccccgaggcctacccgtctaacgttcgttttagacgttcgtccttttaccaaccgtaccggggtccccctgggtcccggtccccgaagggtccggtaacggttccggaggttcgggtaccggtaggttcgggggtccgttacgggggacctaacgggtaccctttacgaccttccgtaccaaccgtacgtaccacgaccgacgtccgtaacgacgtccgtaaggtagttaacttttcggacgttaaggtttacttacttgttactaggtcacggtcgtcgacccgttcggttccgggacgggtacggtccgtaccggttacgggtttaccgggaacgggtaacgggtaaaccgttaaaaggtacggtaacgggttaaaccgaaaccggttaaccggttacgggtccggtacgtaccggtaccgaaccgtaccgttgttaccgttacctttccgtaccgttcccccgg

SEQ ID NO: 193400 - DNA, 617 bp, Homo sapiens
  misc_feature: GYAE6OF02F2OOK.10.2.A02.1.454.CMB.1.raw
  modified_base (120)..(120): a, c, t, g, unknown or other
  misc_feature (120)..(120): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (490)..(490): a, c, t, g, unknown or other
  misc_feature (490)..(490): n is a, c, g, or t
  modified_base (585)..(585): a, c, t, g, unknown or other
  misc_feature (585)..(585): n is a, c, g, or t
tcagcatagtagtgcacgaccggtgctcgatttagactcatctacagggggaggaactgctcacttaggacccagacgaaccatggaagccccagcgcagcttctcttcctcctgctacnctggcctcccagataccactggagaagtaggtgatgacgcagtctccagcccaccctgtctgtgtctccgaagggaaacacgcccacctctctgccgaggcagtcagtgtgtgcngnaggtcncctggaccagcaagaacgtgccaggcctccgaggccttccgtgttaataggtggtcgacactcccgaacggcgggtacctacgtcggttacgtcctacggaggccgtaacggtttccgggacggcgtagggttcggggtctacgggggaacaggtacttacgcttacgacccgacctagtcgagtacgacgcctagtactagtaccgtagtaaggttcttagtacgttaagtttatacgttgtaacngtactaaagttacgtagtccggtacgtcggtaccgtgtaccgtaccggaacgaacgggtcgtacgtagaacgttaacgaacgtaacgtgtaccgngttaccgactacgtgtaccgtcttacgtaccg

SEQ ID NO: 193401 - DNA, 696 bp, Homo sapiens
  misc_feature: GYAE6OF02GHIEO.10.2.A02.1.454.CMB.1.raw
tcagcatagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagcccacctgtcctgtgtctccgaggggaaacacgccaccctctcctgcagggccagtcagagtgttggcagcaggttagcctcggtaccagcgaagaacggtcggaccgaggccctcccgaggcctccgtcgtagtacgtggtcgcactcccgaccggtacgggccctacgtcggtactcgtacgacggtcgtaccgggttccggtgtcgtaggttcggggttcgtagggggactaggtacgttaccgtacgttcggtaccctaaccgtacgtacgacgtaccgacgtccgtagacgtacgttcgtaaggttaacgttacgttttcgtaccgtttaagttttaacgtttacgttcggttaacgtacggtacgtaagttaacgttaaagtcgggtaccgaccgggtcccgtaccgggttaaccgggttccggaaccgggaacggggtaccggtagggtacgtaacgttaaccggaacggtacgtaaggtcggtactacggccctacggtactcggtaccttacgttaccg

SEQ ID NO: 193402 - DNA, 736 bp, Homo sapiens
  misc_feature: GYAE6OF02FMU0R.10.2.A02.1.454.CMB.1.raw
  modified_base (320)..(320): a, c, t, g, unknown or other
  misc_feature (320)..(320): n is a, c, g, or t
tcagcatagtagtgcacgaccggtgctcgatttagactcatctacaggggaggaactgctcacttaggacccagacggaaccatggaagccccagcgcagcttctcttcctcctgctactctggctcccagataccactggagaagtagtgatgacgcagtctccagccacctgtctgtgtctccgagggaaacagccaccctctcctgcgacgggccagtcagagtgttggcagctaggttacgccgttggtaccaggcgaacggaaacgttcggaccagggcctacccgagggtcctccgtcgtattacgtgggtacncctacgttcccgaaccgacggggtacccaacggttggttactcgtacgacggtccgtacggggtttccgtgggaccgtagggttcggggttcctacggggactaggtacgtttaccgacgttcgtaccgaaccgtagtaccgacgtccgacgtcccgtacgacgtacgttacgtacgtaacggtttagtttacgacgtttaagttttacgttacgttgtaccgtaggtaccgtaaggttaactaacgttcgtccgttaccgggtacccgttaacggttaccggttaccgggaacccggtaaacggggtaccggtacgggttaccggtaaacgtttaaccggaaaccggttacggtacggttcggtacccgtacggtaccctaaccgtacgtttaccggttacgttaccttaaccgg

SEQ ID NO: 193403 - DNA, 775 bp, Homo sapiens
  misc_feature: GYAE6OF02HOZC8.10.2.A02.1.454.CMB.1.raw
  modified_base (210)..(210): a, c, t, g, unknown or other
  misc_feature (210)..(210): n is a, c, g, or t
  modified_base (410)..(410): a, c, t, g, unknown or other
  misc_feature (410)..(410): n is a, c, g, or t
tcagcatagtagtgcacgaccggtgctcgatttagactcatctacagggggaggaactgctcacttaggacccagacggaaccatggaagccccagcgacagcttctcttcctcctgctactctggcctcccagactaccacgtggaagaagtaagtggatgacgcacgtcctccacgcccacccttgtctgtcgtctccgaagggaacngccctaccctcctcctacgcgacgggaccacgtagacggtagttcggttaggccaggtctaagggggttactcccgtaggaccacgtacggaaacgtaacggtcgccggtacggtccctaccgaggtcctaccctcgtattcggttaggcgtaccacgtaccgccggaacgggtccctacggtacgtacgttccgtacgnggtaccgtcggttccgaggtacgtcgggtgacgtgggacacggtacgttacgtactcgtaccactcggtacacgtacgctccgtacgtactcgttacgtaggtaaccgttttacgtttgtaacggtttagttttaaccgcgtttacgacttagtaaccgtaattaacgtacgttaccgtacggtaccggacccggttaccgggttaccggaccggtaacccgggtaaccgggggtaacggtacccggtttaacgggtaaccgttaaacccggtaacggttccgggtaaccggggttaaccggtccggttaacgaacccccggttaacttttcggggtacccttttaccgtacccttttaccccgg

SEQ ID NO: 193404 - DNA, 786 bp, Homo sapiens
  misc_feature: GYAE6OF02FLPYW.10.2.A02.1.454.CMB.1.raw
  modified_base (242)..(242): a, c, t, g, unknown or other
  misc_feature (242)..(242): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
tcagcatagtagtgcacgaccggtgctcgatttagactcatctacagggggaggaactgctcacttaggacccagacggaaccatggaagccccagcgcagcttctcttcctcctgctactctggcctcccagataccactggagaagtagtgatgacgcagtctccagccaccctgtctgtgtctccgaggggaaacacgccctaccctctcctgcgacgggccagtccagagtgtgcagngaggttgcctggaccagcgaagaacgtcggccaggcctcccgaggtcctccctagttatagtggtgcactcccgaccgacgggcccacgtggttacncgtcgaggacgtacgggttccggnggtacgagggtcgggttacggaggggactacgggtacgtttccgtccctttaccgtaccccaaccgtaacgtacgaacggtcctaacggttcgtacggaccgtacggttacctaaagggttaaacgtttacgtttttcggttaaccgtttaaaggttttttaactttacggtttaaccggttaaacgttaacggggttaaactttaagggttaggttaccgggtttacgggttccgggttacccggttaccgtttaccccgtttaacgtttacccggttttacggggaacccccggtaaaggggttaaccccgtaagggtttacccggtaaaccgttaaccggtaaaacgtaaaccgggttaacgttacgggttacgggtccgttaaccggacccctaaccggttaccgttttcggttacccg

SEQ ID NO: 193405 - DNA, 457 bp, Homo sapiens
  misc_feature: GYAE6OF01CCMTJ.13.61.F06.1.454.CMB.1.raw
  modified_base (439)..(457): a, c, t, g, unknown or other
  misc_feature (439)..(457): n is a, c, g, or t
tcagtcacgtactacacgaccggtgctcgatttagctacgctctaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccagaccacgacttttggagtggtgcgctcgacccctggggcccgggaaccctggtcaccgtctcctcagcctccaccaagggccccatcggtcttccccctggccaccctcctccaagacgcacctctcgggggcacgagcggccctgggctgcctggtcaaggtactactcctagtacgtgactgagcgggctggcgaggcgcatagnnnnnnnnnnnnnnnnnnn

SEQ ID NO: 193406 - DNA, 531 bp, Homo sapiens
  misc_feature: GYAE6OF01DUL6L.13.61.F06.1.454.CMB.1.raw
  modified_base (471)..(471): a, c, t, g, unknown or other
  misc_feature (471)..(471): n is a, c, g, or t
  modified_base (503)..(503): a, c, t, g, unknown or other
  misc_feature (503)..(503): n is a, c, g, or t
  modified_base (505)..(531): a, c, t, g, unknown or other
  misc_feature (505)..(531): n is a, c, g, or t
tcagtcacgtactacacgaccggtgctcgatttagctacgctctaagggaaaggggctggagtgggtggccaacataaaggaggatgggagtcagacatattatgtggagtctgtgcgggccgattcaccatttccagagacaacgccagatcgtcagtatatctgcaaaatgaggagcctgagagtcgatgatacggctacatattattgtgcgaagaattgactagttttccagacggcgactacgttgtcggcgtgggcgtactttgactagtttcggggaccgaagggaccacgtggtccacccgtcctcccaagtccttaccaacccggaacgggccctacgtccggttccccgtttccccccgtcggcccgcccctcgcctccgaggtacgcctaccctcggtcggggcacgacgccggcccgtggctcgcctggtacaaggtcctacttcgtagtacgtcgacngaggccggctggacgaacggtcgagacgtagngnnnnnnnnnnnnnnnnnnnnnnnnnnn

SEQ ID NO: 193407 - DNA, 504 bp, Homo sapiens
  misc_feature: GYAE6OF01C2SYX.13.61.F06.1.454.CMB.1.raw
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (494)..(504): a, c, t, g, unknown or other
  misc_feature (494)..(504): n is a, c, g, or t
tcagtcacgtactacacgaccggtgctcgatttagctacgctctaagggaaggggctggagtgggtggccaacataaaggaggatgggagtcagacatattatgtggagtctgtgcggggccgattcaccatttccagagacaacgccagatcgtcagtatatctgcaaaatgaggagcctgagagtcgatgatacggctacatattattgtgcgagaattgactagttttccagacggcgactacgttgtcggctgggggcgtacgtttgactagtttggggccaagggacacgtggtcctaccgtcctccccaagccttccgaccgaacgggcccacgtccggttcccttccccccgtgggcccgccccgtcgcctcccgaggacgcctacccgtcgtcgggggaccacgacgccggcccgtgggctcggcctggtacgaaggtacttaccgtctagtcgtgacgtgnggcggngcggacgaggcgngatgnnnnnnnnnnn

SEQ ID NO: 193408 - DNA, 562 bp, Homo sapiens
  misc_feature: GYAE6OF01CXOUM.13.61.F06.1.454.CMB.1.raw
  modified_base (523)..(562): a, c, t, g, unknown or other
  misc_feature (523)..(562): n is a, c, g, or t
tcagtcacgtactacacgaccggtgctcgatttagctacgctctaagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacagacaaaatatggttcagggagttcgaactacgtgggggccaaggggaacccctgggtccaccgtctcctcagccctccaaccaaacgggcccagtaccggttcctttccccccgtcggccaccccgtccctaccgaaacgaacgccaaccctcggtcgggggccaacgaacggcccggccccgtcgggggcctcggccccgttggttaccgaaacgggtacccttaaccgtttccctaaggttaacggtcggtactggaacgggccggggtactgggaccgaaacgggccgaccgagtaacggcannnnnnnnnnnnnnnnnnnnnnnnnnnnnnnnnnnnnnnn

SEQ ID NO: 193409 - DNA, 641 bp, Homo sapiens
  misc_feature: GYAE6OF01CASZ2.13.61.F06.1.454.CMB.1.raw
  modified_base (161)..(161): a, c, t, g, unknown or other
  misc_feature (161)..(161): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(641): a, c, t, g, unknown or other
  misc_feature (616)..(641): n is a, c, g, or t
tcagtcacgtactacacgaccggtgctcgatttagctacgctctaaggggaaaggggctggagtgggtggccaacataaaggaggatgggagtcagacatattatgtggagtctggtggcggggccgattcacctatttccagagacaacgccagatcgtnagtatatctgacaaatggaggagccgtggagagtcgagtagacgtacggctaactagttattagttgtagagaaggtaattgaacttacgtttccgaaggtaccggcgtactacggtttcggtcgggcggtagggggcgttacgttgaacgttaggtttcggggaccgaaggacacgtcggtctacccgtctaccgacgtacctacccaaccgacggcctacgttccggtcccttccccgtcggcccgtccgtcgtccgtaccggaggtaccgccaccggttcggacggggaccaaccggacggcccgggtcccggtgggtaccgtcggtcccggtcgggtaacgtaacgggtaccctttaaccgttaccgtaacggttacggtaccgggtaacctacgggggacgcccgggggtacgtaaccgggacgggtaaccggtcgacggttaagngntnnnnnnnnnnnnnnnnnnnnnnnnnn

SEQ ID NO: 193410 - DNA, 821 bp, Homo sapiens
  misc_feature: GYAE6OF01EKKMC.13.61.F06.1.454.CMB.1.raw
  modified_base (750)..(750): a, c, t, g, unknown or other
  misc_feature (750)..(750): n is a, c, g, or t
  modified_base (780)..(780): a, c, t, g, unknown or other
  misc_feature (780)..(780): n is a, c, g, or t
  modified_base (784)..(784): a, c, t, g, unknown or other
  misc_feature (784)..(784): n is a, c, g, or t
  modified_base (786)..(786): a, c, t, g, unknown or other
  misc_feature (786)..(786): n is a, c, g, or t
  modified_base (790)..(790): a, c, t, g, unknown or other
  misc_feature (790)..(790): n is a, c, g, or t
  modified_base (794)..(794): a, c, t, g, unknown or other
  misc_feature (794)..(794): n is a, c, g, or t
  modified_base (798)..(798): a, c, t, g, unknown or other
  misc_feature (798)..(798): n is a, c, g, or t
  modified_base (801)..(803): a, c, t, g, unknown or other
  misc_feature (801)..(803): n is a, c, g, or t
  modified_base (806)..(812): a, c, t, g, unknown or other
  misc_feature (806)..(812): n is a, c, g, or t
  modified_base (814)..(815): a, c, t, g, unknown or other
  misc_feature (814)..(815): n is a, c, g, or t
  modified_base (817)..(817): a, c, t, g, unknown or other
  misc_feature (817)..(817): n is a, c, g, or t
  modified_base (819)..(821): a, c, t, g, unknown or other
  misc_feature (819)..(821): n is a, c, g, or t
tcagtcacgtactacacgaccggtgctcgatttagctacgctctaagggaagggctggagtgggtggccaacataaaggaggatgggagtcagacatattatgtggagtctgtggcggggccgattcacctatttccagagacaacgccagatcgtcagtatatctgcaaatgaggacgcctgagagtcgatgatacggctaacattatttagttgtcgacgtaagtaaatttcgtaacttacggtttttaccgacggtaaccgggaccggttaaccgtttaaccggtttcggggtcccgggttacgggttcggggggtacccgtttaaccgtttttacggaaccgtttacgggtttttacggggggaacccgtaaaacgggggtaccgttaacccggttcggggttacccccgtaccccgggtttaccccttaccccccgtaaaacgggttccccgttttaacccccgaaacccggttaaacccgggggtacccccctaacggttttccccgggttttaccccccgttttcccccccggtcggggtacccccgttcccccggttacggtcccctacccggaacggggtacctaccccggtacccgttccggggtacggggaccctaccggaccgggtcccgggtcccggtcgggtacccgtcgtaccggtacgggtaaccggtaaccggttaccgtttacccgttacgttacggtacgtacgtaacggtcggtacgggtccggtacggnggtaaccggcgtacgacgttagcgatcgancgtnancgtnacancgancgnnncgnnnnnnngnnancnnn

SEQ ID NO: 193411 - DNA, 444 bp, Homo sapiens
  misc_feature: GYAE6OF02GOQY5.13.61.F06.1.454.CMB.1.raw
  modified_base (436)..(444): a, c, t, g, unknown or other
  misc_feature (436)..(444): n is a, c, g, or t
tcagtcacgtactacacgaccggtgctcgatttagctacgctctaagggaagggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggcgccctgctccaggagcacctctggggcacagcggccctgggctgcctggtcaaggactacttcctagtcgtgactgagcgggctggcaaggcgcatagnnnnnnnnn

SEQ ID NO: 193412 - DNA, 441 bp, Homo sapiens
  misc_feature: GYAE6OF02FWR1W.13.61.F06.1.454.CMB.1.raw
  modified_base (434)..(441): a, c, t, g, unknown or other
  misc_feature (434)..(441): n is a, c, g, or t
tcagtcacgtactacacgaccggtgctcgatttagctacgctctaagggaaagggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnnn

SEQ ID NO: 193413 - DNA, 431 bp, Homo sapiens
  misc_feature: GYAE6OF02IP0BD.13.61.F06.1.454.CMB.1.raw
  modified_base (424)..(431): a, c, t, g, unknown or other
  misc_feature (424)..(431): n is a, c, g, or t
tcagtcacgtactacacgaccggtgctcgatttagctacgctctaagggaaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttagatttttggagtggttataccgagtggggccaggaaccctggtcatcgtctcctcagcctccaccaaggcccatcggtcttccccctggccaccctcctccaagagcaccctctggggcacagcggccctgggctgcctggtcaaggactacttcctagtacgtgactgagcgggctggcaaggcgcatagnnnnnnnn

SEQ ID NO: 193414 - DNA, 439 bp, Homo sapiens
  misc_feature: GYAE6OF02HMZ3T.13.61.F06.1.454.CMB.1.raw
  modified_base (348)..(348): a, c, t, g, unknown or other
  misc_feature (348)..(348): n is a, c, g, or t
  modified_base (432)..(439): a, c, t, g, unknown or other
  misc_feature (432)..(439): n is a, c, g, or t
tcagtcacgtactacacgaccggtgctcgatttagctacgctctaagggaaggggctggagtgggtggccaacataaaggaggatgggagtcagacatattatgtggagtctgtgcgggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaaggcccatcggtcttcccctgcgccctgctccagngcacctctggggcacagcggccctgggctgcctggtcaaggctactcctagtacgtgactgagcgggctggcaaggcgcatagnnnnnnnn

SEQ ID NO: 193415 - DNA, 419 bp, Homo sapiens
  misc_feature: GYAE6OF02F6PHM.13.61.F06.1.454.CMB.1.raw
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (413)..(419): a, c, t, g, unknown or other
  misc_feature (413)..(419): n is a, c, g, or t
tcagtcacgtactacacgaccggtgctcgatttagctacgctctaagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccggtctcctcagcctccaccaagggcccatcggtcttccccccnggcaccctcctccaagagcacctctgggggcacagcggccctgggctgccnggtcaaggctacttcctagtacgtgactgagcgggctggcaggcgcatgnnnnnnn

SEQ ID NO: 193416 - DNA, 546 bp, Homo sapiens
  misc_feature: GYAE6OF01C0WI9.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacactacttgaattggtttcagcagaggccaggccaatctccgaggcgaccttaatttatttggtttactaaacgggactcgtggggtcccagacagattcgagcggcagcgggtcaggcactgtatttcacactagaaaatcagcgagggtggaggcgtggaggagtggttcgggtttactacgtgcatgacaacatagagtacgtcggtcctaccgtactacgtttcggaccgacgggtaaccaaggcgtaggacgtaataccgaaaacgacgtaggtaggacttgctacctacg

SEQ ID NO: 193417 - DNA, 542 bp, Homo sapiens
  misc_feature: GYAE6OF01AB9J0.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacacctacttgaattggtttcagcagaggccaggccaatctccgaggcgccttaatttatttggtttactaaacgggactcgtggggtcccagacagattcagcggcagcgggtcaggcactgatttcacactagaaatcagcaggggtggaggctgaggagtggtcgggtttactacgtgcagtgacaactatagagacgtggcccttccgtactacgttttcggcctacggggaccaaggcgtaggaagtacgtacgaaacgaacgtaggtacggacgtcgccaccgtacg

SEQ ID NO: 193418 - DNA, 577 bp, Homo sapiens
  misc_feature: GYAE6OF01D1S2C.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacaccttacttgaatttggttcagcagaggccaggccaatctccgaggcgtaccttaattttattttggtttactaaacgggactcgtcggggtcccagacagtattcgaggccggcaggcgggtcagggcactgatttcaactactagaaatcgagcgaggggtaggaggcgtaggaggtagttggttacgggtttactacgtgactatgactaacgataggacgtacgtcggtccctaccgtactacgtttcggaccgaacggggaccaaggtcgtagggaacgtacgtaaccgaaacgtaacgtgtcggtactcggccacgtacg

SEQ ID NO: 193419 - DNA, 573 bp, Homo sapiens
  misc_feature: GYAE6OF01DHILI.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgtggtgtagtcaaagtctcgtacacagagatggaaacacctacttgaatttggttcagcagagccaggaccaatctccgaggcgacctaatttatttggtttactaaacgggtactcgtcggggtcccagacagattcaggcggcaggcgggtcaggcactgatttcacactagaaatcagcgaggggtggaggcgtaggaggagttagggtcggggttttaactaccgtgaccgtagtagactaaacagttaagagtacgtcggtccttaccggtactacgttttacggaccgacggggaccaacggtacgtagggacgtaagtacgaaacgtaacgttcggtaggctagccacgtaac

SEQ ID NO: 193420 - DNA, 732 bp, Homo sapiens
  misc_feature: GYAE6OF01DP2CA.35.82.H05.1.454.CMB.1.raw
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (346)..(346): a, c, t, g, unknown or other
  misc_feature (346)..(346): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagcggcgtgttcaggtcggctatttaaggncagtgtgngtgcagctgtgacgtntgggagctgacncngccgtggggcctgacactctctgtnacgtgcctntaggtcttntagtttacgcctactatggcatggactccgttgggccttccggccgggtaacgtccggaaggggaacgggtcgttgggaccggtgggtttacncctaaacttagtggtagtggggttaccgtaggccctttaactaacgtaactacgtacggtacgtaacgacgtaacgtaccggttacggtacgggtaccgggtacccgttaccgacgtaccgttacctaccgaacgtaacgtaacccgtaacgttacccggaacggaaccgttaacgtacttaaccgtaatccggtacgtaacgtaacgtaacgtaaaccgtaacgtacggtacggtaccggtaaccggtaccggtaaccggtaccggtaaccggtaaccggttaaccgttacgttacgttacggtaccggttaacggttaacggttacggttacggttacggttacggttacggttacggttacggtacgggtcggtacggtacgg

SEQ ID NO: 193421 - DNA, 663 bp, Homo sapiens
  misc_feature: GYAE6OF01DKEPO.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggactccagtgacgtaggttgtgatgactcagtctccactctccctgcccgtcacctgacagccgcctcatctctgttggtgtatcaagtctacgtacacgagaagataggaaaacctaccttagttagtaactttggtttacagcaggacggccaggaccaatccgtaccggaggtccgtacctttaattttagttttacggttttaccgtaaaacgggtcttcggtcgggtacccaagacagtacttcgaggcggctacgggcggtacagggctacgtgtactttacacgtaactacgaaaactcgtaacgacggtaggggtagggacggtcgtaggaggtagtcgggtttacgggtttacgtacgtacgtactacgtcgacgaactagtaaggagtacgtcggtcccgttaccgtactacggtttacggaccggtaacggggtaccgaacggtcgtaagggtaacggtaactaaccgtaaaacggtaacgttacggtacggtaccgttcggaccgtaaccgttacg

SEQ ID NO: 193422 - DNA, 618 bp, Homo sapiens
  misc_feature: GYAE6OF01DX7RA.35.82.H05.1.454.CMB.1.raw
  modified_base (452)..(452): a, c, t, g, unknown or other
  misc_feature (452)..(452): n is a, c, g, or t
  modified_base (484)..(484): a, c, t, g, unknown or other
  misc_feature (484)..(484): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcgttggtaaagccgtggggggtccctcagactctcctgtacagtctctggattcagtctaagtgacgcctggatgaacgtcgggtccgccgaggctccgaggccgagggggctgggaggtggggttggaccgttaagttaaaaccagtcgtaggagggtggaacaacgagactacgcgtacggaccgtaggaaaggcaggttcaccatcacaagagatgattcaagaaacgtccttanctagactaatcgaacacgacctaagaaaccgngaacaacacgtaccctttaatacttacgtaaccctacccgttacgactaacttactacgtactaacgagtaggggtacttcggtacggggacccgtaagggtaacctacggacggttaccctccgttctacccg

SEQ ID NO: 193423 - DNA, 797 bp, Homo sapiens
  misc_feature: GYAE6OF01AP6FG.35.82.H05.1.454.CMB.1.raw
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagtacagatcgtcacgaccggtgctcgatttagtcgagctctctcgcgggggggaggaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggtcgttaggtaaagccgttcggggggtccctcaggactcgtcctgtactagtctctggattcagtctaagngacgctggatgaacgtgggtccnccgaggctccgnggcccgaggggtctgggtaggttgggttacggtaccgtaaacgttaaaaccgaaggccgttgggaacgggtcgggaactaaacgagaaccgtacggccggtacggggaaccccgttagggaaaacgggtcgtaacgggtttacccaacgtacgtacgtaaccgtaaaggacggtaagtacggtaacgtttaccggaaaacgtaaaacccggttccccttttaagtaccgttaggaaaccgtaaaacgttaggaaacccgtaacgtaccgttaaacggaaaaccgggtacgaaccgaccgtaacgtaccccttttaagttaccttaaccggtaaccctaacccttaacgtaacccgtaattacgtaccggaaattcccggaaacggttagggggtaaccctttcgggtaacccggggtaaccgtaaacgggtaccttacccgtaacggggttccctaaaccccggttccgttaccccg

SEQ ID NO: 193424 - DNA, 739 bp, Homo sapiens
  misc_feature: GYAE6OF01APYC5.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggtattttccttgctactaattttaaaggtgtccagtgtgaggtgcagctggtggagtcgtgggggaggcgttaggtaaagccgtcgggggtccctcgagactctcctgtacagtctcgtggtattcgagttcgtaagtcgaccgcctggatgaaccgtgggtcccgccgaggcctccgacggccgaggggctgggaggttcggggttacggaccggttaaacgttaaaaccgaggtcggtaggaggggtacgggaactaacgagaaccgtacgccgtacgggacccgtaggaaacggtcgtaacgggttcccaacgtacgttaccgtacgaaaggtagtagtgtaacttacgaaaaccgtaaaacccgttccctttagtacctagtaccaaatcgaaacctacggtaccgtaacggaaaccgaggaactaccgaacgtttccctttaaagttactttaacccgaacccttaacccgttacgtaacttacttacgttagtaaccttacgtacggttacggggttaccttcgggtaccggggaaccgttaacggggtacctacccggacggttacccctccgttcccgtacccg

SEQ ID NO: 193425 - DNA, 596 bp, Homo sapiens
  misc_feature: GYAE6OF01DQD3C.35.82.H05.1.454.CMB.1.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (585)..(585): a, c, t, g, unknown or other
  misc_feature (585)..(585): n is a, c, g, or t
tcagtacagatcgtcacgaccggtgctcgatttagtcgagctctctcgcggggggggagaggagccccagccttgggattcccaagtgttttcattcagtgatcaggactgaacacagaggactcaccatggagtttgggctgagctggattttcctgctactattttaaaaggtgtccagtgtgaggtgcagctggtggagtcgtgggggaggcgttggtaaagccgtggggggtccctcgagactctcctgtacagtctcgtggattcgagtctaagtgacgcctggatgaacgtcgggtccgccgaggctccgaggccgaggggctgggagtgggttggaccgtaaattaaaaccgagtcgtaggagggtggacaacgagactacgcgtagggacccgtagaacggcaggttcacatcanaganangatcaagaaacctccttancnacaatnaacngacctaagaaaccaggacactacgtaccctttaatacttactaaccctaccttacaactactacgacgtactacgagttcgggactttcgggacgggtaccgacgggtaactaccgaggtacccnccgtctacccg

SEQ ID NO: 193426 - DNA, 797 bp, Homo sapiens
  misc_feature: GYAE6OF01EJ1L9.35.82.H05.1.454.CMB.1.raw
  modified_base (154)..(154): a, c, t, g, unknown or other
  misc_feature (154)..(154): n is a, c, g, or t
tcagtacagatcgtcacgaccggtgctcgatttagtcgagctctctcgcgggactgatcaggactcctcagttcaccttctcacaatgaggctccctgctcagctcctggggctgctaatgctctgggtcccaggatccagtgacgtaggttgngatgactcagtctccactcctccctcgcccgtccacccttggacacggccgcctccattcctccgttgttggtgtacgtacaaagtctaccgtacacagagtatacgaaaccaccttacttagtaactttggttacagacaggacggaccaacggacctaagttccgtccggacggtaccgttaccgtttaaagtttttacgttttacgggttttaaccgttaaaaccggggtacgtttccggttaccgggggtacccctaacggtactaacggtacgtttaccgacgggccggacgaacgggtcgggtacgtacggaccgtacgtttacgtacttttaccgaaccgtaacgttaacgaaaacctcggaacggtacgggtagggggttaggtacgggacgttaggggaaacggttagttttacggggttttaacgggttttacctacggtttcggacgtacgtaccgtaacgtaacgtaacggtaacgtaaccggtaccgtaccgggttaccctttaaccgttaccggtttaccggtttacggaacccgggtaccgggtaaacctacgggacggttacggaacttaaccggtaaacccgaaaggttacgttacggtacggtacctaccgacctaccgttaccg

SEQ ID NO: 193427 - DNA, 627 bp, Homo sapiens
  misc_feature: GYAE6OF01AK2TH.35.82.H05.1.454.CMB.1.raw
  modified_base (254)..(254): a, c, t, g, unknown or other
  misc_feature (254)..(254): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttggtaaagccgtggggggtccctcagactctcctgtacngtctctggattcagtctaagtgacgcctggatgaactggggtccgccgaggcctccgaggccgaggggctgggaggtgggttggccgttaattaaaaccgagcgtggagggtggacaacgagacacgcgcggacccgtggaaggcgaggttccaaccatctacaagngatgattcaacgaaaaccgtccctttanctagacaagtgaacagaccctagaaaccgaggacacacgtccctttaattacttacgtaccctaccttacgaacctacttactagtaactaaccgtaggttacggggttaccttcgggtacgggggtacccgaagggtaacccttacccggaaggtccctacccggttccctaccccg

SEQ ID NO: 193428 - DNA, 983 bp, Homo sapiens
  misc_feature: GYAE6OF01CF9R9.35.82.H05.1.454.CMB.1.raw
tcagtacagatcgtcacgaccggtgctcgatttagtcgagctctctcgcggggggggagaggagccccagccttgggattcccaagtgttttcattcagtgatcaggactgaacacagaggactcaccatggagttggctgagctggtattttcctgctactaatttaaaggtgtcagtgtgagtgcagctggtggagtcggtgggggagtcgttagggtaaagtccggtcggggggtccctacgacggactccgtcctgtacctagttctcgtggtacttctagttactaaggtcgacgccgtaggtatacggtaacgtcgggtcccgaccgtacggccgtaccggacggaccggacggggtccggtaggggtacgggttggggttacgggtaacccggttaaaagtttaaaaaccccggaggtacgggtacggggaaagggggtcggggtaaaaccaaaccggaacggtaacccgtaacggtacccggttaccggggtaaaccccggttagggaaaaaccggggtcctaaacgggggtttacccaaacccgttaaacgttaccccggtaaggtaaaacggtaggtaaccggttaagttaaccgtttaaacccggaaaaaggtttaaaaaaaccccccggttttcccttttaaacgtaaacccgtttaacggtaaaaccgtaaaacgtttaaacggaaacccggtaaaacccggtaacccgttaaaaaccgggaaaacccgggtaaaccgaaaacccggtaaaccgttaaccggtttaaccccgtttttaaacgttaacgtttaaacccgggtaaaccccttaaaccccggtttaacgtaaacccttaaccgtttaaggttaccgtaacgttaaaccggtaagggttaacccggggttaacggttcgggttaaccggggaacccgttaacgggggtaacctacccgggtaacggttaccccgtacccggttccgtaccccgg

SEQ ID NO: 193429 - DNA, 840 bp, Homo sapiens
  misc_feature: GYAE6OF01ESARC.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagagactcaccatggagtttggctgagctggtattttcctgctactaatttaaaaggtgtcagtgtgaggtgcagcgtggtggagtcggtgggggagtcgttaggtaaacgccggtcgggggtccctcgacgtaccttccgttccgtacgtacgtacgttcctcgttacggtattcgagttacgtaaggtcgaaccggtccgtaggtaactacggtaaccggttcgggtcccgaccgaacggtcccgtaccggaccgggaccggagggggtcgtaggggtacgggttggggttaccggtaaccgttaaaagttaaaaaccgagggtacggtagggaacgggtacggaacaaacgaacgaacgtaccggacgtacgggaaccgtaggaaacggtcgtacggtaccaacgtactacgtaacgaagagtaattagtaacttacgaaaaccgttaaacccgttaccctttagtctaacgtaactaaaggtaacgaaaccgtaaccggtaacccgtaaaacggaaaaccggtacgaaccctaacgttaacccgtttaacccgttttaaacttaacgttaaccccgttaaaccccttaacccgttaactaacttaaccgttaacgtaacgtaaacttaccgggtaaggtaccgggttaccttacggggaccgggtaaccgaaacgggttacctaacccgggtaacgtccccgttaaccgtcccgtaacccg

SEQ ID NO: 193430 - DNA, 880 bp, Homo sapiens
  misc_feature: GYAE6OF01CTDRU.35.82.H05.1.454.CMB.1.raw
  modified_base (191)..(191): a, c, t, g, unknown or other
  misc_feature (191)..(191): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagttgggctgagctggtattttccttgctactaattttaaaaggtgtccagtgtgaggtncagctgggtggaggtcgtgggggaggcgttagggtaaagccggtggggggtccctcgacgtactctcctagtactagtctcgtggtattcagtcctaaggtcgacgtccgtaggatgaaccgtcgggtccgccgtagccgtccgacggccgaggggccgtgggtacggttcggggttacggaccgttaaaagtaaaaccgaggtacggtaggacggggtaggaactaacgacgactacggcgtacggaccggtaggaacggcgtacggtaccaacgtacttaccgtaacgaagttaagattagtaaccgtttaacgaaaaacccggtaaaaccccgttttccctttaaataccggttacgtaaccgtaaaaagttccggaaaaccgtaaccgggtaacccgttaaaacggaaaaacccgggtaccgggtaaacctaaacccggtttaacccggttttaaccccttttttaaaaggttttaccgttaaaccccgggttaaaccccccgtttaaccccctttaagggttaacccttaaaacggtttttaccgtaaaacggtacgttaaaccgtacgggggtttaaccggggttaacccggtttccgggaaaccgggggttaacccggttaaacggggtaaccttacccggggtaccggttaacccctaccccgggttcccttaaaccccgg

SEQ ID NO: 193431 - DNA, 641 bp, Homo sapiens
  misc_feature: GYAE6OF01E1MQ2.35.82.H05.1.454.CMB.1.raw
  modified_base (501)..(501): a, c, t, g, unknown or other
  misc_feature (501)..(501): n is a, c, g, or t
tcagtacagatcgtcacgaccggtgctcgatttagtcgagctctctcgcggggggggagaggagccccagccttgggattcccaagtgttttcattcagtgatcaggactgaacacagaggactcaccatggagtttgggctgagctggattttccttgctactattttaaaaggtgtccagtgtgaggtgcagctgggtggagtcgtgggggaggcttggtaaagccgtggggggtccctcagacctctcctgtacagtctctggattcagtctaagtgacgcctggatgaactgggccgccaggcctccgaggcccagggggctgggaggtgggttcggaccgttaattaaaaccgaggcgtaggagggtacggacaacgagactacgcgtaggacccgtaggaaacggctaggttcacatctacaagagatagattacgaacgtaaaccgtccctttaagctagactaaagtcgaaacacgacctaaggaaaacccgnggaaccacgtacgtacccttttaattacgttaccgtaaccctacccttaacgactaacttactagtaatacgtagttaggggtaccttcggtacggggaccaaggggtacctccggacggttccctacccgttctacccg

SEQ ID NO: 193432 - DNA, 771 bp, Homo sapiens
  misc_feature: GYAE6OF01CCYV2.35.82.H05.1.454.CMB.1.raw
tcagtacagatcgtcacgaccggtgctcgatttagtcgagctctctcgcggggactgatcaggactcctcagttcaccttctcacaatgagcctccctgctcagctccgtggggctgactaatgctcgtgggtcccaggactccagtgacgtaggttgtgatgactcgagttcctccacttcctcccgtcgccccgttacctacccgttggaccacggcccggtcctcccattccttccgtttggttgggttgtaacgtacgaaagttcctcgtaacacgagagtactacggaaacctaccttacgttagtaattttcggttacagacacggacggccgagtaccaaagttccgtccggaagtacccgtacctttttaaagtttttaggttttacggtttaaaccggaaaccgggtctttccgggtacggggtacccctaagtaccgtagtacttaccggagggccggtagaccgggtccgggtagacggtccacgtttgtacttaacaacctaagtaacgtaaactcgagggaacgggtaggggtcgggacggtgtagggtaaggtcgggtttacgggtttaccgggtttaacctagtcggtagacgtacgaacgttaacagttaacggacgtccggtaccgtcccgtttaccgtacgttaaccggtttccggaacccgggtaagggaaccgtacggtacggttaagaaacggttaccgtaaacgaaacccgttgggttacgtaccggacttccggaacctacgttaccg

SEQ ID NO: 193433 - DNA, 736 bp, Homo sapiens
  misc_feature: GYAE6OF01EQXKD.35.82.H05.1.454.CMB.1.raw
  modified_base (196)..(196): a, c, t, g, unknown or other
  misc_feature (196)..(196): n is a, c, g, or t
  modified_base (728)..(728): a, c, t, g, unknown or other
  misc_feature (728)..(728): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctcgcccgtcacccttgacngccgcctccatcctcctgttgtgtagtacaaacgtctcgtacacagagtatacgaaacctacctacgttagtaagtttcggttacagtccaggacggtacccgacggacccaattcccgtccggaacggtccttaccgtttaaatttttagttttcggttttaacgtaaaaccggggtccttacgggttccggggtacccctaagtacgtaacggtactttacggaacggcccggggtacgtaacgggtcccggggtacgaggggtaacccctacgtttaggtaacttttaccgaacccgtaagtaaacgtaaaaacgttcgacgggtaccgggtagggggtacgggaacgggtcgtagggtaaggtaggttcgggtttacggggtttactacgttcgatagacgataacgaatacgacgtacgtcggtcccttaccgtaaccgttacgtttcggaccgtacggggacctaaaggtcgtaagggtactaacgaaccgtaaacgtaacggtcggtacggtacctacggtaccncggttacc

SEQ ID NO: 193434 - DNA, 787 bp, Homo sapiens
  misc_feature: GYAE6OF01AEJ7P.35.82.H05.1.454.CMB.1.raw
  modified_base (498)..(498): a, c, t, g, unknown or other
  misc_feature (498)..(498): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggtattttccttgctacttaattttaaaaggtgtccagtgtgaggtgcagctggtggagtcgtgggggaggtcgttggtaaagccgtcgggggtccctcagactctcctgtacagtctcgtgtattcgagtactaagtgaccgtccgtggatgaacgtcggtccgccgacggcctccgacggccgagggtcgtgggtggttcgggtcggtaccgttaacgtaaaccgacggtcggtagggagggtacggaacaacgacgacgtacgcggtacggacccgtaggaacggcgtacggtccacctatcgacgaagtacgatagtacttacgaaacgtaaaccccgttacctttanaccgttagaacctaaagtacgaaaccgtaccgacccggtaaaggaaaacccgacggaacctaccgttaacccgtttacccctttttaacgttaacccgtttaacccgttaaacccccgttaaccccgttaacgtaaaccgtttaacttacgtaaacccggttattaaacccgggtacgggtttaccggggtaacccgtttccggggtaaccgggggtacccgtaacgggggttaaacccttaccccgggtaaccgggttacccccttaaccgttcccccgtaaccccgg

SEQ ID NO: 193435 - DNA, 803 bp, Homo sapiens
  misc_feature: GYAE6OF01EUYFA.35.82.H05.1.454.CMB.1.raw
tcagtacagatcgtcacgaccggtgctcgatttagtcgagctctctcgcggggactgatcaggactcctcagttcaccttctcacaagtgaggctccctgctcagcccctccgtggggctgctaatgctcgtgggtctcgtggatccgaggtggggattattgtgtatgactcgagtcctcctactcctcccgtcgcccgtccacccgtggagcggcccgcctcctatcctctcgcgaggttctacgtcagctccctactgactaagttagtagtaggaactaacttaagttactttagtaaacgttcggttaccgagacgaaacggaccggacggtaacgggtcctacgttacccgaccacggacgtccccttagttacgttactttcggttttaaggttttcgggtaaccgttaacccgggtcccggggttacccccgggttccggggttaccctagggtaaccgttagggtttaccgaagggttcgggtacgtaggggtacgttacgtaaccggagttacccgaagtttaaacgtttaaccgttttaacgaaaccggttaaactaaacgtaccgttaagggaaccgtaggggttaacggtagggtaccggtgttaagggtaggtttaagtttaacggggttagttaaccgttttaagtccggtagtaccgttaacgtacgtaaaccgtaacctctaaacgtacgtacccgttccgggtaacggtcccgggtaaggaaccgggaaaaggtaaccggtaaggtaaaccgagttaaaccggaaagttcggttagtcgggaccg

SEQ ID NO: 193436 - DNA, 504 bp, Homo sapiens
  misc_feature: GYAE6OF02GVFWF.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacacctacttgaattggtttcagcagaggccaggccaatctccgaggcgcctaatttatttggtttctaaacgggctctggggtcccagacagattcagcggcagcggtcaggcactgatttcacactgaaatcagcagggtgaggctgaggatggtcgggtttactatgcatgcaacatagagactggcctccgtacacttttcggccaggggaccagcgtggagagtacaacgaactgtggcgtcgcacctac

SEQ ID NO: 193437 - DNA, 554 bp, Homo sapiens
  misc_feature: GYAE6OF02ID2IS.35.82.H05.1.454.CMB.1.raw
  modified_base (447)..(447): a, c, t, g, unknown or other
  misc_feature (447)..(447): n is a, c, g, or t
  modified_base (510)..(510): a, c, t, g, unknown or other
  misc_feature (510)..(510): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttgggtaaagcctggggggtccctcagactctcctgtacagtctctggattcagtctaagtgacgcctggatgaactgggtccgccaggctcccgaggccaggggctggagtgggtggccgtattaaaaccagcgtgagggtggacaacagactacgctggacccgtgaaacggcaggttcaccatctcaagagatgattcaagaaaacgtccctttatctgacaaatgaacngacctagaaaccgagacacacgtcctttattactagtacctacctacgactattactgatacngtgggacttcgtgggaccagggactccgaggtcaccgtctcccg

SEQ ID NO: 193438 - DNA, 578 bp, Homo sapiens
  misc_feature: GYAE6OF02GRLGU.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttgttaaagcctggggggtccctcagactctcctgtacagtctctggattcagtctaagtgacgcctggatgaactgggtccgccaggcctccaggccaggggctggagtgggtgccgtataaaaccagcgtgaggtggacaacagactacgctggacccgtgaaaggcaggttcaccatctcaagagatagattacagaaaaccgccctttaatctagacaaatgaaacagacctagaaaaccgaggaacaccgaagtaccctttaattacttacgtaaccctaacccttacgaacctattactatactacagtacgggtacttcgtacgggaccgagggactccgaggtcgaccgtctaccc

SEQ ID NO: 193439 - DNA, 628 bp, Homo sapiens
  misc_feature: GYAE6OF02GY38R.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactcctccctgcccgtcacccttggacagccggcctccatctcctgttggtgtagtcaaagtctacgtacacagagatggaaacacctacttgaatttggtttcagcaggacggccgaggaccaatccgtccggacggccgaccctttaaagttttagttttcgggtttacctaaaacggggtcttccgtcggggtaccctaggacagacttcgagcggacgagcgggtcaggcacgtgatttcactacgtaagaaaacttcgaagcgaggggtaggtacgggctaggacggtagttgggttaccggggtttactacgtcgctagacgtacaacgagtagagtacgtacggtccctccgttaacgtacgttttacggacccgtacggggacctaacggtcgtagggaacgtaacgtaaccgtaacggtaacgttcggtaggtccgtcgacaccgttacg

SEQ ID NO: 193440 - DNA, 648 bp, Homo sapiens
  misc_feature: GYAE6OF02GPJCB.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttggtaaagccgtggggggtccctcgagactctcctgtacagtctctggattcagtctaagtgacgcctggatgaactgggtccgccgaggcctccgaggccaggggctggagtgggttggaccgtaattaaaaccgagtcgtggagggtcggacaacagacgtacgctcggaccgtgaaacgcgaggttaccaccatctacaagagatgatacaacgtaaacgtcctttaatcctagacaaagtcgaaacacgtaccctaaggaaaaccgtacggaaccacgtaaccgtacccgttttaattacgttaccgtaaccctaaccccttaacgtaacctactttacctataacgttaacgtaagtcggggttaacttccgtcggggacccgtagggtaacctaccgtacgggtaccgttacccgtcgttacccccg

SEQ ID NO: 193441 - DNA, 588 bp, Homo sapiens
  misc_feature: GYAE6OF02HY1WO.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcttggtacaggccgtggggggtccctgagactctcctgtgaagcctctggattcacctttaggaactatgccatgtgcgtgggtccgccaggcctccgaggggaaggggctgggagtcgggtctcgagttattagtggtagtggtgatactatacactacgcagactccgaggaacgggccgtacaccactcctacgagacgataacttccaaagaacacgctagtactactacaaagtggacagtctagagagccgaaggaccacggtccttaatactttacgtagtacgacgtaaagtttcgaacgtaggtcggtactgggaactacgggagggttcgggagttagacggtacgtaccggtggggtaccccg

SEQ ID NO: 193442 - DNA, 646 bp, Homo sapiens
  misc_feature: GYAE6OF02HOUSV.35.82.H05.1.454.CMB.1.raw
  modified_base (592)..(592): a, c, t, g, unknown or other
  misc_feature (592)..(592): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcgttggtaaagccgtgggggggtccctcgagactctcctgtacagtctctggattcagtctaagtgacgcctggatgaacgtcgggtccgccaggcctccgacggccgagggggcgtgggaggttggggttggacccgttaagttaaaaacccgaaggtacggtaggaggggtacgggaacaacgagactacggcgtacggaacccgtaggaaacggcgacggttaccacctatcgtacgaagagataggtattacgaacggaaacctcctttaatccgttagactaaatacgaacacggtacctaaggaaaaccgagaaccacgtacgttacctttatacttacgtaccctaccctacactattactagtactacgngtacgggtacttcggacgggtacgacggactccggaggtaccaccgtctacccg

SEQ ID NO: 193443 - DNA, 527 bp, Homo sapiens
  misc_feature: GYAE6OF02GTVAB.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactctgatgtatagggctctgttctaacaaaagtcggggtcccacgaaggttcaggcggcagtggatcgtgggacagaattcactctacacatcagtacgctgcagcctgatgactttgctaaccttattactcgacctaacattacagtctactttatttcttcctttcgggcggtacggaaccgagggtacgacactacaaggtaccgtaacgtggtcggactgccaccctatcctcgttcttac

SEQ ID NO: 193444 - DNA, 550 bp, Homo sapiens
  misc_feature: GYAE6OF02HSEJR.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacacctacttgaattgtttcagcagaggccaggccaatctccgaggcgccttaatttatttggtttactaaacgggacttcgtggggtcccagacagtattcacggcggcaggcggtacaggcactgatttcacactagtaaatcaagacgagggtaggaggtctaggaggtagtcggttacgggtttactacgtgcatgacaacaagtagagtacgtcgtcccgtccgttactacgttttcgaccgtacgggacacggtcgtaggacgtaatacgaaacgacgtggagcgtacgcactac

SEQ ID NO: 193445 - DNA, 932 bp, Homo sapiens
  misc_feature: GYAE6OF02JRDIS.35.82.H05.1.454.CMB.1.raw
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactcctccctgcccgtctacccttggacacgcccggcctccatcctccgttggttggtgtacgtacaaagtctacgtacacagagtaatacggaaacctaccttaacgttagtaagtttcgggtttacaacgcgtaaggacggacccgtaacgggaccctaaacgtcccgtaccgggacgggacccgttaacctttaaacgtttttacggtttttacgggttttaaccgtaaaaaaccgggggttccttaccgggtttaccggggggtaacccctaaggtaaccgtaacggtaacttccggaacggtccgggtaccggtaacgggtcccgggggttacaaacggggtacctaacgttacgggtaaacttttcccggaaaccgttaacccgttaaaggtaaaaaaccgttcccggtaaacgggtacccgggtaaaggggggttaacggggtaaacggggtaccggttaaagggggtaaaccgggttacgggtttaccgggggttttaacccggggggtttttaaacctaaaccgggtttaccggtaaccgtaaggttaccgggtaaacctaaaacggttaacgtaaacgggtaaccggttaaccggttacccgggttaccccgtttaaacccggttaaccgtttaaccggttttacggggaacccggtaacgggggtaaccaacgggttcggtaaggggtaactaccggtaaaccggtaaaccggtaacgttgggaaccgtcgtaaccgaccgtaaccttacgg

SEQ ID NO: 193446 - DNA, 646 bp, Homo sapiens
  misc_feature: GYAE6OF02F6W1L.35.82.H05.1.454.CMB.1.raw
  modified_base (164)..(164): a, c, t, g, unknown or other
  misc_feature (164)..(164): n is a, c, g, or t
  modified_base (243)..(243): a, c, t, g, unknown or other
  misc_feature (243)..(243): n is a, c, g, or t
  modified_base (599)..(599): a, c, t, g, unknown or other
  misc_feature (599)..(599): n is a, c, g, or t
tcagtacagatcgtcacgaccggtgctcgatttagtcgagctctctcgcggggactgatcaggactcctcagttctaccttctcacaatgaggctccctgctcagctcctggggctgctaatgctctgggtcccaggactccagtgacgaggttgtgatgactnagtctccactctccctgcccgtcacccttgacagccggcctccactcctcctgtggtgtatcaaagtctgtaccacagngatgaaacactactagaatttcggttacagtcagacgacccgtaggacctaactccgaccggacggaccgtacttaactttagttttcggttaacgtaaaccgggtacttcgtacggggtaccaggtacagtattcgaacgtcggacgaggtcggactacggacacgtgtacgtttcaacacgttagaaaacgtcgaaggccgaggggtcggaagtcgtagggtaaacggacgtttgggttacgggttttaccgagttcggaccgtaatcggaaacacggtattaaccggagtaccgtcggtaacccgtcgaacgttccgtttggaccggtaggaaccgtaacggcgtaacggaanaccgttaccggaaaagtacgttcggagtacctacgtccgacgtaacg

SEQ ID NO: 193447 - DNA, 764 bp, Homo sapiens
  misc_feature: GYAE6OF02GKF88.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggtagtttgggctgagctggattttcctgctaattattttaaaaggtgtccagtgtgaggtgcagctggtggagtcgtgggggaggtcgttaggtaagccgtgggggtccctcgagacctctcctgtactagtctcgtggtacttcagtctaagtgacgtccgtggatcgaacgtcgggtaccgccgacggtcctaccgacgggccggaggggtccgtaggggtaggtcggggttcggtaccgttaaacgttaaaaaccgaaggtacgggtacgggaaggggtacgggaaaccgaaacgacgtaaccgtacggcgtacgggaacccggtaggaaaacggtcgtaacggttaccaaccgtacgttaccgtaacgaagtaacgtatagtaacttaacgaaacgtaaaaccgttcctttaatacgtacgaactaaagtacgtaactacgtaccgtaaacggaaaacccggacggaacctaaacgtaccgttacccgttttaattaccgttaacccgttaaccctaacccttaactaacctaattaacgtacgtaactaccgtaggtaccgggttacttaccgggtacggtaccgtaacgggtaccgttaccggacggtaccctaccgtcccgtacccg

SEQ ID NO: 193448 - DNA, 692 bp, Homo sapiens
  misc_feature: GYAE6OF02GPR83.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttggtaaagccgtggggggtccctcagactctcctgtacagtctctggattcagtctaagtgacgcctggatgaacgtggtccgccaggcctccaggccgaggggctaggaggtgggttcggaccgtataaaaccgagcgtaggtaggttggaacaacgagactacgctggacccgtgaaaggcgaggttcactatctacaagagatagattacaaggaaaaccgtcctttaatctacgactaaagttcaaaccgtacggaccttaaacggaaaacccgtagggaacccaaccgtaacggttacccctttttaaattaccgtttacgtaaacccctaacccctttaacgaaaccttaacgttaaccgttacgaacttaccgtaacggtttacggggtaaaccgtttcggtacgggggaacccgtaagggggtaactaccccggtaacggttaccccgtaaccccggtccttaaccccg

SEQ ID NO: 193449 - DNA, 593 bp, Homo sapiens
  misc_feature: GYAE6OF02ILI9O.35.82.H05.1.454.CMB.1.raw
  modified_base (453)..(453): a, c, t, g, unknown or other
  misc_feature (453)..(453): n is a, c, g, or t
tcagtacagatcgtcacgaccggtgctcgatttagtcgagctctctcgcggggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcttggtaaagccgtggggggtccctcagactctcctgtacagtctctggattcagtctaagtgacgcctggatgaactgggtccgccaggcctccgacggccgaggggcgtgggagtggggttggccgtaataaaaccgagcgtggagggtgggacaacgagactacgctcggacccggtgaaaggctaggttccaccatcctacaagagatagattacaagaaaccgtccctttaanctagacaaatcgaacacgacctacgaaaccgagacacacgtccctttatacttcgtaccctaccttacactattactgtactacaggtcgggtacttcggtacgggaccgagggtactccgaggtcctaccgtctacccg

SEQ ID NO: 193450 - DNA, 663 bp, Homo sapiens
  misc_feature: GYAE6OF02IBQMQ.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggtattttccttgctactaattttaaaggtgtcctagtgtgagtgcagctggtggagtcgtgggggaggcgttggtaaagccgttgggggtcctcgagactcgtcctgtactagtctcgtggtattcgagtctaagtcgacgtcctggatgaacgtgggtccgcgaggtctacgacggccgaggggctggagtgggtggaccggtaattaaaacccgaagtcgtggagggtcggaacaacgagacgtacgcgtacggacccgtaggaaacggtctaggttaccaaccgtatcgtaacaaggagtatacggaattacaaacggtaaaaccgttccctttaagcctggaactaaacgtcgaaaccgaacgaccgttaaagaaaaacccggcggaaaccacgtaacgtaccctttaataacttacgtaacctaccctaagaacctattaacagtaacacgaacgtacgggtacttcggaggtaccagggtaaactccgtaacggtctaccggtatacccg

SEQ ID NO: 193451 - DNA, 654 bp, Homo sapiens
  misc_feature: GYAE6OF02FO3LP.35.82.H05.1.454.CMB.1.raw
  modified_base (242)..(242): a, c, t, g, unknown or other
  misc_feature (242)..(242): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgccccgtcacccttggacagccggcctccacttctcctgttggtgtagtcaaagtctcgtacanagagatggaaacaccttacttagaaatttgggtttcagtcagaggtccaggccaaagttccgtccggaggccgaccttaattttagtttggtttacgtaaacgggcttgtcggggtacccagacagtactacgagcgagcggcggtacgacgcacgtgtacttacgactacgtaagtaaacgtacgacgtacgtaaggggtaggaacgggtcgtagggaggtacgttacgggttaccgggtttactacggtcgtgtacgtacgactaacgaagttacggaacgtacgtcggttacccgttaccgttacgtacgttttaccgggaccggtacgggtaccgacggtagtacggtaacgttaacgaacgtaaaaccgttcggtcggttacgtccggtacgtaccctcgttaaccg

SEQ ID NO: 193452 - DNA, 646 bp, Homo sapiens
  misc_feature: GYAE6OF02FP2PS.35.82.H05.1.454.CMB.1.raw
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgcccgtcacccttggacagccgcctccatctcctgttggtgtagtcaaagtctcgtacacagagataggaaacactacttgaatttggttcagcagagcaggccaatcncgagcgtacctaatttatttgttactaaacgggctcgtggggtccagacagtatcagcgnaggcggtcaggctactgacgtttcaacgtactagtaaaactccgaagcgtaaggggtggaaggtcgttaggacggtagttacgggttaccggggtttaactacgtcgtactagtacggaactaaacgtagtacgaagtaccgtacggtacccgttacccgttaacttaccgggtttttacgggacccggtaaggggtaaccctaacgggtcggttaacgggtaaacggtaacgttaaacccggaaaaccggtaacggttcgggtaccggtaccgtttacggaaccccgtacttaaccgg

SEQ ID NO: 193453 - DNA, 830 bp, Homo sapiens
  misc_feature: GYAE6OF02I9560.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctgggtggagtcgtgggggaggcttggtaaagccgtggggggtccctcagactctcctgtacagtctctggattcagtctaagtgacgcctggatcgtaacgtgggtccgccgaggccgtaccgagggccgacgggggtcctgggtaggtcggggtttcgggacccggttaaacgtttaaaaacccgaaggtccggtaggggaagggggttacggggaacgaaacgacggaacctaacgggccgtacggggtaaccccggttagggaaaacgggtacgaaccggggtttaccaacccgtacgttaccgtaacgaaacggtagtaaacgtagggaactttaaccgaaacgggtaaaaacccggttccccttttaaagtaccgttacggtaaacccgaaaagttaacccggaaacgtaaccgtaacccgttaaacgggaaaaaccccggtaacggtaaaacccgaaccggtaacccggtttaaccccttttttaaagtttaaaccgtttaccggttaaacccttaaccccgtttaaacgtaaccttaactttaccgtacgtaactaaccgttagggtacgggttacttacggcggggtaaccagggtaacctccggtaacggtcctaccgttcctcccg

SEQ ID NO: 193454 - DNA, 560 bp, Homo sapiens
  misc_feature: GYAE6OF02GDQBD.35.82.H05.1.454.CMB.1.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttcctggtgctattttaaaagtgtccagtgtgaggtgcacctggtggagtcgggcgaggcttcgttaagccaggagggtccctaagactctcctgtgcagtttctggattccctttnaatgtcgctggatgaactgggtccncaggctcagggaggctggagtgggtgccgnattaaaggngaattgatggcggacaacagactacgcttcacccgttgagggcagatcaccgtctccaganatgatccatgagtatcctgtctctacaaatgaacacgcctagaaccaaccgaggaccacgacgccgtactacttactcgtacccatcctacgacccagtacctggacctaaccgttcaaccggtacgtaacgttccggacgggggacccgggtaactcccggtacgg

SEQ ID NO: 193455 - DNA, 647 bp, Homo sapiens
  misc_feature: GYAE6OF02FRCIY.35.82.H05.1.454.CMB.1.raw
  modified_base (359)..(359): a, c, t, g, unknown or other
  misc_feature (359)..(359): n is a, c, g, or t
  modified_base (463)..(463): a, c, t, g, unknown or other
  misc_feature (463)..(463): n is a, c, g, or t
  modified_base (641)..(641): a, c, t, g, unknown or other
  misc_feature (641)..(641): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcgttggtaaagccgtggggggtccctcagactcctcctgtacagtctcgtggattcagtctaagtgacgcctggatgaacgtgggtccgccgaggctccgaggccgaggggccgtggaggtgggttggacgtaagtaaaacgagngtggagggtggacaacgagactacgcgtaggacccgtaggaaacggctaaggtcaaccatcctacaagtagatagattcgaaacgtaaaaccgtccttttaacnccgtagaacctaaagtacgaaacacggtaccctaaggaaaacccggacgaaccgacgtaccgtacccttttaattacgttacgtaacccctacctttaacgactaactttaccagttatacgtagtaggggtaccctttggaccgggtacacggggtactaccgaggtcctaccggtntacccg

SEQ ID NO: 193456 - DNA, 722 bp, Homo sapiens
  misc_feature: GYAE6OF02HA53G.35.82.H05.1.454.CMB.1.raw
  modified_base (500)..(500): a, c, t, g, unknown or other
  misc_feature (500)..(500): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggagcttggtaaagccgtcggggggtccctcgagacctctcctgtacagtctctggattcagtctaagtgacgcctggatgaacgtcgggtccgccaggcctccgaggccgacggggcgtgggaggtgggttcggtccgttaaagttaaaaccgaagtccggtaggacggggtagggaacaacgacgaactacggacgtacggacccggtagaaacggtcgtaacggttccaaccgtagtacctacgtaaggatagtgtaacgttacgaaacgtaaaaccgtcccgtttaanaccgtagaactaaagtcggaacacgtacctaacgaaaaccgcggaaactaccgacgttacctttaagttacgttacttaacccgttacgttaaaccgaacttacgttaacgtacgtaacgttaaccggtaggttccgggtaacgtttacccgggtacggggtaacgtaacggggtacccgttaaccgaaccgggttacccggttaccctcccggttaacccg

SEQ ID NO: 193457 - DNA, 624 bp, Homo sapiens
  misc_feature: GYAE6OF02GGUUE.35.82.H05.1.454.CMB.1.raw
  modified_base (268)..(268): a, c, t, g, unknown or other
  misc_feature (268)..(268): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
tcagtacagatcgtcacgaccggtgctcgatttagtcgagctctctcgcgggggggagaggagccccagccttgggattcccaagtgtttcattcagtgatcaggactgacacagaggactcaccatggagttggctgagctggattttcctgctactatttaaaaggtgtccagtgtgaggtagcagctggtggagtcgtgggggagtcgttgggtaaagccgtcggggggtccctcgacgtctctccgtgtacacggtctcgtagnttcagtactaagcgacgcctggatcggtaacgtcgggtccaccgtaggcctaccgaggccgaggggctggaggttgggtacgaccgttaaagttaaaccgaggtcggtggacgggtggaacaacgagaactacggctacgggacccgtagaacgggctagttccaacctatccganagngaacgtgtaactacgaagaaacgtccttaagctagactaancgaancgactacgaagcgacganacgttccttatacgtacacctactcgaactattcagtactagtacggtccggtaatccggtagggacccgtaaggtaccgtacggtaccggtacctacccgggtcctaaccgg

SEQ ID NO: 193458 - DNA, 798 bp, Homo sapiens
  misc_feature: GYAE6OF02HOZQC.35.82.H05.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaggactccagtgacgtaggttgtgatgactcagtctccatctccctgcccgtcaccctggacngccgcctcatctctgttgtntagtcaaattctcgtacacagagatacggaacaccttagtgtaatttcggttacagtcgaggacggtaccgacggcctaactccgtaccggaggtccgtactttaacgttttacgtttacgggtttactaaaccgggtacttccgtacggggttccccaagtacctaggtacttaccgacggtccgggactacgggtaccgggtaccgacgggtacctaaccgttacggtaacttttaccgaacgttaccgtaagtaaaaccgtcgtaccgggtacggtaacgggggttacggtaacggtaccggtaggtaacgggttacggttacggggttttaaccgggggttttaaccctaaccgggttcgtaacccgttaagttaacccggtaacgttaaacccggtagttaaccggaacggttaccggtacccgggttacccgtttacccggtaacgtttacggttttcccggggaacccgtaacggggtacccttaaacgggtccgttaacggggtaactaaccggtaacccgtaaacggttaccgttggtaacccgggttcgtaacgtacccggtaccgttaacg

SEQ ID NO: 193459 - DNA, 729 bp, Homo sapiens
  misc_feature: GYAE6OF02JB1XB.35.82.H05.1.454.CMB.1.raw
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggattttccttgctactattttaaaaaggtgtccagtgtgaggtgcagctgggtggagtcgtgggggaggcttgggtaaacggccgtggggggtccctcgagacctctcctgtacagtctctggattcaccttcagtatcacttcggatgctacgtgggtccgtacgaaagggttcccgggggaaggggtcgtagggttggttacggggtttctaacggttacttaacggaagtgacggtcgggactaggaactaacgaactaccgtacgccggtaccgtaccggtaggaacgggtccgtaagtttcccaccccccgttacgaacgacggaaacctaacccgaccgaaacgtaaaccaacctaacgtaactaactcgtagaacctaaagaacgaactaagtacttaggaagaaccggtacggaacggtaacgaccgtaacgtcgttacttaaccgtttactacgttagaccggtaaagacggtacggtactaacgtaacgtacgtaacggtttaggttttaagtacgttccgttacggtaccggggaccggaaagggtaacccgtaaggttacggttaacccg

SEQ ID NO: 193460 - DNA, 634 bp, Homo sapiens
  misc_feature: GYAE6OF02FP597.35.82.H05.1.454.CMB.1.raw
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaggatccagtgacgaggttgtgatgactcagtctccactctccctgacccgtcacccttggacacgccgcctaccattcctccgtgttggtgtagtactaaagtctcgtacactagagatggaaacctacctacgttgtaagtttggttcgagcgaagacggcccaggtaccaaatccgtaccgaggccgtaccttaatttagttttcggtttacgtaaacgggtacgttcgtacggggtacccagtaccgagtattcgaggaccgcgaggtcggacgacggctacgtgtatttacacactagtaaaacncgagtagtagggnggaagngttaggaaggtagtacgggtttacgggtttacgtacggtcgtacgatacgacgtaataacgtaagtacggaccgttcgtacccgttacgtacgttaccgtttacggaccggtacgggaccgagtcggtaggactaacgtaacgaacgtagtcggtgtactcgaccgtatacg

SEQ ID NO: 193461 - DNA, 732 bp, Homo sapiens
  misc_feature: GYAE6OF02IXWCN.35.82.H05.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (321)..(321): a, c, t, g, unknown or other
  misc_feature (321)..(321): n is a, c, g, or t
tcagtacagatcgtcacgaccggtgctcgatttagtcgagctctctcgcggggggggagaggagccccagccttggggattcccgaagtgttttcattcagtgatcaggactggaacacagaggactcaccatggagtttgggctgagctggatttctgctatatttaaaggntaccagtgtgaggtgnagcgtgggtaggacgttcggtggggggacgtcgtttgggcccaggtcccgttggggaacggttccctggacgtactccgtcctggtagaacgtcccttagtggtactttcctaccttacaaagtaacttagnggactagtcgctacggtcgggtccgacgacgggtcctccggaagggccggaaagggggcctagggtacggttggggtacggcgtagggtagaacgtttacgacctagttttcggaagtttaacgggtaaagttaaacgtaaacgtacgttaacggacctagtacccgtacggttaaggacgggtaccgtactttaccgactacgttaccgacaggtaactaacctaaacgtaccaaacgaaccttacgtacttccgtactacgcctacaacctagtacgaacgtacgttcgtacggacgttaacgggagtaccctagggtaccctttaggtaccttaacgttacggtagttacggaacggtcgaaacggtattaaacggtaatttaacggtcgtacgtacgttaggtacgg

SEQ ID NO: 193462 - DNA, 780 bp, Homo sapiens
  misc_feature: GYAE6OF02ISZ0Z.35.82.H05.1.454.CMB.1.raw
  modified_base (138)..(138): a, c, t, g, unknown or other
  misc_feature (138)..(138): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (560)..(560): a, c, t, g, unknown or other
  misc_feature (560)..(560): n is a, c, g, or t
tcagtacagatcgtcacgaccggtgctcgatttagtcgagctctctcgcggggactgatcaggactcctcagttcaccttctcacaatgaggctccctgctcagctcctggggctgctaatgctctgggtcccaaggntccagtgacgaggttgtgatgactcagtctcctactcctcctgcccgtcacccttgacagccgcctcatctctgttgtntagtcaagtcncgtacacagagataggaactacctactttagaaactttggtttacacgtacaggacggtcccgaagggacccaaagttccggtacccggaccggggtaccgacccttttaaattttaccgtttttacgggttttaacccggttaaaacccgggggacgttttccgggttacgggggtacccccgtaagggaaaccgtacgttacttcccgtaagggccgggtacaagggtcccggggtaacgacgggtaccctacgttacggttaacttttacccgaacgtacgttaaccggaaaaacttggaaccggtacggtacgggggtagggacggtntagggtaagggtacggttacggggttccgggttttacgttaacgtcggtcgttaacgtcggtacgaaaacgtagtaacggaccggtaacgtcccggttaccgttacccgtaacctttaagggtttcccggaaccgggtaccgggacgtacgggtacgtacggtaataacgtacccgaaaacggtacggttacgtacggccgttacggtacgacccgttag

SEQ ID NO: 193463 - DNA, 920 bp, Homo sapiens
  misc_feature: GYAE6OF02FKKS8.35.82.H05.1.454.CMB.1.raw
  modified_base (280)..(280): a, c, t, g, unknown or other
  misc_feature (280)..(280): n is a, c, g, or t
tcagtacagatcgtcacgaccggtgctcgatttagtcgagctctctcgcgggggggagaggagccccagccttgggattcccaagtgttttcattcagtgatcaggactgaacacagaggactcaccatggagtttgggctgagctggtattttccttgctactaatttaaaaggtgtccagtgtgaggtgcagcgtggtggagtcggtgggggaggcgttgggtaaacggccggtcggggggtccctcacggacctcctcctgtacagtcctcgtggtnttcgagttacgtaagtgaccgccgtggtactacggaacggttccgggtaccgtccggacggtccctcccggaacgggcccggaagggggtccgtaggggagggttcgggggtttcgggtaacccggttaaaacgttaaaaacccgtaagggtaccgggttaggggtaacgggggttacggggaaaccaaacgaacggtaaccgtaaccgtccggtaccgggtaaccccggtagggaaacgggtccgtaacgggttacccaaccccgtacgttacccgtaacggaaaggtacggtaacttacggttaacttaaccgtaaaaccgggtaaaacccgtttaccccttttaagtaacccgttaacgtaaccgttaaaaacgttaccggtaaaaccgtaacccgggtaccttaaaaccggggaaaaacccggtaccggtaaaccgaacccgttaaacccgtttaaccccgtttttaattttaaacccgttttacccggttaaacccccttaacccgtttaaaccgaactttaaccgtttaaccgttacgtaataaccggtaagggttacccgggtaactttccggggaccgggtaccggtaacggtacgtacccggtaacggtcccgtacccgtacgttaccccg

SEQ ID NO: 193464 - DNA, 490 bp, Homo sapiens
  misc_feature: GYAE6OF01CQKW0.11.76.G10.1.454.CMB.1.raw
  modified_base (225)..(225): a, c, t, g, unknown or other
  misc_feature (225)..(225): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctcctaaactgctcatctcctgggcatctacccgggcacccggagtccctgaccgattcagtggcagcggtctgggacagacttcactctcaccatcagcaacctgcaggctgaagatgtggctagtttatactgtcagcagtattgtgaagctccgctcacgtttcggcggagggaccgcgggtggagatcgagacgaatggtggctcg

SEQ ID NO: 193465 - DNA, 472 bp, Homo sapiens
  misc_feature: GYAE6OF01CU9AM.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccataagagagattgtagttggtacaacagaagccaggccagcctccaaagcagctcatttatgggcatctactcgggattccgggtcctgaccgatccgtgcagtggatctgggacaaatttcactctcacatcaatagcctgcaggctgaagatgtgcagcttattatgtcagcaatatatacttctctcgatctactttggccagggaccaggctggagatcagacgaactgtgtcg

SEQ ID NO: 193466 - DNA, 490 bp, Homo sapiens
  misc_feature: GYAE6OF01BCQJH.11.76.G10.1.454.CMB.1.raw
  modified_base (339)..(339): a, c, t, g, unknown or other
  misc_feature (339)..(339): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccgggtcctgaccgattccgnggcagtggatcgtgggactaaatttcactctcaccatcaatagcctgcaggctgaagatgtggcagcttattattgtcagcaatattatacttctcttccgtatctactttgccgtagggaccaggctggagagtcagacgacgtgtggcg

SEQ ID NO: 193467 - DNA, 625 bp, Homo sapiens
  misc_feature: GYAE6OF01CEBKI.11.76.G10.1.454.CMB.1.raw
  modified_base (296)..(296): a, c, t, g, unknown or other
  misc_feature (296)..(296): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (474)..(474): a, c, t, g, unknown or other
  misc_feature (474)..(474): n is a, c, g, or t
tcagcgagagataccacgaccggtgctcgatttagtcactcatacgaggggaggtctgagagaggacgccccgcccgtgggatttgcaggttattttcattgggtgctcaggactgaaacaaagagaactcaccatggaactcgggctgagcgtggtctttttctggtggcttaattttaaaaggtgtccagtctacaacgagactactggaatcgtgggggcacttgtgctggccgggagggtcctgagactctcctgtgcagcctctggacttccccttgatttcactttcatntggccgttcgggtccgccaagcctccggagggggganagttggagtgggtccgcctccgatgaattcgaattctatgataatttgatgcgtactcgtggaagggctatttacngtcgccgcagactaagacgaacaactacttattcctaccactacttaccaaccgcacagtcgaanacgacggaccaaattactttacctgtaggtacggtaagggttgggtttttcggttgggggtacctaagtttcggtaccgttccccgtttagtaccgtggtcccggtttggggacccgacggggtaaccccgttcggtcccgaccggttccc

SEQ ID NO: 193468 - DNA, 592 bp, Homo sapiens
  misc_feature: GYAE6OF01C22YS.11.76.G10.1.454.CMB.1.raw
  modified_base (284)..(284): a, c, t, g, unknown or other
  misc_feature (284)..(284): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtcctccagtacttccctggctgtgtctcgtgggcgagaccggccaccatcaactgacaagtccagtcagtaattcttttaagacttattaccaactaagagagtatttgttagtttaggtaaccaanagaagccaggccagccctaccaaagcagctactatttagtgggctatctacgtcgggtacgttcccggggtcctcggaacccgtacgttcccggtggccgtaggttgggacttcggtagggaaccttaaatttccgactcctacacctatacaatacgcctgacaggctagaagtagtgtagcagtactttattagtgtacaagtactaaattattaactactttcctcttccgtattccttacgtttcggaccgtaacggggcccagggtccgttagggactagtacgaacggtaacgtaagtcggg

SEQ ID NO: 193469 - DNA, 543 bp, Homo sapiens
  misc_feature: GYAE6OF01A3QNM.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaattctttagactattccataagagagtatttgttagtttggtaccaacagaagccaggccagcctaccaaagcagctcatttatgggcatctactcgggtacttcccggggtcctagaccgtattcccggtggcaggtggatcgtagggactaaagtttcactctacaccatcaatgcctgcaggctagaagagtgtggcagtctttattattgtacagtctaaatatttattacttcttaccttccgtattacttacgttttgggcccgtaaggggtacccaagggtctagggagacgtacgacgaacgtaacgtggtggtccg

SEQ ID NO: 193470 - DNA, 492 bp, Homo sapiens
  misc_feature: GYAE6OF01BWDJ4.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctccaaagcagctcatttatgggcatctactcgggattccgggtcctgaccgattccgtggcagtgatctgggacaaatttcactctcaccatcaatagcctgcaggctagaagatgtggcagcttattattgtcagctaatattatacttctcttccgattcctacgttttggccctaggggaccaggctggagatacagcgaagtcgg

SEQ ID NO: 193471 - DNA, 507 bp, Homo sapiens
  misc_feature: GYAE6OF01C3876.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagtatttgttagtttggtaccaacagaagcaggccagcctccaaagcagctcatttattgggcatctactcggattccgggtccctgaccgattccgtgcagtggatctggactaaattcactctcaccatcaatagcctgcaggctgaagatgtgcagcttattattgtacagacaatattattacttcttcttccgattctacgttttcggaccgtaggggtaccaggtcctgggacgtaatcgaagacgtaacgtacggg

SEQ ID NO: 193472 - DNA, 532 bp, Homo sapiens
  misc_feature: GYAE6OF01C4TGM.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccataagagagatttgttagtttggtaccaaacagaagccaggccagcctccaaagcagctcatttatgggcatctactcgggattccggggtcctgaccgattccgtggcagtggatcgtgggacaaatttcactctcaccatcaatagcctgcaggctgaagatgtggcagtctttattattgtcagtcaattattattacttcttcttaccgtattcctacttttcggacccgtaacggggtaccctagggtccgtagggaagtacgtacgtaaggaacgtaaacgtggtggtaccg

SEQ ID NO: 193473 - DNA, 537 bp, Homo sapiens
  misc_feature: GYAE6OF01BY0KE.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagaatctttagactattccactaagagagtatttgttagtttggtaccaacagaagccaggccagcctccaaagcagctcatttatggcatctactcgggattcccggggtccctgaccgtattccggtggcaggtggatcgtgggactaaatttcactctacaccatacaatagcctgcaggctagaagagtgtggcagtctttattagttgtcagctaattattattacttctcttaccgtattcctacgtttcggccgtacggggtacctagggtcgtagggaagtacgtacgaacggacgtaactggtcggtaccg

SEQ ID NO: 193474 - DNA, 535 bp, Homo sapiens
  misc_feature: GYAE6OF01C4IER.11.76.G10.1.454.CMB.1.raw
  modified_base (431)..(431): a, c, t, g, unknown or other
  misc_feature (431)..(431): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccaataagagagtattgttagtttggtaccaacagaagccaggccagcctaccaaagcagctcatttatgggcatctactcgggtacttccggggtccctggaccgactttccgtggctagtggatcgtgggacaaagtttcaactctacacctactacaatagcctgcagctagaagatggtgcagtcttattattgtnagctaatatattacttctcttccgattacctacgtttggacccgtaaggggtacccagggtcgtagggagtacgtacgaacggtacgaacgtggtcgggtaccg

SEQ ID NO: 193475 - DNA, 632 bp, Homo sapiens
  misc_feature: GYAE6OF01C8LHU.11.76.G10.1.454.CMB.1.raw
  modified_base (493)..(493): a, c, t, g, unknown or other
  misc_feature (493)..(493): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggcttattttaaaaggtgtccagtctacaacgagactactggaatcgtgggggcgacttcgtgctggccggggagggtccctgagacctctcctgtgcagccctctggacttcccccttgacttcactttcactatcggcctggggtcccgccaagccgtccgaggggggagagttggaggtcgggtcgcctccatgaattcgaattctatgactaatttgtatgcgtactccgtggaggggctatttactgtcgcgcagacatgtacgaacaactaccttactccctccactacttaccacgcgacagtacgaagaccacggacctaattntttactgtagtacggtaaggggtttcggttttacgggtgggggtactaaggtttcggttcccggtcccgttttcggaccgttcgggcccggttcgggggacccgaacgggggtaacccccttgggtcccgtaaccccgg

SEQ ID NO: 193476 - DNA, 725 bp, Homo sapiens
  misc_feature: GYAE6OF01APRYD.11.76.G10.1.454.CMB.1.raw
  modified_base (277)..(277): a, c, t, g, unknown or other
  misc_feature (277)..(277): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagaattcttttagacttattccaactaagagagtattttgttagtttggtaaccaanagaagccaggccagccctaccaaagcagctcatttatgggctatctacgtcgggacgttcccgggtcctggtaccgtagttcccggtggcgaggttcggacttccgtaggggtaactaaattttccacgttacctccaacccgtattacccgaaattaccggtcccgttaggaccgtaacgggtaccgttaggaaaacggtaggtttacggtcggggtacctaacgggtttaccttttaaagttttacggttacggttaaccgtaacggtacttaaagttttactttaaacttacccttttaccttaccgtttacccgtaactttacccgtttaacgggtttttccgggaaccccggttaacggggggtaaccccttaacggggttcccggttaagggtaaccggtaacgttaaccggaacgggttaaacccggtaacggttacgggg

SEQ ID NO: 193477 - DNA, 525 bp, Homo sapiens
  misc_feature: GYAE6OF01AZFVO.11.76.G10.1.454.CMB.1.raw
  modified_base (396)..(396): a, c, t, g, unknown or other
  misc_feature (396)..(396): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgtagtttggtaccaacagaagccaggccagcctccaaagcagctcatttatgggcatctactcgggattccggggtcctgaccgattccgtggcagtggatctgggactaaatttcactctcaccatcaatagcctgcaggctgaagntgtgcagtctttattattgtcagtacaattacttaattacctttctaccttccgattcctacgttttcggacccgtaggggtacctagggtcctagggtagaagttccaaggacgtaactggtggtccg

SEQ ID NO: 193478 - DNA, 608 bp, Homo sapiens
  misc_feature: GYAE6OF01CCHBS.11.76.G10.1.454.CMB.1.raw
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttctgtggctattttaaaggtgtccagtctacaacgagactactggaatcgtggggcgacttcgtgctgccggggagggtccctgagactctcctgtgcagcctcgtggacttccccttgattcactttcacatcggccgtgggtccncaagcctccgaggggganagttggagtcgggtcnccgtccagtgaattcgaattcttatgtactaatttgtatgcggtactccggtagaagggcgtatttacngtcgccgcagacaacgtacgaacaactaccttntacctcactacttaccaacgcacacgtacgaacgacgacgacctaaattactttacctgtagaccggtagggttcggttttcggtggggactaagttcggtccgtcgtttaggaccttggaccggttcgggacccgtacgggtaacccgttcgggtcccgtacgttcccg

SEQ ID NO: 193479 - DNA, 558 bp, Homo sapiens
  misc_feature: GYAE6OF01DIQF9.11.76.G10.1.454.CMB.1.raw
  modified_base (343)..(343): a, c, t, g, unknown or other
  misc_feature (343)..(343): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccataagagagatttgttagttggtaccaacagaagccaggccagcctaccaaagcagctcatttatgggcatctactcgggattccggggtccctgacccgtattcccgnggcaggtggatcgtggacaaatttcacttctacacctatacaatacgcctgcaggctagaagtatgtggctagtctttaattacttgacagactaattattacttacttcttccttacgtacttctaccgttttcggacccgtaagggggtacccaggggtccttaggggagtaacgttccgaaacggtaaccggtaaacgttgggtcgggtccg

SEQ ID NO: 193480 - DNA, 528 bp, Homo sapiens
  misc_feature: GYAE6OF01EM4KY.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctaccaaagcagctcatttatggcatctactcgggattcccggggtcctgacccgtattccgtggcaggtggatcgtggactaaatttcactctcaccatcaatgcctgcaggctagaagtgtgtggctagtctttaattattgtcagtactaattattactactttctccttccgtattccttacgttttcggacccgtaggggtacccagggtctagggtagactacgaacgtacgaacgtggg

SEQ ID NO: 193481 - DNA, 583 bp, Homo sapiens
  misc_feature: GYAE6OF01EI64J.11.76.G10.1.454.CMB.1.raw
  modified_base (272)..(272): a, c, t, g, unknown or other
  misc_feature (272)..(272): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagactattccactaagagagtattttgtagtttggtaccaacagaanccaggccagcctccaaagcagctcatttattgggcatctacgtcgggacttcccgggtcctgaccgtatccagtcggctaggtggattcgtagggaactaaatttccacttcctacacctatacaatacgtcctcgacaggctagaagtagtgtgacgagtcttattattgtacagtactaattaatttaattacctttacttaccttccgtacttcgttaaccgtttttcgggaccggtaacgggggtaccctacgggtacgttagggaacgtacgtaccgaacggtaaccgtaaacggttcggtacggg

SEQ ID NO: 193482 - DNA, 735 bp, Homo sapiens
  misc_feature: GYAE6OF01CAP7B.11.76.G10.1.454.CMB.1.raw
  modified_base (151)..(151): a, c, t, g, unknown or other
  misc_feature (151)..(151): n is a, c, g, or t
tcagcgagagataccacgaccggtgctcgatttagtcactcatacgaggggagctacaacacggcaggacaaggggcagcaagatggtgttgcagacccaggtcttcatttctctgttgctcgtggagtctcttggtgtccttggcggganactattcgtgagtagacccacgtctccgagtacttcccgtggcctgtgtctcgtggacaggacgccaccagtcgaactgactaacgtccagtcagtacttctttagctatccactaagcgagtactttgttagttacggtaccagtagacgcgacggcctacgccctacgaaagcgaacgtcgtactagtttagtcgggactacgtacgtaccgtacgggtacgttcccgggtacctacggtaccgtacgtttaccggaggtacctagggtacggacttacggtacgggaaacttaaagtttccaaccgtcgtaccaaccgtacttaacgaacgtaccgtcccgtacggaaccgtacgggtaccgtaagggaaaccgtgtttcgggaccgggtacgtaggttaaccttttagtttacgttacggttaccgaacggttaccttaaaacgtttattttaaaccttccgtttacgttaccgtttaccgtaagttttaccgttacggttttaccggggaaccggttaacgggtaccgtacgggtacgtagggtaactacgtaggtaaacggtaccgttaaggttcggg

SEQ ID NO: 193483 - DNA, 493 bp, Homo sapiens
  misc_feature: GYAE6OF01A7M2S.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccggggtcctgaccgattccgtggcagtggatctgggacaaatttcactctcaccatcaatagcctgcaggctgaagatgtggcagcttattattgtcagcaatattatacttctcttcgatctactttggcctaggggtaccaggctaggagtactcgagacgaactgtggtcg

SEQ ID NO: 193484 - DNA, 503 bp, Homo sapiens
  misc_feature: GYAE6OF01AMME9.11.76.G10.1.454.CMB.1.raw
  modified_base (295)..(295): a, c, t, g, unknown or other
  misc_feature (295)..(295): n is a, c, g, or t
  modified_base (482)..(482): a, c, t, g, unknown or other
  misc_feature (482)..(482): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagtatttgttagtttggtaccaacagaagccaggccagcctccaaagcagctnatttatggcatctactcgggtattcccgggtcctgaccgtattccgtggcagtggatcgtgggactaaatttcactctcaccatcaatacgcctgcaggctagaagatgtgcagtcttattattgtcagctaattattatacttctcttacgattctactttggacgtacgggtacaggtctagganatacgagacgactggtcgtcg

SEQ ID NO: 193485 - DNA, 500 bp, Homo sapiens
  misc_feature: GYAE6OF01BKMY3.11.76.G10.1.454.CMB.1.raw
  modified_base (478)..(478): a, c, t, g, unknown or other
  misc_feature (478)..(478): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggttaccaacagaagccaggccagcctccaaagcagctcatttatgggcatctactcgggattccggggtccctgaccgattccgtggcagtggatctgggacaaatttcactctcaccatcaatagcctgcaggctgaagatgtggcagcttattattgtcagcaatattatacttctcttccgatctacttttggaccgtaggggacccaggtctggganatacagacgaactggtggtccg

SEQ ID NO: 193486 - DNA, 501 bp, Homo sapiens
  misc_feature: GYAE6OF01EKB08.11.76.G10.1.454.CMB.1.raw
  modified_base (268)..(268): a, c, t, g, unknown or other
  misc_feature (268)..(268): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaanagaagccaggccagcctccaaagcagctcatttatgggcatctactcgggattcccgggtcctgaccgattccgtggcagtgatcgtggactaaatttcactctcaccatacaatagcctgcaggctagaagatgtggcagtcttattattgtcagtcaattattatacttctcttccgtatctacgtttggccctaggggcccaggcgtagggacatacaggacgtacgtgg

SEQ ID NO: 193487 - DNA, 533 bp, Homo sapiens
  misc_feature: GYAE6OF01DZVGW.11.76.G10.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagcgagagataccacgaccggtgctcgatttagtcactcatacgaggggacaaccgaggcaggcaggggcagcaagatggtgttgcagacccaggtcttcatttctctgttgctctggatctctggtgcctgcggacgacatcgtgatgacccagtctccagacttccctggctgtgtctctgggcagccggccaccatcaactgcaagtccagtcagatctttagactnttccataagngagatttgttagttgtaccaanagaagtcaggccagcctaccaaagcagctcatttatgggcatctacgtcgggtattcccggggtccctgaccgtacgttccgcggcagtggactcgtggaactaaactttccacttctacaccatcaatacgctgcagctagaagntgtggcacgtnttattnttgcagnaattnttattacttctcttccgattctacgttttggccgtaacggggtaccgagggtccgtagggagtaacgtcaaggaccgtaacgtggtcggtaccg

SEQ ID NO: 193488 - DNA, 611 bp, Homo sapiens
  misc_feature: GYAE6OF01AM54X.11.76.G10.1.454.CMB.1.raw
  modified_base (367)..(367): a, c, t, g, unknown or other
  misc_feature (367)..(367): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagaccggccaccatcaactgacaagtccagtcagtaattctttagacttattccactaagagagtatttgttagttggtaccaacagaagccaggccagcctccaaagcagctctatttattgggactatctaacgtcgggtactttcccggggtccctggacccgtatttcccggnggccaggtggatcgtaggactaaatttcactctcactactcaatacgcctgcgtaggcctaggaagacgtggtacggcagtaccttttaattacgttacgttacgaagtactaaagtttaactttaacttaaccgtttccttaccttaccgtaacttaccgttaccgtttttcgggacccgtacgggggtaccctagggtcgttacgggaacgtacgtacgaaacggtaacgtaacgttacggg

SEQ ID NO: 193489 - DNA, 497 bp, Homo sapiens
  misc_feature: GYAE6OF01DS0NW.11.76.G10.1.454.CMB.1.raw
  modified_base (484)..(484): a, c, t, g, unknown or other
  misc_feature (484)..(484): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaaagagagatttgttagtttggtaaccaacagaagccaggccagcctccaaagcagctcatttattgggcatctactcgggattccgggtccctgaccgattccgtggcagtggatctgggacaaatttcactctcaccatacaatagcctgcaggctgaagatgtgcagcttattattgtctagctaatattatacttctcttcgatctacgtttggccacggggaccaggctacggtagatnaagacgaacgtgg

SEQ ID NO: 193490 - DNA, 575 bp, Homo sapiens
  misc_feature: GYAE6OF01BW5LG.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatctgggggcgacttcgtgctgccgggagggtccctgagactctcctgtgcagcctctggacttccccttgattcactttcacatggcctgggtccgccaagcctccgaggggggagattgggagtgggtcgcctccatgaattcgaatttcttatgactaatttgtatgcggactccgtgaaggggctatttacgtgtcgccgcagacatcgtcgaacaactaccttacttccctaccacacttacccaacgccgacacgtcgaagacacggaccaaattacttctgtgcgtaagggttggttttcggtggggtactaagttcgtcgcccgtttgactggcgtcggggccagggtaccctggtcctacccg

SEQ ID NO: 193491 - DNA, 537 bp, Homo sapiens
  misc_feature: GYAE6OF01DJYM4.11.76.G10.1.454.CMB.1.raw
  modified_base (274)..(274): a, c, t, g, unknown or other
  misc_feature (274)..(274): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagacttcttttatatagtgtacaacgataaggactatttagcttggtatcagacaaaaacnggacagcctacctaaactgctcatctctgggcactcgtaccccggcacccggactcccgtcgaccgtattcagtcggcacggcgggtcgtgggacagacttcactcncacatcancactgcagcngantgngtctagtttnacttgcagctagtagttgtgaacgtccgtaccgtcttcgaccgtttcgggacgggtacggggtacccggtgggtcggaagtacgttaccgaacggtaacggtacgtggttgggcctaccggg

SEQ ID NO: 193492 - DNA, 535 bp, Homo sapiens
  misc_feature: GYAE6OF01CQH9F.11.76.G10.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaattcttttagactattccataagagagtatttgttagtttggtaccaacagaagccaggccagccctaccaaaagccagctcattttatgggctatctactcgggattcccggggtcctgaccgatttccggnggcaggtggatcgngggtactaaatttcactctcaccatacaatacgcctgcaggctagagagtggtgacagtctttattattgtcagactaattattattacttcttcttccgtatctactttggaccgtacggggaccagggtcgtagggagtacgtacaacggtacgaactggtcggtccg

SEQ ID NO: 193493 - DNA, 794 bp, Homo sapiens
  misc_feature: GYAE6OF01BTU22.11.76.G10.1.454.CMB.1.raw
tcagcgagagataccacgaccggtgctcgatttagtcactcatacaggggaggtctgagagaggagccccgccctgggatttgcaggttattttcattgggtgctcaggactgaacaaagagaactcaccatggaactcgggctgagcgtggtcgttttcttagtggactaattttaaaaggtgtccagtctacaacgagactaacgtggaatcgtgggggcgtacttcggtgcgtggccggggagggtccctgacgactctcctgtgcagcctctggtactttcccttgtattctacttttcacgagttcggccttggggtcccaccgaaggccgtccggaggggggagtaagtttggggaggttcggggtccgtcccttaccgtaagttggtaaacgtttacggttaaattctttacgttagtaaccttaaagttttgtaaacgttggtacccgggtaacggttcccggtaaggggtaacgggggtacgttacgtttttaacggccggttccggacccgacgtaggtaaaccgaacggttaccggaaacctaaaccctaacccttttaacttacccctaacctaactaaccgttaaaccaaaccgtcccgaacgacggttaacgaaccgacgaaccggtaacctaaagttactttcgtagtacgtaccgggttaagggtttcggttttacggggttacggggtcttaaagttcggttcccgttccctttaggtaccgttcggacggttccggggaccgtacggggtaacccgtcggtacccgtcccgttccg

SEQ ID NO: 193494 - DNA, 577 bp, Homo sapiens
  misc_feature: GYAE6OF01BB21P.11.76.G10.1.454.CMB.1.raw
  modified_base (266)..(266): a, c, t, g, unknown or other
  misc_feature (266)..(266): n is a, c, g, or t
  modified_base (351)..(351): a, c, t, g, unknown or other
  misc_feature (351)..(351): n is a, c, g, or t
  modified_base (446)..(446): a, c, t, g, unknown or other
  misc_feature (446)..(446): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgacaagtccagtcagaattctttagactattccataagagagtatttgttagttggtaccaanagaagccaggccagcctaccaaagcagctctatttagtggctatctacgtcgggtacgttccgggtcctgaccgtagttcccggnggcgtaggtggtatcgtagggactaaatttccactctcaacctatacaatacgctagcgaggctagaagtgtgtgcagtctttaattattcgtanacgtactaattactttacttacttccttacttccgtacttccgtacgttttccgggaccggtaacggggtaccctaggggtccgtagggaagtacgtacggaacgtaaccggtaacgttgggtcggtaccg

SEQ ID NO: 193495 - DNA, 545 bp, Homo sapiens
  misc_feature: GYAE6OF01CKGEW.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagtatttgttagtttggtaccaacagaagccaggccagcctccaaagcagctcatttatgggcatctactcgggacttcccggggtccctggaccgtattcccggtggcaggtggatcgtgggactaaatttcactctcaccatcaatagcctgcaggctgaagatggtggcagtcttattattgtcagctaattattattacttctcttaccgtattcctacgttttcggaccgtacggggtacccagggtccttagggtacgtacgttaccgaacggaccggtaaacgttggtcggtaccg

SEQ ID NO: 193496 - DNA, 602 bp, Homo sapiens
  misc_feature: GYAE6OF01EQ6JO.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtcctccagtacttccctggcttgtgtctcgtgggcgagaccggccaccatcaactgacaagtccagtcagtaattcttttagacttacttccaactaaagagagtattttggttagtttggtaccaacagaagccaggccagccctaccaaagcagctctatttagtgggctatcctacgtccgggtacttcccggggtccctggacccgtattccgtggcctaggtggatcgtaggactaaatttcactctacaccatacaatacgcctgcagtacctagaagtagtggtcggactagtacctttatttagttcgtactaagtactaacttatttaacttactttccttcctttacccgtactttaccgttaccgtttttcggacccggtacggggtaccgtacggtcggtaggtacgtactacgaacgtaacggtacgtcggg

SEQ ID NO: 193497 - DNA, 554 bp, Homo sapiens
  misc_feature: GYAE6OF01BF6J9.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcagacggccaccatcaactgcaagtccagtcagaatctttagactatccactaagagagtatttgttagtttggtaaccaacagaagccgaggccagcctaccaaaagcagctctatttagtgggctatctacgtcgggtagttcccggggtcctgaccgtattccggtggactaggtgtatcgtggactaaagtttcactctcacctatacaatagcctgacgaggcctaggaacgataggtgctagtctttaattagttgtcgagtactaattattatactttctcgttacctactctacgttttcggacccgtaggggaccctagggtcgtacggtacgtaagtacgaacggtaccgaagttcggg

SEQ ID NO: 193498 - DNA, 563 bp, Homo sapiens
  misc_feature: GYAE6OF01B2DTP.11.76.G10.1.454.CMB.1.raw
  modified_base (352)..(352): a, c, t, g, unknown or other
  misc_feature (352)..(352): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtacttccctggctgtgtctcgtgggcgagacggccacatcaactgcaagtccagtcagatctttagactattccaataagagagtatttgttagtttggtaccaacagaagccaaggccagcctacaaagcagctctatttatggactatctacgtacgggtagttccggggtccctgaccgtagttccggnggaccaggtggacttcggtacgggaactaaatttccacttctactaccatactaatacgactcgacgagacgtagaagagtgcggactagtacttattagttgtactagtactaatattactacttctaccttaccgtattcctacgtttacggaccgtacgggtaccgaggtcgtaggacgtacgtacgagtaacgaacgtggtggtccg

SEQ ID NO: 193499 - DNA, 535 bp, Homo sapiens
  misc_feature: GYAE6OF01CSFVZ.11.76.G10.1.454.CMB.1.raw
  modified_base (348)..(348): a, c, t, g, unknown or other
  misc_feature (348)..(348): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatctttagactattccactaagagagtatttgttagtttggtaaccaacagaagccaggccagcctaccaaagcagctcatttatgggctatctacgtcgggacttccggggtccctgaccgtattccgnggcaggtggatcgtgggaactaaagtttcactctcacctatacaatcgcctgcaggctagaagtatggtgcagtcttattattgtcagctaattattattacttcttcttaccgtattcctacttttcggaccgtacggggtacccagggtctagggagacgtacgacggacgtaacgtggtggtcg

SEQ ID NO: 193500 - DNA, 522 bp, Homo sapiens
  misc_feature: GYAE6OF01D9WCT.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaattctttagactattcactaagagagtatttgttagtttggtaaccaacagaagccaggccagcctaccaaagcagctcatttattgggcatctactcgggtacttccgggtcctgaccgtattccggtggcagtggatcgtaggacaaatttcactctcacctatcaatagctgcaggctagaacgatgtgcagtctttattattgtacagtacaattatattacttctcttaccgtatctacgttttcggcctagggggtacccagggtcgtagggatatacgaaggtacgtaacgtcgg

SEQ ID NO: 193501 - DNA, 581 bp, Homo sapiens
  misc_feature: GYAE6OF01D3M6Z.11.76.G10.1.454.CMB.1.raw
  modified_base (281)..(281): a, c, t, g, unknown or other
  misc_feature (281)..(281): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcagtaacttctttagacttattccaactaagagagtatttgttaagtttcggtaaccaaanagaacgccaggccagcctaccgaaagcagctctattttagtggcatcgtacgtcgggacgttcccggggtccctgaccgtacttccggtgcgtaggtggatcgtaggaactaaagtttcactctacacctaatcaactacgctgcaggctagaagagtgtggcagtctttattacttgactagtactaaatttattacttacctttcttaccttaccgtacttaccgttaccgttttacggccggtaacggggtaccctagggtcgttagacgtactacgaacggtacgtacggttacgg

SEQ ID NO: 193502 - DNA, 707 bp, Homo sapiens
  misc_feature: GYAE6OF01ELLLY.11.76.G10.1.454.CMB.1.raw
  modified_base (352)..(352): a, c, t, g, unknown or other
  misc_feature (352)..(352): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagcgtgtcgttttctaggtggctaattttaaaaggtgtccagtctacaacgagactactggaatcgtgggggcacttcgtgctggccgggagggtccctgagactctcctgtgcagcctgtggacttcccctgtacttcactttcacatcggccgtcgggtccgccgaagtccgtaccggaggggggagagttgggaggtcgggtccnccgttccagtgtaacttcgtaattcttatagtactaagttgtatggcgactcggtaggaaggggtctagtttacgtcgttcggaccgtacgaacggactaagtaccgaaacctaaaccttaccttaacttccctaacctacctaacttaacccgaaccgaccgtaactacggttaaccgaacgaaccgtaccggtaacctaaagttactttaccgtaggttacgaccgggttaagggttgggttttccgggttaggggggtaccttaagttccggtaccgttcccgtttaggtacgtcggtcgggtacgggtaccggaaccgggtacccgttacgggtcccgtaacccgttcccg

SEQ ID NO: 193503 - DNA, 615 bp, Homo sapiens
  misc_feature: GYAE6OF01D4LS6.11.76.G10.1.454.CMB.1.raw
  modified_base (318)..(318): a, c, t, g, unknown or other
  misc_feature (318)..(318): n is a, c, g, or t
  modified_base (390)..(390): a, c, t, g, unknown or other
  misc_feature (390)..(390): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatctgggggcgacttcgtgctgccgggagggtccctgagactctcctgtgcagcctctggattccccttgattcactttcacatggcctgggtccgccaagctccgagggggganagttggagtgggtcgcctccatgaattcgaattctatgactaatttgatgcggactcgtgagggcattacgngtcgcgcagacatgtacgaaacaacctaccttacttccctccaactacttacccaacgccgaacagtaccgaaagaccgaaccggacctaaattactttacctagttacgcgggtaaaggggttggtttttcggttggggggtactaagtttcggtccgtccccgttttggaccgttggccggtcgggggacccacgggggtaaccccttgggtccctaccccgg

SEQ ID NO: 193504 - DNA, 535 bp, Homo sapiens
  misc_feature: GYAE6OF01CLXRS.11.76.G10.1.454.CMB.1.raw
  modified_base (442)..(442): a, c, t, g, unknown or other
  misc_feature (442)..(442): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagactattccaataagagagtatttgttagtttggtaaccaacagaagccaggccagcctaccaaagcagctcatttatgggctatctacgtcgggtacgttcccggggtcctggaccgtagtttcccggtggccaggtcggatcgtgggaactaagtttcactctcaccatacaatacgcctgcaggactaggaagagtgtgctagtcttattatntcagctaattattattacttctcttaccgattctacgtttggacccgtagggtaccaggcgtggagtagtacaaggacgaacgtggtgtaccg

SEQ ID NO: 193505 - DNA, 519 bp, Homo sapiens
  misc_feature: GYAE6OF01DIKJ2.11.76.G10.1.454.CMB.1.raw
  modified_base (226)..(226): a, c, t, g, unknown or other
  misc_feature (226)..(226): n is a, c, g, or t
  modified_base (277)..(277): a, c, t, g, unknown or other
  misc_feature (277)..(277): n is a, c, g, or t
  modified_base (481)..(481): a, c, t, g, unknown or other
  misc_feature (481)..(481): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagcgagactcttttanatagtgtacaacgataaaggactaatttagcttggtatcagacaaaaaccnggacagcctacctaaactgctcatctcctggcatctacccgggcaccggatccctgaccgattcgagtgcagcgggtctgggacagacttcactctcaccatcagcaacctgacaggctagaagtatgtagctagtttattacgtgtcagctagtattggtagacgtcctccgctcctacgtttccgggacgggagggacccgngggtaggagacgtcgaaggtacgaaactggtggtaccg

SEQ ID NO: 193506 - DNA, 703 bp, Homo sapiens
  misc_feature: GYAE6OF01DSP7Y.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtcctccagtacttccctggctggtgtctcgtgggcgagaccggccaccatcaactgacaagtccagtcaagtaattctttagacttattaccaactaagagtagtatttagtttagttggtaaccaacagaacgccaggccacgcctacaaagcacgctactatttagtggactactactacgtcgggtaccgttcccgggtacctcggtacccgtacgttccggtggcgtaggtggacttacggtagggtaacctaaaagtttcccaaccttccgtaccctaacctaacttaaccgaaacgttaacgtacccgtacggaccgtaacgggtaccgttaaggaaacggtagttacgggttaggtaccgtaagtttaccgttttaagtttacgttacgttactaacgtacttaaatttaacttttaacttaccgttttcctttacctttaccggtaactttacccgttaacggttttccggacccggtaaggggtacccgtacgggtacgtacggaacgtacgtaccgaacggtacgtacggtacggg

SEQ ID NO: 193507 - DNA, 498 bp, Homo sapiens
  misc_feature: GYAE6OF01B2I3Z.11.76.G10.1.454.CMB.1.raw
  modified_base (417)..(417): a, c, t, g, unknown or other
  misc_feature (417)..(417): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagaattctttagactattccactaagagagatttgttagtttggtaccaacagaagccaggccagcctccaaagcagctcatttattgggcatctactcgggattccgggtccctgaccgattccgtgcagtggatctgggacaaatttcactctcaccatcaatagcctgcaggctgaagatgtggcagtcttattnttgtcagtctaatattatacttctcttccgatctactttggccaggggccagggctgggacgtatacagacgaacgtcggg

SEQ ID NO: 193508 - DNA, 546 bp, Homo sapiens
  misc_feature: GYAE6OF01BX3JM.11.76.G10.1.454.CMB.1.raw
  modified_base (445)..(445): a, c, t, g, unknown or other
  misc_feature (445)..(445): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagaccgccaccatcaactgcaagtccagtcagtattctttagacttattccaactaagagatatttgttagttggtaaccaacagtaacgccgaggccagccctaccaaagcagctctatttatgggctatctacgtcggacgttcccgggtcctggaccgtattccggtggctaggtggatcgtgggaactaaatttcactctacacaatcagcacgcctgcagactagaatgtggtgggtacttttatagttntacaactatttattcttctttacgttacgtttaagttcgggacggtaggtaaccgtagggtgagtagtacaaacggtagtgtcggactagacactgtaccg

SEQ ID NO: 193509 - DNA, 601 bp, Homo sapiens
  misc_feature: GYAE6OF01CHXUC.11.76.G10.1.454.CMB.1.raw
  modified_base (271)..(271): a, c, t, g, unknown or other
  misc_feature (271)..(271): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagacggccacatcaactgacaagtccagtcagtattcttttagactattccaataagagtagtatttgttagttggtaaccaanagaagccaggccagcctacaaagcagctctatttagtggctatcctacgtcgggtacgttcccggggtcctacgaccgtattcccggtggcgtaggtcggacttcggtagggtaactaaatttccacgttcctacaacctactacaatacgtcctagacgaggtactaggaagtagtgtcggactagttacttagttattcgtactaagtactaattacgttaacttactttccttaccttaccgtacttccgttaccgttttacggacccggtacgggtaccgtacggtcgtaggacgtactacgacgtaacgtaacgtggtggtaccg

SEQ ID NO: 193510 - DNA, 619 bp, Homo sapiens
  misc_feature: GYAE6OF01E5MDA.11.76.G10.1.454.CMB.1.raw
  modified_base (462)..(462): a, c, t, g, unknown or other
  misc_feature (462)..(462): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctggcggagacatcgtgatcgacccagtctccagtacttcccgtggctggtcgtctcgtgggcgaggaccggccaccatccaactgacaagtccagtcaagtaattcttttaagacttattccaataagagagtattttgttagtttacggtaccaacagtaagaccaggccagcctaccaaagcagctctatttagtgggactactctaccgtccggggtacttcccggggtcctcggacccgtagttcccggtggcgtaggtcggagtcgtaggggaacctaaatttccacttctacaccatacaatacgcctgcgaggtctagaagagtgnggctagtcctttaattacttgtctaagtactaattaatttacttactttccttaccttaccggtattccgttaacgtttcggacccgtacggggtaaccagggttcctaggggtaacgtacgtacggtaagtaaccgaccggttggtccgggtaccg

SEQ ID NO: 193511 - DNA, 606 bp, Homo sapiens
  misc_feature: GYAE6OF01B0GKA.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttcccgtggctgtgtctcgtgggcgagaccggccacatcaactgacaagtccagtcagtattctttagactattccaataagagagtatttgttagttaggtaaccaacagaacgccgaggccacgacctaccaaagcagctactatttagtggactatctacgtcgggtacgttcccgggtcctcggaccgtacgttcccggtgctaggtggtatcgtagggtaactaagttccactctacacctatactaagtcgcctgacgaggtacctaggaagtgtggtacgtacgtacgttactttaagttacttgtactaagtactaaattattaacttacctttctaccttaccgtacttccttacggtttccgggaccggtacggggtaccctagggttccgtaggtacgtagtaccgaaggtaacgtaacgttggtacggtacc

SEQ ID NO: 193512 - DNA, 555 bp, Homo sapiens
  misc_feature: GYAE6OF01BG6W9.11.76.G10.1.454.CMB.1.raw
  modified_base (433)..(433): a, c, t, g, unknown or other
  misc_feature (433)..(433): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagatctttagactattccataagagtagtattttgttagtttggtaaccaacagaagccaggccagcctaccaaagcagctctatttagtgggcatctacgtcgggtacttcccggggtccctggacccgtacgttcccggtagggtccaggttggaatcgtaggggtaacctaaatttccgacctctaccaccatcaatagcctgcagctagaagtntgtggcagtctttattattgtctagactaattattatactttctacttccgtattccgtacttttggaccgtacggggacctagggtctagggtactacgtacgacgtacgtactggtgtcg

SEQ ID NO: 193513 - DNA, 535 bp, Homo sapiens
  misc_feature: GYAE6OF01EDNNJ.11.76.G10.1.454.CMB.1.raw
  modified_base (426)..(426): a, c, t, g, unknown or other
  misc_feature (426)..(426): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagaccggccaccatcaactgcaagtccagtcagatctttagactattcactaagagagtatttgttagtttggtaccaacagaagccaggccacgcctacaaagcagctctatttatgggctatctacgtcgggtacgttcccggggtccctggaccgtgttccggtggctaggtcggtatcgtagggtaactaaatttcactctcaccatacaatacgcctgcaggctagaagatggngctagtcttattattgtacagtactaattattaattcttctcttccgtatcttacgtttcggaccgtaggggaccagggtcgtaggatacgtacacgtacgagttcggg

SEQ ID NO: 193514 - DNA, 515 bp, Homo sapiens
  misc_feature: GYAE6OF01BCUSJ.11.76.G10.1.454.CMB.1.raw
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagatctttagactattccataagagagtatttgttagtttggtaaccaacagaagccaggccagcctaccaaagcagctcatttatggcatctacgtcgggattcccggggcctgaccgtattccgtggcagtggatcgtagggactaaagttcactctcaccatacaatacnctagacaggctagaagtntgtgcagtcttaagttatgtcagctaattacttatacttctcttcgatctactttggaccgtagggaccagggtctagggagtactcgaagaccgtaacttggtgtaccg

SEQ ID NO: 193515 - DNA, 591 bp, Homo sapiens
  misc_feature: GYAE6OF01A69K6.11.76.G10.1.454.CMB.1.raw
  modified_base (339)..(339): a, c, t, g, unknown or other
  misc_feature (339)..(339): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagcgtggctttttcttgtggcttattttaaaaggtgtccagtctacaacgagactactggaatcgtgggggcgacttcgtgctgccggggagggtccctgagactctcctgtgcagcctctggacttccccttgattcactttcacatcggcctgggtccgccaagcctccgagggggagagttggagtgggtcncctcatgaattcgaattcttatgactaatttgtatgcggtactcggtggaaggggctatttactgtcgccgcagacaagtacgaactaacacctttactcctccactacttacccaacgcgacacgtacgaacgaccaacggacctaaattactttcgtgtgacggttaaggggttgggttttcggtgggggactaaggttcgtcgtcccgtttgctgcgtcggggccacgggtaccctggtcctccgttcc

SEQ ID NO: 193516 - DNA, 562 bp, Homo sapiens
  misc_feature: GYAE6OF01DPRXF.11.76.G10.1.454.CMB.1.raw
  modified_base (359)..(359): a, c, t, g, unknown or other
  misc_feature (359)..(359): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtacttcccgtggctggtgtctcgtgggcgaggaccggccaccatcaactgcaagtccagtcagtaattcttttagactattccaataagagagtatttgttagtttggtaccaacagaacgcaggccagccctaccaaagcagctactatttatgggcatctacgtcgggtacttccgggtcctgaccgacgttaccgnggcaagtggatcgtagggactaaagtttcactctcaaccatacaatacgcctgtcgaggtctgaagtagtggtgacaggtcttattagttagtactagactaattattattacttcttccttctacttctacgttttggacccggtacggggtaccgacggtcgtagggagtacgtacgaacgtacggaacttgggtcgtacg

SEQ ID NO: 193517 - DNA, 589 bp, Homo sapiens
  misc_feature: GYAE6OF01D5IJD.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggcttgtgtctcgtgggcgagaccggccaccatcaactgacaagtccagtcagaattctttagactattccactaagagagtatttgttagtttggtaaccaacgagaagccaggccacgcctaccaaagcagctctatttatggctatctacgtcgggacttcccgggtcctgaccgtagttccgtggcagtggatcgtaggaactaaattcactctacaccatacaatagcctagacaggtactaggaagtagtggtacggactacggtactttaattagttgtacgtaagtaactaattaatttacttacctttcttaccttaccggtattaccgtttacgttttcggacccgtaacggggtaccacgggtccgttagggtactaacgtaccgaaggtaaccgtacggttacggg

SEQ ID NO: 193518 - DNA, 507 bp, Homo sapiens
  misc_feature: GYAE6OF01BYK3X.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagatctttagactatccactaagagagatttgttagtttggtaccaacagaagccaggccagcctccaaagcagctcatttattgggcatctactcgggattccggggtcctgccgattccgtggcagtggatctgggacaaatttcacgtctcaccatccaatagccttgcaggctgaagatgtgcagcttatattgtcagcaatattatacttctcttcgattctacttttggcccgtaggggtaccacgggtcgtaggtagaacgtcgagacgaacttggtggtacccg

SEQ ID NO: 193519 - DNA, 630 bp, Homo sapiens
  misc_feature: GYAE6OF01DRX8B.11.76.G10.1.454.CMB.1.raw
  modified_base (274)..(274): a, c, t, g, unknown or other
  misc_feature (274)..(274): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagtacttccctggctgtgtctcgtgggcgagaccgccaccatcaactgacaacgtccagtcagtaattctttagactattccactaagagagtatttgttagttggaaccaanagagccaggccagcctaccaaagcagtctactatttagtgggctagtctacgtcgggtacgttcccgggtccgtcgtaccgtcgttccggtcggtacgtaggtggtacgtcgtagggaacttaaactttctactctacgtaccatacaacttacgccgtagcgacggtctaagaagtagtggtcgcgtagttctttaattgtttacgtatacgtacttaatttactttaacttacctttccgttacctttaccgtacctttaccgtttaaccggttttcgggtacccggtacgggggtacccgtacgggtacgtaggtaacggtacgtacgtaacgggtaaccgtacggttacggg

SEQ ID NO: 193520 - DNA, 536 bp, Homo sapiens
  misc_feature: GYAE6OF01CSL7J.11.76.G10.1.454.CMB.1.raw
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagattcccctggctgtgtctcgtgggcgagaccggccaccatcaactgacaagtccagtcagtaatcttttagactattccactaagagagatttgtttagtttggtaccaacagaagccaggccagcctccaaagcagctcatttattgggcatctacgtcgggacgttccggggtccctgacccgattccgtggccaggtggatcgtggggactaaagtttcacgtctcaccactacaatacgtcctgcaggctgaagagtgtggcagctttaattnttgtnagtnaatattatcttcttctcgtatctacgttttcggccgtacgggaccgtacggtcgtgggaacgtatacgagtaccggaagttacggg

SEQ ID NO: 193521 - DNA, 640 bp, Homo sapiens
  misc_feature: GYAE6OF01BD6I1.11.76.G10.1.454.CMB.1.raw
  modified_base (265)..(265): a, c, t, g, unknown or other
  misc_feature (265)..(265): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagatctttagactattccactaagagagtatttgttagtttggtaccaanagaagccaggccagcctacaaagcagctactatttagtcggactatctacgtcgggtacgttcccgggtcctacggaccgtagttccggtggctaggtcggtactcgtagggtaaaccttaaagtttccaacgttctaccaacctactacaatacgacctaggacgacggtactaggaacgtgttggtacggactaaggttctttaagttatttcgtacgaacgtactaaagtttactttaacttacctttcttaccgtttaccgtaactttacccgtttaacggttttccgggaacccggtaacggggttacccgtagggtccggtaggtacgtaacgtacgaacggtaacgttaacggttggtcggtacccgg

SEQ ID NO: 193522 - DNA, 630 bp, Homo sapiens
  misc_feature: GYAE6OF01AB9IQ.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttccctggctgtcgtctcgtgggcgagacggccacatcaactgcaagtccagtcagtaattcttttagactattaccactaagagtagtattttggttagttcggtaaccaagagaacgccgaggccacgcctaccaaagcagctctatttagtcggtactatcgtacgtcgggtacgttcccggggtcctcggtaccgtacgttccggtggcgtaggtcggtactcggtagggtaacttaaacgtttccacttcctacctactactacaacgtcgtcctagcgacgctaggatgtcggtgactacgtactttagttacttcgtacgtagtactaaagttattaacttacctttaccttaccgttaccgtacttccgttaacggtttcggaacccggtacggggtacccgagggttcgtacgggtaactacgtacggtaacgaaccggtacgttgggtcgtaccgg

SEQ ID NO: 193523 - DNA, 542 bp, Homo sapiens
  misc_feature: GYAE6OF01AEG4Q.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagcggccaccatcaactgcaagtccagtcagattcttttagactattccactaagagagtatttgttagtttggtaccaacagaagccaggccagccctccaaagcagctctatttagtgggcatctacgtcgggtacttcccggggtccctggtacccgtattccggtggcaggtggatcgtaggactaattcactctcaccatcaatacgctgcaggctagaagtatggtggacagtactttattagttgtacagtactaattactttaatactttctccttcgtatccttacgtttcggaccgtacggggtaccgaggtcgtaggactagtacgacgtacgtaacgttcggg

SEQ ID NO: 193524 - DNA, 513 bp, Homo sapiens
  misc_feature: GYAE6OF01D1AHB.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagtaatctttagactattccaataagagagatttgttagtttggtaccaaactagaagtccaaggccagcctccaaagcagctcatttattggcatctactcgggattccgggtcctgaccgattccgtggcagtggatcgtgggactaaattcactctcaccatcaatagcctgcaggctagaagatgtggcagtcttattattgtcagcaatattatacttctcttcgacttactactttcggccgtaggggtacccagggtctagggagactcaaggaccgaatggtggtaccg

SEQ ID NO: 193525 - DNA, 543 bp, Homo sapiens
  misc_feature: GYAE6OF01EJ5CC.11.76.G10.1.454.CMB.1.raw
  modified_base (430)..(430): a, c, t, g, unknown or other
  misc_feature (430)..(430): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagtaatcttttagactattccaataagagagattttgttagtttaggtaccaaacagaagccaggccagcctaccaaagcagctctatttagttggctatctactcgggtacgttcccgggtcctcgaccgtattccgtggcagtggatcgtagggtaaaactttcactctacactatacaatagctgcaggctagaagtatgtgcagtcttattntgtcagtactaatattattacttcttcttacgacttctacgtttcggaccgtaggggtacctaggtcggtggacgtaagttcgaacggtacgtaacgttggtcggccgttacg

SEQ ID NO: 193526 - DNA, 834 bp, Homo sapiens
  misc_feature: GYAE6OF01AO5OP.11.76.G10.1.454.CMB.1.raw
  modified_base (277)..(277): a, c, t, g, unknown or other
  misc_feature (277)..(277): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttcccgtggctgtgtctcgtgggcgagaccggccacatcaactgacaagtccagtcaagtattctttagacttacttaccataagagagtagtttgttagttcggtaaccaanagaacgccaggccacgcctaccaagcagctactatttagtcggctatctacgtcgggtacgttcccggggtcctacggtaccgtacgttccggtcggactacggtcggtactcggttacgggtaaaccttaaacgtttcctaccttacctacctaaccgtataaccgtaacgtaccgaccgttagacgtacggtaccgtaaggtaacgtcgttacgggtacggtaccgtaacgtttacgtttttaacgtttaacgttttacggtaccgtaaaggttaacctttaaaacgtttttaaccgtttttaaacccttttaacccgtttttacccgtttaccccgttttaacccggtttaaccgttttaacccggtttttaaacccgggttttttaccccgggggaaaccccggggtttaaacccggggggttaaccccggttaaacgggggttaacccgggttaacgggggttaaacccgttaaacggttaaccccggggtaaaccgggttaaaacccgggtttaacccgggtttacgggggtacccgggtttaaaccccgg

SEQ ID NO: 193527 - DNA, 548 bp, Homo sapiens
  misc_feature: GYAE6OF01BNFB1.11.76.G10.1.454.CMB.1.raw
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagtaattcttttagacttattccactaagagagtatttgttagtttggtaccaacagaagccaggccagcctaccaaagcagctctatttagttgggcatctacgtcgggattcccggggtcctgaccgattccgtggcagtggatcgtgggactaatttcactctcacatcaatgctgcaggctgaagntgngcagtctttattattgtcagtactaattatttacgttacttccttcttaccgtattccgttaccgttttgggacccgtaggggtacccagggtccgtagggacgtaagtccgaaggtaccggaacgttggtggtaccg

SEQ ID NO: 193528 - DNA, 567 bp, Homo sapiens
  misc_feature: GYAE6OF01CD83H.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaattctttagactattccataagagagtatttgttagttggtaccaacagaagccaggccagcctcaaagcagctcatttatgggcatctacgtcgggacttccggggtcctgaccgtattccggtggcaggtggatcgtgggaactaaatttcactctacaccatacaatacgcctgcaggctagaagtatgtggacagtactttattattgtactagtactaaagttatttacttaactttcctctttaccgtattacctacgtttttacggacccgtaacggggtaccctagggtccgttagggtaagtaacgttacgaacggaaccggtaaacgttggtggtacccg

SEQ ID NO: 193529 - DNA, 756 bp, Homo sapiens
  misc_feature: GYAE6OF01BXYX2.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctcgtggtcgcctggcggagacatcgtgatcgacccagtcctccagtacttcccgtggctgtcgtctcgtgggcgagaccggccacatcaactgacaacgtccagtcaagtaattctttagacttacttccaagtaagagtagttagttttgtttaggtttcggtaaccaaacaggtaacgccgaggacccacgaccctaccgaaagcaacgtctactaagtttacgtgggacctacttaccttacggtccgggtacggtttcccgggtcccgtgacccggtacgttcccgggtaggacgtacggtaggtacgtcgtacggggaaccttaaacttttccaaccttcgtacctaacccgtattaacctaacgttacgacccgtaggaccgtaacgggtacttaacgggaacggtaaggttccgggtacggggaaccttacgggttaaccttttaagtttaacgtttcggtaaccgacggttaaacctaaagttttaaccttaaccgtttaacgttcccttaccgttaacccgttacttaccgttaccgttttcgggacccggtaacgggggtacctaggggtcccgttagggaacgttagtaccgtaaggtaacccggaggttcgggacggtacccgg

SEQ ID NO: 193530 - DNA, 553 bp, Homo sapiens
  misc_feature: GYAE6OF01AIB9B.11.76.G10.1.454.CMB.1.raw
  modified_base (547)..(547): a, c, t, g, unknown or other
  misc_feature (547)..(547): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagtaattcttttagacttattccaataagagagtatttgttagtttggtaaccaacagaagccaggccagcctccaaagcagctctatttattgggcatctacgtcgggtacttccggggtccctgaccgattccgtggcaggtgatcgtggactaaatttcactctcacctatcaatagtcctgcgaggctagaacgtagtggtggcagtcttattagttgtcaagctaattaacttattacgtttccttcttcccgtattcttaccgttttcggaccgtacgggggtaccagggtcctaggggatacgtaccgaagacgaacgttggnggtacg

SEQ ID NO: 193531 - DNA, 618 bp, Homo sapiens
  misc_feature: GYAE6OF01CKWXT.11.76.G10.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtacttccctggctgtgtctcgtgggcgagacggccacatcaactgacaagtccagtcagtaacttctttagactattccaataagagtagtatttggttagttacggtaaccaactagaacgccgaggccaacgccctaaccaaagcaacgtctactatttacgtggactatctacgtcgggtacttccgggtcctagaccgtnttccggngacaggtgatcgtaggaactaattcactctacactatacaatacgtccngacaggtactaggaacgtgttaggtcgactacgtacttttaactagttacgtacagtactaaacgttattacttaactttccttacgttccgttaattcccgttacggtttaccggaccggtaacggggtacccgtaggtccggtaggtaacggttactacccgggtaagaacccggttaacgttgggtaacggtccg

SEQ ID NO: 193532 - DNA, 559 bp, Homo sapiens
  misc_feature: GYAE6OF01CR908.11.76.G10.1.454.CMB.1.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtcctccagtacttccctggctgtcgtctcgtgggcgagaccgccaccatcaactgacaagtccagtacagtaattctttagactataccaactaagagagtatttgttagttgaaccaagagacgccagaccacgcctacaancagctatagtttagtcggactatctacgtcgggtacttcccgggcctagaccgtattccggngcgtaggtcggatcgtaggaactaattcactctacactatacatacgctcgacgagacgtagaagtgtgacgactagtacttattagtcgtacatactaattatattaccttcctacttaccgtattccgttacgtttcggaccggtacgggtaccgtggtcgtaggatacgtacgaacggtacgtacgtggtcgtaccg

SEQ ID NO: 193533 - DNA, 544 bp, Homo sapiens
  misc_feature: GYAE6OF01B74YS.11.76.G10.1.454.CMB.1.raw
  modified_base (276)..(276): a, c, t, g, unknown or other
  misc_feature (276)..(276): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcaagtaattcttttagacttacttccaactaagagagtatttgttagttaggtaccaanagaagccaggaccagcctacgaaagcacgctcatttagtggcattctacgtcgggtacgttcccgggtacctgaccgacttccgnggcaggtgatcgtaggaactaattccactcacaccatacaagtcncctgactgctaganagtgngcagtctttatagtncgtanactaattacttattaccttctccttacgtattctacgtttcggaccgtacggggaccagggtctagggaatacgtacgacgtaacgagtcggtcgtacg

SEQ ID NO: 193534 - DNA, 612 bp, Homo sapiens
  misc_feature: GYAE6OF01CFQJJ.11.76.G10.1.454.CMB.1.raw
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttcccgtggctgtgtctcgtgggcgagacggccaccatcaactgacaacgtccagtacagtaattctttagacttattaccaataagagagtatttgttagttcggtaaccaanagaagccaggccagcctacaaagcagctctatttagtgggactactctacgtcgggtacgttccgggtccctgaccgtacgttccggnggctagtggatcgtagggaactaaagtttccactctacacctatacaactacgcctgacgaggctaggaagtagtgtacggactaggtctttaattattgtactagtactaaatttatttacttacctttcttccgttaccgtacttccttaaccggttttcggacccggtaacgggggtaccctacgggtcgtagggtaacgtacgtaacggaacggtaacccgtaaacgttgggtacggtaccg

SEQ ID NO: 193535 - DNA, 535 bp, Homo sapiens
  misc_feature: GYAE6OF01ANCLO.11.76.G10.1.454.CMB.1.raw
tcagcgagagataccacgaccggtgctcgatttagtcactcatacagggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagtaatcttttagacttattccactaagagagtatttgttagtttggtaccaacagaagccaggccagcctccaaagcagctcatttatgggcatctactcggggtacttccggggtccctggaccgattccgtggcaggtggatcgtagggactaattcactctacaccatcaatgcctgacaggctagaagtatggtggcagtcttattagttgtccgagtcaattattattacttctcttaccgtatcctagttttcggccgtacggggaccagggtctagggtagacgtacgacgtaccgaacgtggtcggtccg

SEQ ID NO: 193536 - DNA, 874 bp, Homo sapiens
  misc_feature: GYAE6OF01ERS0H.11.76.G10.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagcgtgtcgttttctaggtggcttaattttaaaaggtgtccagtctacaacganactactggaatcgtgggggctacttcgtgctgaccgggnggtccctgacgactctccgtgtgactagtcccgtgtcggtacttcccccgttgtacttcctacctttccaatacgtcggtcccgtcgggtaccccgacctaacggtcctaccggggaggggggtagtaggtttggggacggttcggggtccgtccttaccgagttacgaacgttttaccggtaaattttccgttacgtaaggtaaccttaaagttttcgtaaggtcggtaccggtaaacccgtttccggtaaggggtaaacggggtaccgttttacgtttaaccggttacggttcccggaccgtacggaaacggttaaccgaacggttaaccgtaaaccgtaaacccgtttaccgtttaaccttccccgtaaccctaactaaccctttaacccgaacggtacctaacgaacggttaacgaaacgtaccgtaaccggtaaaccttaaaagttcgtttttaacgacgggttcggtaacggggttaaggggttttccggggttttggggtaacggggttaactttacggtttaaccgggtttcccgtttcccggtttaacggtcggttacgggttaccgggtacggggtacccggaaaccgggttaacccggttcgggttaaacccgttccccggttccc

SEQ ID NO: 193537 - DNA, 718 bp, Homo sapiens
  misc_feature: GYAE6OF01CJA0B.11.76.G10.1.454.CMB.1.raw
  modified_base (130)..(130): a, c, t, g, unknown or other
  misc_feature (130)..(130): n is a, c, g, or t
  modified_base (554)..(554): a, c, t, g, unknown or other
  misc_feature (554)..(554): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtncctgcggagacatcgtgatacgacccagtcctaccagtacttcccgtggcttgtcgtctcgtggggcgaggaccggccaccataccaactgacaacggtccaagtacaagtactttacgttttacgacttacttacctaacgtaagtagagtattttaggtttacgtttaggtaccaacgaagtaacgccgacggaccgacgaccctaccaaaacggccagtcctatatttagttcgggactactacgttacgtaccgggtacgtttccccggggttccctacggtacccggttacgttccgggtcggcgtaacgggtcgacgttccggtaacgggtaacttaaacgttcctaccgttacctaccaacctactacgtaacgtacctccgtagcgtacgggtaactaggaacgtagtcggtacgnttacgttatttagtttacgtacggtactacgtacttaaattaaccgtttacttaccctttcgttaccgtttaacgacctttccgttacgttttccgggaccgggtaaccgggcgtaggtaccgttagggaacgtaccgtagaaccgggtacgtagttaccgggg

SEQ ID NO: 193538 - DNA, 558 bp, Homo sapiens
  misc_feature: GYAE6OF01BL61U.11.76.G10.1.454.CMB.1.raw
  modified_base (340)..(340): a, c, t, g, unknown or other
  misc_feature (340)..(340): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagattctttagacttattccactaagagagattttgttagtttggtaaccaacagaagccaggccagcctaccaaagcagctcatttatgggcatctacgtcggattcccgggtcctgaccgtntccggtgcaggtgatcgtgggactaagtttcactctcaccatacaatacgcctgcgagctagaagatggtgtcagtcgtttaattacgtttgtcaagtactaagtttaattaacttactttcttaccttaccgtattacctacgtttttacgggaccgtaacgggggtacccaggggtctagggaagtactacgagtaacgaacgttggtcggtaccg

SEQ ID NO: 193539 - DNA, 690 bp, Homo sapiens
  misc_feature: GYAE6OF01BSUYO.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgccgacggggacatcgtgatgacccagtctccagacctccctggttgtgtctcgtgggcgagagggccaccatccaactgacaagtccagccagagttgttttatacagcctaccaacaataacaacttacttagtcttacggtaccagacaagaaaccaggaccaccgaccccctaaggtccctactactttacgtcgggcctacgtaccgtacccgggacggttccccggggtcctacgaccgtacttcgacggacggcgacggtcgggtcgtacgggaacagtactttccacttcctaccgacctactacccaacccgtaacctcggaccgacgggtcctaaggtaacgtagttacggtacggtacttaagttttacttacgtcgtacgtaacgtactaaacttaacgttacttacgttccccttaccgttccgtaccgtaccgggttccgggaccgggtaacgggaccgtaagggtacggaactacgtaaaccgtaaacgtacggtggtacggcctcgaacctacctacgttccttacgttccttacgtccttcccccgg

SEQ ID NO: 193540 - DNA, 638 bp, Homo sapiens
  misc_feature: GYAE6OF01A0O5Y.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagacttccctggctgtgtctcgtgggcgaggaccgccaccatcaactgacaagtccagtcagtaacttctttagacttattaccaactaagagtagtagttttgtttaaggtttcggtaaccaacgaggaacgccaagggccacgccctaccgaaagcagctactatttagtggactatccgtaacgtcgggtacgttcccgggtccctaggacccgtcgttccggtcggctaggtcggactcgtaggtaactaaactttcacgttcctacaccataccaatacgccgtgaccgtaggcgtagaagtagtggtcggactagttctttaagttcgtttacgcgtaagtactaagtttaattaccttacctttaccgttacctttaccgtactttaccgttacgtttccgggacccggtaacggggtacccgagggtccgtagggtacctagtaccgaaggtaacccggtaggtcggg

SEQ ID NO: 193541 - DNA, 709 bp, Homo sapiens
  misc_feature: GYAE6OF01DIJHI.11.76.G10.1.454.CMB.1.raw
  modified_base (140)..(140): a, c, t, g, unknown or other
  misc_feature (140)..(140): n is a, c, g, or t
  modified_base (415)..(415): a, c, t, g, unknown or other
  misc_feature (415)..(415): n is a, c, g, or t
tcagcgagagataccacgaccggtgctcgatttagtcactcatacaggggacaacaggcaggcaggggcagcaagatggtgttgcagacccaggtcttcatttctcttgttgctctggatctcgtggtgcctgacggganactattcggagactcgaaccctgtcctaccgagtacttcccgtggtcttggtgtcctcggtgggacgacggaccgccaacatcaactgaactacgtcagtacaagttactttcgttagaacttactaccaagtaagagtaagttatttaggttagttacgaaccaagaggaacgccgacggtaccacgtcctaacgaaagtcactacgttactaagtttacgcgactaactcggtacgtacggggtacttccgggacctaggaccgtagttccgnggacaggtagaccttggaacgtaacttaaactttccactacctacgactacactacgtacgtactacgtacgagtacgtaggaagtacgtacggtacgtacgtacggttaactttacgtttaacgttagtacgtaactacgttaacttaacgtttaacttactttaccgttacgttaccgttacgtaccgttaccggtttaccgggaccgggtaaccgggtaaccggtaggtacggtaaggtacggtaaacgttaccggaaacggttaaaccggaacggttggacggttaaccg

SEQ ID NO: 193542 - DNA, 640 bp, Homo sapiens
  misc_feature: GYAE6OF01BDRJ8.11.76.G10.1.454.CMB.1.raw
  modified_base (527)..(527): a, c, t, g, unknown or other
  misc_feature (527)..(527): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgaactggctttttcttgtggctattttaaaaggtgtccagtctacaacgagactactggaatcgtgggggcacttcgtgctggccgggagggtccctgagactctcctgtgcagcctctggacttccccttgacttctactttcacatggcctgggtcccgccaagccgtccggaggggggagagttggaggtgggtccgcctccgatgtaacttcgaatttcttatgtaactaagtttgtatgcggtactccggtggaacggggtcgtagtttacgtcggtccgccgcgacgactaacgtaccgaaacctaacctaccctttacttccctacctacctaacttacccaacgcgacgagtacgaacgaccacggacctaaattnttacgtgtcgacggtaagggtttggtttacgggtggggtctagttcggtccgtccctttgacgttcgcggtcggggaccgacggggtacccctgggtccctccgtccgtcccg

SEQ ID NO: 193543 - DNA, 641 bp, Homo sapiens
  misc_feature: GYAE6OF01EEU6X.11.76.G10.1.454.CMB.1.raw
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtcctccagtacttcccgtggtctggtgtctcgtgggcgacgaccggccaccatcaactgactaacgtccagtcaagtaactttcgtttaagacttacttaccaagtaagagtagttatttgttagttacgtaaccaagagaacgccacggacctacgacctaaccgaaagccagtccttatatttaggtcggactatccgtacgtcggtacgttcccggcctcggaccgtcgtaccggtggctaggtgtacgtcgtaggacttaacgttcacttacaccactatacaagtcgtaccgngacgngtacgtagagtatggcgtactagttctttaaggtactacggtactaagtcttaaattactttaattcccttacgttaccgttaccgtactttaccgttttacggtacgggaccccggtaagggtacctagggtcgtacgggaataccgttaacggaacgtaacgtaggttcgggtctaccgg

SEQ ID NO: 193544 - DNA, 750 bp, Homo sapiens
  misc_feature: GYAE6OF01DDEI3.11.76.G10.1.454.CMB.1.raw
  modified_base (179)..(179): a, c, t, g, unknown or other
  misc_feature (179)..(179): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggcttattttaaaaggtntccagtctacaacgagactactggaatcgtgggggcacttcgtgctggccggggagggtccctgagactctcctgtgcagcctctggtacttccccttgtacttctaccttttcacactcggccgtgggtccgccgaagccgtaccggaggggggagtacgttggaggtcgggtcgcctccataggtaacttacgtaattcttatacgtaactaatttagtagttacgcggtacgtccggtagggaacggggtcgtaattttacgtcggtccggccgacgtaacggactaacgtaaccgaaactaaacccttaccttacttccctaccaacttaacttaacccgaacgcgaaccgtacgtaccgaaacgaacgtaaccggaacctaaaagtttcgtttcgtagttcgggtaacgggttaagggggtttcgggtttttaccggggttacgggggtacttaacggtttccggtcccggttaccccgttttagggtccgttaccgggtccgggttcccgggggacccgtaaacccggggtaccccgttacggggtcccgtaccccggttccccg

SEQ ID NO: 193545 - DNA, 574 bp, Homo sapiens
  misc_feature: GYAE6OF01EVAP7.11.76.G10.1.454.CMB.1.raw
  modified_base (408)..(408): a, c, t, g, unknown or other
  misc_feature (408)..(408): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcaagtaacttcttttagacttacttaccaactaaagagtagtaattttgttagttttggtacccaaacagaaagtccaggccagcctccaaagcagctcatttatgggcatctactcgggattcccggggtcctgaccgtattccggtgccgagtcggatctagggactaaattcactctcacatacaatacncctgccaggtctagaagtagttggtggctagtctttaattagttgtcagtactaattacgtttattactttctaccttccgtattccgtaacttttcggaccgtacggggacccgtaggtcgtagggtaagacgttacgaacggtaacgtaacgtggtcggtaccg

SEQ ID NO: 193546 - DNA, 612 bp, Homo sapiens
  misc_feature: GYAE6OF01BH22E.11.76.G10.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttcccgtggctgtgtctcgtgggcgagacgccaccatcaactgcaagtccagtcagtatctttanactatccatagagatatttgttagttcgtacctaacagaagccaggccagccctaccaagcacgctctatttntgggctatctacgtcgggtagttcccgggtccncgaccgtatcggtcggctaggtgacgtcgtaggtaactaattccactcctacactaatacaataccgctagcgagtcgagaagtntagggtgactcgttactttattacgttcgactacgtaacgtaattacgtttaacttacctttaccgttcccttaaccggttattacccgtttacggttttacccggggaaccggtaaccggggtaccgtacgggtccgttaacgggagttaaccgtaccgaagggtaaccggtacgttgggtcggtaacccg

SEQ ID NO: 193547 - DNA, 630 bp, Homo sapiens
  misc_feature: GYAE6OF01BRYAG.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggcttgtgtctcgtgggcgaggaccgccacatcaactgacaacgtccagtcagtaattcgttttagactacttccaactaagagtagtattttaggtttaggttacggtaaccaaacgtagaacgccgaggccacgcctacaaagcagctactatttagtggactatctacgtcgggtacgttcccgggtcctaggaccgtcgttccggcggtcgaggtcgagtcgtacggaactaatttccgacttccgtccaactactactaagtcgcctaggacgaaggtctaaggaagtcgtagggtagactaagttaccttttaattacgtttacgtaccagtaacttaaatttacttacttacctttcgttaccgttacctattccgtttacggtttcggacccggtaacgggtacctcggtacgtaggtaacgtacgtacggaaggtaaccgtggttacggg

SEQ ID NO: 193548 - DNA, 873 bp, Homo sapiens
  misc_feature: GYAE6OF01DJDT5.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagtacttcccgtggtctggtcgtcgtcgtgggacgacggaccggcccaaccactaccaacgtcgactaacgtccacgtactaagtaactttacttttaacgaccttaacttacccaagtaaagagtaagttagtttttacggtttaagttaccggtaaccaacgtaaggaaccgccccgtaaggacccaaccgacccgttaaccgaaaacggtccacggtaccttagttaacgtttttaggtcgggactaacgttaccgttacgggtaccgggtaaccggttttccccggggtaccctacgggtaacccgttcggtttcccgggaggacgtacggtacgggtacgtttaccgggtaaacgggtaaactttaaccgttttacccgaccgttacctaacccgtaacccttaacgtaccgtaaaccgttaccggtccgttaacgggaccgtaacgggttaccggttaagtaaacggtaggttacgggtacgggtaacttaacggttttaccgttttaagtttaacggttaccgttaacgtaaggttaaccttaaagtttttaactttaaccctttacgtttcccttaaccggtttacccgttacgttttacccgttaaccggggttttaccggaacccgggttaacggggtaacccgtacgggttcgtaacggggacgttaagtaaccggaacgggtaaacgttcggttcgggg

SEQ ID NO: 193549 - DNA, 735 bp, Homo sapiens
  misc_feature: GYAE6OF01C85R0.11.76.G10.1.454.CMB.1.raw
  modified_base (393)..(393): a, c, t, g, unknown or other
  misc_feature (393)..(393): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgaccctagtctccagtacttcccgtggctgtgtcctcgtgggcgacgaccggccaccatcgaactgacaacgtccagtcaagtacttctttagacttattaccaataagagtagtagtttagttaagttcgaaccaagagaacgccgacggccacgacctacgaaacgcacgctactatttagcgggactagttacctacggtcgggtaccgttcccgggtccctacggtaccgtacgttcccggnggtaccgtagggtacggtacgttacggtacgggtaaaccttaaacgtttcctaccttaccgtacctaaccgtactacgtaacgtaccgtccctaggaccaacgggtcgttaaggaaggttatcgggtagaccgtaacggtttactttaagtttacgttagtaacgacgttaactaaatttacgtttacttacccttttaccgtttaccgttaacccgttaactttcccgtttaaaccgggttttaccggacccggggttaaaccgggtaccgttaaccgggtacggttaacgggacgtacggtaacgtaacgggtaacccgtaacggtgggtacccgggtac

SEQ ID NO: 193550 - DNA, 868 bp, Homo sapiens
  misc_feature: GYAE6OF01A1W39.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaaacaaagagaactcaccatggaactcgggctgagctggctttttcttgtggcttattttaaaaggtgtccagtctacaacgagactactggaatcgtgggggcgacttcgtgctggccgggagggttccctggacgacctctcctgtgcagcctctcggacttccccttgtacttctactttcacagtcggccgttcgggtccgccgaacgtccgtccggaaggggggtagtagttggggaggttcgggtccggcccttaccgagttcgtaacttcgtaaatttcttagtacgtaacttaagttttggtaatcggaccggtaaccgttaccggtaggggtaacgggggtcgttaacgttttacctgggttcccggtacccggacgacgtaacgaacggttacccgtaaactaaacccttaacccgtttacttaccccgtaccccaaccgttaaccttaaccccgaaacgacccgaacctaacggttaccaaacggtaaccgaacccgggaacccttaaaagtttaccgttttacgttagggttaccggtaccgggttaacgggggttttcgggtttttaccgggtttggggggtacccgttttaaaagggttttccgggtttaccccggtttaccccgtttttacgggtccggtttaccgggtcccggggtttaccgggggggtacccccggtaacggggggtttaaaacccccccggttgggtttaacccccggtaacccccggtttcccccgg

SEQ ID NO: 193551 - DNA, 911 bp, Homo sapiens
  misc_feature: GYAE6OF01EV2XD.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtcctccagtacttcccgtggctgtgtctcgtgggcgacgaccgccacatcaactgacagtccagtcagtacttctttagacttactaccaactaagagtagtagttttgtttaacggtttacggttaacccaaactaaggtaaacggacccgaacgggacccctaacggtacccctaacccgaaaaggcccgaacgtccttaacctaagttttacgtttacggggacctaacgttccgttaccggtccggggtaacggttttcccccgggggttccccttacggtaaccccggtacgtttcccgggtaggtccgtaagggttcgggtaacgttacggttacggggtaaaccttaaacgttttaccgtaaccttccctaacccgtaacctaaccgtttaaccgaaacgttaccgtacccgttacggtacccgtaacgggtaccgttaagggaaaccgttaggtttacgggtaccgggtacgtaacgggttttacctttttaaagttttaccggtttaacggttaccgtaaaggttaaccctttaaaagtttaaaccttttaacttttaaccccgttttccctttaaccgtttacccgtttaacgtttaccccgttttaaacccgggttttcccgggtaaaccccgggttaacggggggtaaccccgttacgggtaacccggttacggggtaaacggttaacgttaacccggaaccggttaaaccgggtaaacgtttccggggttcgggtaaccccg

SEQ ID NO: 193552 - DNA, 866 bp, Homo sapiens
  misc_feature: GYAE6OF01BJGPW.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggtctttttcttgtggctattttaaaaggtgtccagtctacaacgagactactggaatcgtgggggcgacttcgtgctgccgggaggtccctgagactctcctgtgcagcctcgtggacttccccttgtacttcactttcacatcggcctgggtcccgcctaacgcctccggagggggggtagtacggttggggacggtcgggggtccgcccgttacccgagttacggtaaactttacggtaattttccttaacgttacggtaacctaaattttggtaacgttcgggtaccgggtaaccttcccgggtaggggtaaaacggggggtcgttaaacgttttaccgtcgggttcccggcccggtacgaacggtaaccgtaaaggtaccgaaaacccgtaaacccttaaacccgtttaacctttacccctaccctaactaaccgtttaaccccgaaaaccggtcccgaaccgtaacggtaccggaaacggtaaccgaaccgggaaccctaaaagttacgttttaccgtacggttacggtacggggttaacgggggtttacggggttttttcccggggttagggggggtaccttaaagggttttccggttcccgggttaccccgtttttacgggtaaccggttcgggttcccgggtaccggggggtacccccggaacggggggttaaacccccgtcgggttaccccgaccccgggtttccccg

SEQ ID NO: 193553 - DNA, 806 bp, Homo sapiens
  misc_feature: GYAE6OF01CQJ3U.11.76.G10.1.454.CMB.1.raw
  modified_base (542)..(542): a, c, t, g, unknown or other
  misc_feature (542)..(542): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtcctccagtacttccctggctgtcgtctcgtggcgagaccggaccaccatcaactgacaagtccagtacagtaactttactttagacttacttaccgaataagagtagtagttttagtttacgttttacggtaaaccctaacgaagaacgtaccgacggaccccgaacggaccctaacccgaaaagccgaacggtccttacctaacgttttaagttcggggacttacgttacctaccggttaccggggtaaccggtttcccgggggtacccctacggtaaccccgtacgtttcccgggtggacctagggttacggagttaccgtacggggtaaaccttaaacgtttcctaccgttacctactaacctacttaacaaaccgtttacncccgttaggccgtaagggtacgtaggtaacggtagttacggtacgggaccgttaaggtttacttttaacgttttacggtttaacgaaccgttaacggtaactttaaacgtttaacgtttacttttaacccgttcctttaccgttaccggttaacctttccgttacccggtttcggtacccggtaaaccgggtaccggaaaccggttcggtaaacgggtagtaaccgtaccggtaaacgtaccgttaacggtcggtacgtacccg

SEQ ID NO: 193554 - DNA, 799 bp, Homo sapiens
  misc_feature: GYAE6OF01D11GQ.11.76.G10.1.454.CMB.1.raw
  modified_base (188)..(188): a, c, t, g, unknown or other
  misc_feature (188)..(188): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgccgtggcggagactagtcggtgactacgaccctagtcctccagtacttcccgtggctggtntcgtcgtgggcgacggaccgccacataccgaactgacacgtcagtcaagtatttcgtttaacgacttactaccaactaagagtagttatttagtttagttacgtaacaacagaacgccgacggccacgacctacaagcatctatatttaggtcggactattcgttaccggtcgggtaccgttcccgggtacctcggtaccgttacgtccggtaggtaccgtagggtacgtacgtacgggtacggtaaaccttaacgtttccaaccgttctaaccgtactaacttaccgtaagtccgtccgttaggacgtacgggtacttaagggaacgtcggtaggtaccgtcgtaaccggtttacgttttaatttaccggttacggttaacctaacgggttaaaccttttaaagttttaacctttacccgtttaaacgtttttccccgttttacccgttaaccgtttaccggtttacccgtttttaccggggtttacccgggtaccccggggtaaacggggttaaccccggttacgggttaaggttacccggggtaacttaaccggttaccggtaaaccgggaacccgggttttaacggtttcccgggagggttaccccg

SEQ ID NO: 193555 - DNA, 595 bp, Homo sapiens
  misc_feature: GYAE6OF01DYJVD.11.76.G10.1.454.CMB.1.raw
  modified_base (313)..(313): a, c, t, g, unknown or other
  misc_feature (313)..(313): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtattccctggctgtgtctctgggcgagacggccaccatcaactgcaagtccagtcagaatctttagactatccaataagagtaagtatttgttagtttggtaacctaacagaagccaggccagcctaccaaagcagctactatttagtcgggntatcctacgtcgggacgttccggggtccctggaccgtagtccgtaggcaggtggactcgtagggactaaagtttccaatccgacaccgtatacaaatacgacctagcgaggtctagaagtagtgtgtcagtactttatagtttgcaagtactaaagttatttaacgttactttaccgtcttaccgtacttaccgtaacctttaggacccggtaacggggtaccctaagggccgttagggacgtaaccgtcgtaaacggtaacgtaaaccgttggtggtaccg

SEQ ID NO: 193556 - DNA, 777 bp, Homo sapiens
  misc_feature: GYAE6OF01DFA46.11.76.G10.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (541)..(541): a, c, t, g, unknown or other
  misc_feature (541)..(541): n is a, c, g, or t
tcagcgagagataccacgaccggtgctcgatttagtcactcatacaggggacaacagtcaggcaggggcagcaagatggtgttgcagacccaggtcttcatttctctgttgcttcgtggatcctcgtggtcgccgtggacggagacagttcgtgatcgacccagtctccagtcttcccgnggctggtcgtcgtcggngggacgacgaccgccaccagtacacgtgacctaagtccagtacaagtaactttacgtttaagaccttactaccgaaagtaagagttaagttacgtttagtttacggttacgtaaccaacgagaacgacgacggaccacgacctaaccgaacgactacgtacttacgttaagttttacggtcgtactacgttaccgtacggtaccggggttaccggttcccgggtaccgtaccggtaccggttacgttccggcggtacgtaggttcgtacgttacggtacggtaaacctacgtttacgaccgtaccgtaccaaccttaacaacgtaaccgttcgtaccgttacgnggtaacgttacgtaggaacgttacggtcgggtacgtacgttaaccgtttacgtttaacgtttgttaacgtaacgtacttaacgtttaacttaaccttttaccttaccgttttacctcgttaaccgtttaccgttaccgtttaccgggttacgggaacccgggttaaacgggtcggtacggttaccggtaggtaccgtaacgtaaccggacgttaacgttccgggtagtcggtaacg

SEQ ID NO: 193557 - DNA, 901 bp, Homo sapiens
  misc_feature: GYAE6OF01AW95U.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggtctttttcttgtggcttaattttaaaaggtgtccagtctaacaacgagactactggaatcgtggggcacttcgtgctggccggggaggtccctgacgcctcctccgtggtcgcacgtcctcgtcggtacctttccccgtgtactttcctactttccacgacgttcggcccgtcggggtccccgaccaacggtccgtaccgggagggggtacgtagttgggagggttcgggtccgcctaccgtagtagtaactttacgtaatttccgtttagtacgtaacttaagttttagtacgtcggtaccggtaccgttcgggtaacggggaacgggttccgttaagttttaccgtccggttaccggaccccggtatacggtaacgtagttaccgggtaacccgtaaacctaaacccgttttaccctttaaccgttttacccccaacccgttaaccgtaaacctttaaaccccggaaacccggtcccgtaaaccggttacgttaaaccgggaaaccgtacccggtaaacccgtaaccgtaaacttttacgtttaccgttagggttaacggggttaccggggtttaaacggggtttttcggggttttaccggggttaacgggggtaccgttttaaacggtttcccgggttacccggttacccggttttacgggaccggttacggggtccggggtttaaccggggggaccccttaaaaccggggggttcccccgttaccgggttcccgtttacccccgggg

SEQ ID NO: 193558 - DNA, 869 bp, Homo sapiens
  misc_feature: GYAE6OF01CH373.11.76.G10.1.454.CMB.1.raw
  modified_base (367)..(367): a, c, t, g, unknown or other
  misc_feature (367)..(367): n is a, c, g, or t
tcagcgagagataccacgaccggtgctcgatttagtcactcatacaggggaggtctgagagaggacgccccgccctgggatttgcaggtattttcattgggtgctcaggactgaacaaagagaactcaccatggaactcgggctgagctggtctttttctgtggcttaattttaaaaggtgtccagtctacaacgagactactggaatcgtggggcattcgtgctgccgggaggtccctgacgctctcctgtcgcgagcctcgtggtactttccctagtacttctaactttcactatcggccgttcgggtcccgaccgaacgtccgtaccggaaggggggagtacggttgggacgggttcggggtcnccgtaccagtagtaacttaccgaatttacgttaacgtgtaacttaagttttgtaagtcggtaccgggtaccgtaccggttaagggtaacgggggtacgtaacggttttaccgtcgggttacccggaccgtaccggtaaacgaacggttaaaaccgggttaaccgaaaaaccccttaaacccgttaacccttttaaccgttttacccctaaacccgtaaacccgtttaaacttaaacccccaaaacgggtccccggaaacggtaaccggttaacggaaaacgaccgaaaccggttaacctaaaacgtttacgtttacgttacgggttaacggtaccggggttaagggggtttcggtttttacgggggtaggggtaaaccgttaggttaccggggtttcctaccccgggtttaggtaaccggttccggttccggggtacgggggtaacccccgtaacggggtaacccccgggtttacggttccccgtaaaccccggggtttccc

SEQ ID NO: 193559 - DNA, 603 bp, Homo sapiens
  misc_feature: GYAE6OF01A0WIT.11.76.G10.1.454.CMB.1.raw
  modified_base (130)..(130): a, c, t, g, unknown or other
  misc_feature (130)..(130): n is a, c, g, or t
  modified_base (159)..(159): a, c, t, g, unknown or other
  misc_feature (159)..(159): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtncctgcggagacatcgtgatgacccagtcnccagtacttccctggctgtgtctgtgggcagcgccacatcaactgcaacgtccagtcagtattcttagacttataccactaagagtagtatttagttagttacggtaaccaagagtaacgctaggccacgacctacaaagcacgctactatttagtcggctactactacgtcgggtaccgttcccgggtacctaggacccgtacgttcccggtggacctaggtacggactggtacggaacttaacttaccgactcctacactaccgtactaactacgcttagacgaggtactaggagtagtcgtgacgtagttacttattagtgtacgaagtactaagttatttacttacttaccgttacttccgtacttcgttaccgtttaggcccggtaacgggtacgtcgggtgttaccgggtatacgtacaacggtaccgttaaggtcgg

SEQ ID NO: 193560 - DNA, 797 bp, Homo sapiens
  misc_feature: GYAE6OF01A3AP3.11.76.G10.1.454.CMB.1.raw
  modified_base (554)..(554): a, c, t, g, unknown or other
  misc_feature (554)..(554): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtcctccagtacttccctggctgtgtctcgtgggcgagaccggccaccatcactgacagtccagtcagtaattctttagactacttccaacgtaagagtagtattttaggtttagtttacggtaaccaaacgaggtaaccgccgacggacccacggtaccctaaccgaaacgccgaacgtccttacgttaattttacggttcgggacttacgttccgttaacggttccgggtacggtttccccgggtcctacggtaccgttacgttccggtggacgtaggtcgtacgttcggtaacggggtaaccttaaacgtttccaaccgtttaccacccgtaaccgtatacccaaaagttcccgtccgtaggaccgtaacggtcctaaaggtacgtagttacggnggtaactacggtttaactttttaacgttacgtttacggtactaagttaaccgtttaaatttttaaacgtttaaccgttttacccttttaccgtttaccccggtttaaccgttacgttttaccccgtttttaaacgggttttcccggggaaacccggggtaaccgggggttaaccctaacggggtttacgacggggtaacgtacgttaaccgggaaacgttaaccgggttacggttacccgggg

SEQ ID NO: 193561 - DNA, 700 bp, Homo sapiens
  misc_feature: GYAE6OF01A10XJ.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctagcgagacatcgtgatcgacccagtcctccagtacttccctggctgtgtctcgtgggcagaccggccaccatcaactgacaagtccagtcagtattcttttaagctacttcaacgtagagagtatttgttagtttcgtaccaacgagaagccaggccacgcctacaagcagctctatttagtggctactctacgtcgggacttcccgggtcctggacccgtattccggcggactggtaggtacgtcgtagggaactaacgtttcccacgtttccaccgaacctactaacctaatcggtacccttagacggtaacggtccggtaaaggtaagtacggtttcgggagttacccgtaagtttaccgtttaagtttaccgtttacggtaaccctaacggttaacttaaactttaaccgtttaaccgttttaacccgttccggtttaacctttcccgttaacttcccggttttaaccgtttccggggaccgttaccgggggaaccctacgggtccggttacggtaaccgtacgtaacgtaaccggtaacgtaaccggtttggtccggttaacccg

SEQ ID NO: 193562 - DNA, 648 bp, Homo sapiens
  misc_feature: GYAE6OF01CTKHG.11.76.G10.1.454.CMB.1.raw
  modified_base (169)..(169): a, c, t, g, unknown or other
  misc_feature (169)..(169): n is a, c, g, or t
  modified_base (405)..(405): a, c, t, g, unknown or other
  misc_feature (405)..(405): n is a, c, g, or t
  modified_base (475)..(475): a, c, t, g, unknown or other
  misc_feature (475)..(475): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtcttcccgnggctgtcgtctcgtgggcgagaccgccaccatacaactgacaacgtccagtacaagtaactttcctttaagacttacgttaccaagtaagagtagttattttacggtttaaggtttacggtaaaccaaacgtaaggaacgtaccgacggaccaacgtccctaaccaaagccagtcctactatttagtggtactattctacgtcgggacgttcccgggtcctgaccgtagttccggnggtacaggtcggactcgagggtaactaacgtttccacgtcacgacctactacaactacgcctgacgacgntagagatggacgctagtacttagtattcgtactaagtactaaagttacttaacttacttaccttaccgttaccgtactttccgttaccgttttacgggacccggtaacggggtaccgtacggtccggttaggaacgtacgtaccgaacggtaccgtaacgtggtccggtaccg

SEQ ID NO: 193563 - DNA, 724 bp, Homo sapiens
  misc_feature: GYAE6OF01ATL9E.11.76.G10.1.454.CMB.1.raw
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
tcagcgagagataccacgaccggtgctcgatttagtcactcatacaggggacaacaggcaggcaggggcagcaagatggtgttgcagacccaggtcttcatttctcttgttgctctggatctcgtggtgcctgcggagacatcgtgatgacccagtctccagattccctggctgtgtctntgggcgagacggccaccatcactgcaagtccagtcagatcttagactatcanaganatattgtgttgtacanagaancgagcgancctacaacntacgctactattagtaggcatacctacgtacggtacgttccgggtcccaggtaaccggtntacccggtgtacgtaggtcggtaatccggttaggaacttaagttcacctcgtaccaccgtaactactaacgtacgtccgtacgtacgtacgggaccttaggaaaacgttcgttaacgggtgggtaacccaagggtttaccttttaacgttaagggtttacttaaccggtaagttaaccgttaaactttaaacgttttaacgtaaccgttttacccgtttaacgtttaccccgttaactttttaacccgggtactttttaaccggggtaacccggggttaacccggggttaaacccggttacggggtacccgttaaccgggttaaacgggaccgtttaaaacccggacgggttaaaccccgggttaaacgtttggggttaacgttacccgg

SEQ ID NO: 193564 - DNA, 778 bp, Homo sapiens
  misc_feature: GYAE6OF01CN6X8.11.76.G10.1.454.CMB.1.raw
  modified_base (146)..(146): a, c, t, g, unknown or other
  misc_feature (146)..(146): n is a, c, g, or t
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagcgagagataccacgaccggtgctcgatttagtcactcatacagggagctaacaacaggcaggcaggggcagcaagatggtgttgcagacccaggtcttctatttctcttgttgcttctggatctcgtggtcgcctggcgganacatcgtgatcgacccngtcctccagtcttcccgnggctgtgtcctggngggacgaggaccgccaccatacaacgtgaccaacgtccaagtacaagtaactttcgtttaagaccttaactacctaaacgtaaaggagtagttaagttttaggtttaacggttacgaaaccaaacgaaggtaaccgccgaacggtacctaaccggtaccctaaaccgaaacggtccaacgtccgttaacttagtttacggtcggactacgttccgtaacggtcggtaccgttcccgggtacctacgtaccggtacgttcccggaggtacgtaggtacggtactacggtaacggtaaacctttaattacccgtacttaccctaccaaaccgtaacttaaccgtaaacgtacgtcccgtagaaccgtagggtactaacggtaagtcgttcgggtaactacgtaacggtttaacttttaagttacgtctaacgaaagttactttaaacgtttacttaacttaccgtttccctacgtttaccggtaaacttccggtttaaccggttcgggggaacccgtaacggggttaccaaggttccggtaaagggtacctaaacggttacggaaaacggtccgttacggtacgg

SEQ ID NO: 193565 - DNA, 710 bp, Homo sapiens
  misc_feature: GYAE6OF01C7QLL.11.76.G10.1.454.CMB.1.raw
  modified_base (140)..(140): a, c, t, g, unknown or other
  misc_feature (140)..(140): n is a, c, g, or t
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
  modified_base (174)..(174): a, c, t, g, unknown or other
  misc_feature (174)..(174): n is a, c, g, or t
  modified_base (412)..(412): a, c, t, g, unknown or other
  misc_feature (412)..(412): n is a, c, g, or t
tcagcgagagataccacgaccggtgctcgatttagtcactcatacaggggacaacaggcaggcaggggcagcaagatggtgttgcagacccaggtcttcatttctctgttgctcgtggatctcgtggtcgcctggcgganacnttcgngatcgacccagtcctcagtcttccgnggctgtcgtctcgtcgggcgacgcggccacatacaactgactaacgtccaagtcgagtacgtttcttaagacttacttccaaagtaaggacgtagttacgttagttacgttacggtaaccaacgtagtaacgcgacgaccgaacggtaccctaacgaagcacggtactcgttaattacgtggactagtaccgtacgtcgggtaccgttccgggtacctcggtaccgtacgtttccggnggttacgacggtacggtacgtcggtaacgggtaaactaacgttacctacgttaccacctaccgtaactacgtaacgtacgaccgtacgtacgtacggtacgtaaggaacgtacggttacggtacggtaacgtacggttacctttaagtttaaccgttagttaaccggtagtaacccgttaaattacgtttaacttacgtttaccttaccgttaccgtaacgtttaccgtacggtttaccgacggtaccggtacggtacgtcggtacgtagtactacgtaacgagtactggtcgtaccg

SEQ ID NO: 193566 - DNA, 649 bp, Homo sapiens
  misc_feature: GYAE6OF01ED6F9.11.76.G10.1.454.CMB.1.raw
  modified_base (285)..(285): a, c, t, g, unknown or other
  misc_feature (285)..(285): n is a, c, g, or t
  modified_base (417)..(417): a, c, t, g, unknown or other
  misc_feature (417)..(417): n is a, c, g, or t
tcagcgagagataccacgaccggtgctcgatttagtcactcatacagggagctacaacaggcaggcagggggcagcaagatgggtgttgcagacccaggtcttcatttctctgttgctctggatctctggtgcctggcggagacatcgtgatgacccagtcctccagtacttccctggctgtcgtctcgtgggcgaggaccggccaccatcaactgacaagtccagtcaagtaattcttttaagactattccactaagagagatttgttagtttggtaaccaaanagaacgccaggccagccctacaaacgcagctacatttatgggactatctacgtcgggatttcccggggtcccctggacccgtattccggtggctaggtggatcgtgggaactaaattcactctacaccatanaactagctgcgacgtctagaagcgtggtggcagttacctttaagttacgttgtacgtaacgtacgttaaaatttaactttaacgttaacccttttacgttacccgtttacccgttaaacgttaccgtttaaccggtttttcgggacccggttaaccggggggtaacccgtacggggtacgtacggggtaacgtaacgtaccgtaaagggtaacccggtaacgtttacggggg

SEQ ID NO: 193567 - DNA, 528 bp, Homo sapiens
  misc_feature: GYAE6OF01EXHOH.11.76.G10.1.454.CMB.1.raw
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcaagtaattcttttagacttacttccaactaagagagtatttgttagtttggtaaccaacagaagccaggccagcctccaaagcagctcattatggcatctacgtcgggattcccggggtcctggaccgtattccggtggcagtggatcgtagggactaaattcactcacacatcaatgctgcaggctagaagtatggngnacgtctttattntgtcagctaattacttattacttctcttcgattccgttactttcggccgtagggtacccaggtgtacgganacgtacgagaacgtacgtggtcggtaccg

SEQ ID NO: 193568 - DNA, 719 bp, Homo sapiens
  misc_feature: GYAE6OF01DJGHG.11.76.G10.1.454.CMB.1.raw
  modified_base (118)..(118): a, c, t, g, unknown or other
  misc_feature (118)..(118): n is a, c, g, or t
  modified_base (152)..(152): a, c, t, g, unknown or other
  misc_feature (152)..(152): n is a, c, g, or t
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (436)..(436): a, c, t, g, unknown or other
  misc_feature (436)..(436): n is a, c, g, or t
tcagcgagagataccacgaccggtgctcgatttagtcactcatacgagggacaacaggcaggcaggggcagcaagatggtgttgcagacccaggtcttcatttctctgttgctctggntctgtggtcgcctgcgagacatcgtgatcgaccngtctcagtcttccgngctgtgtctcgngggacgagaccgaccacatcaactgacaacgtccatacgaagtactttctttaagactacgttaccaacgtaagtagtaagttagttttgttttaacggttaacgtaaccgaacgaacggaacgtaccgacggacccgtacgaccccgtaacaaacgcgacgtcgtactagttttacggtaggtacttacgtaccgttaccggtaccggggttaccgttcccggggtaccttaccggtaaccgtcggttacccgggnggtccgtaaggtaccggtagttacgggtacggttaacttaaaccgtttctaccctcctaaccgactaacgtacgaacgttacgacccgtgtaccgtagaccgtagaagtggtacggtggtactattacgttatttgtacgtacgtatagttaatttacttacttaccgtttaccgttccttaccgttcgtttaccgttacggtttaccgggacggtaaccggggtctagggttccggtaagacgttacgtaacgtaacggtaccgtagggtcggtcgtaaccg

SEQ ID NO: 193569 - DNA, 807 bp, Homo sapiens
  misc_feature: GYAE6OF01EG7W0.11.76.G10.1.454.CMB.1.raw
tcagcgagagataccacgaccggtgctcgatttagtcactcatacaggggacaacaggcaggcaggggcagcaagatggtgttgcagacccaggtcttcatttctcttgttgctctggatctcgtggtcgcctaggcggagacatcgtgatcgaccctagtcctcgagtacttcccgtggtcttggtcgtcgtcggtgggcgacgaccggaccacgtactacaacgtcgaacgtaacgtccacgtactaagtactttacgtttaacgacttactacctaagtaagagtagtttagttttggttaacggttacgaaaccagaagaacgacgacgaccacggtcctaacgaagcgtacgtcttaccttagtttaacggtcgaaccttacgttacggttaaccggtccggggttaccgtttccccgggtactacgggtaccgttacggttccgggtggacgttaggtcggtactacgggttaacggaactttaacgttccgtacctcctaaccgacgtacttacgtaaccgtcggtaccgtacgacgggtaacgttagtaaaggacgttaggttccgggtaacgtacttaaccgtttttaatttaccggttattaccggtaacgtaactaacgttttaaattttaaccgttttaccttaccgtttaccggttttaccgtaacggttcctttaacgggtttcccggttaacccggggaagggggtaacccggttaccggtaggggttacccggtaagtaacgtaaaccgtacgggtaaaccggtaaggtttaaccggtggtcccggtaacg

SEQ ID NO: 193570 - DNA, 781 bp, Homo sapiens
  misc_feature: GYAE6OF01BPO0D.11.76.G10.1.454.CMB.1.raw
  modified_base (137)..(137): a, c, t, g, unknown or other
  misc_feature (137)..(137): n is a, c, g, or t
  modified_base (420)..(420): a, c, t, g, unknown or other
  misc_feature (420)..(420): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctggcgganacatcgtgatcgacccagtcctccagtacttcccgtggctggtcgtcgtcgtgggcacggaccgtccacctatcaactgaccaagtccagtacaagtatttcgttaagacttacttaccgataaggagtagttagttttaggttaggttacggtaaccaagtacggaacgtcccgacggtccacgtaccctaaccgaaagccagtcctattagtttaggtcggtactacttccgtacggttccgggtaccgttcccgggtacctaggaccgttcgttcccggnggtacgtacggttacggattccggtaacggtaacttaacgttccaacttaccgtacctaacctagttaacctaagtaccgtaccgtaggacgtaacggtacgtaaggtaacggtacgttacgggtcggaccgttaacgtttaccgttttaagtttacgttacggttactaacggttacttaaagtttacttttaacgtttcccttacggtttaccttacccgttacgttcccgtttaaccgggtttccggggaacccggttaaccggggtacccggttaacggggtaccgttaacggggtaacgtaacccgggttaacgaaccgggttaaaccggttacggttacccgggttggtaacccg

SEQ ID NO: 193571 - DNA, 855 bp, Homo sapiens
  misc_feature: GYAE6OF01EUHBB.11.76.G10.1.454.CMB.1.raw
tcagcgagagataccacgaccggtgctcgatttagtcactcatacagggagctacaacaggcaggcaggggcagcaagatggtgttgcacgacccaggtcttctatttctctgttgctctggatctcgtggtcgcctgcggagactatcgtagatcgacccagtcctccagtcttcccgtgctgtcgtctgagggaccgacgaccgtccacctactacacgtcgacaacgtccagtacaagttacttctttaagaccttacgttacctaacgtaagagtagttagtttaggtttacgttacgaactaacgagacgaccgacggtaccaccgtacctaaccgaaacgtccgaacgttaccttacgttaacgttttacggtacggtactacggttaccgttacccggtacgggttacccggttccccgggtaccgttaaccgggtacccggttaaccggttcggggtacccggtacgggttacggttaacgggttaccggtacgggttaaaccgggttaaacttaaaccggttttacccttaccccggttaacccttaacccggtaaacccttaacggttaacccgtaaacgttacccgccgttaacgtaccgggtaaccggttaaacgtaagggtaaaggttacgggttacgtaaggtaccgtttaaacggtttattttaacgtttacggtacgtaccgttacgttaaactttacgtttaaacttttaccggttactttaccggtttaccccttaacggttaccgtttaccggttacggttacccgggtaacggacgggtaccccgtagggttacccgaggtactaacgtaaggtacggtaaaccgtggtaccggg

SEQ ID NO: 193572 - DNA, 677 bp, Homo sapiens
  misc_feature: GYAE6OF01B6YNI.11.76.G10.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
  modified_base (337)..(337): a, c, t, g, unknown or other
  misc_feature (337)..(337): n is a, c, g, or t
  modified_base (638)..(638): a, c, t, g, unknown or other
  misc_feature (638)..(638): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtccnccagtacttcccgnggctgtctctgngggcgaggaccgaccacatacaactgacaagtccagtacaagtatttctttagactacttaccaagtaagagtagttagttttaggttagttacgaaccaagagaacgcgacggaccactacctaacgaaagctagctattaagtttaggnggtacctaacgtccgttaaccggtaccgggtaccgttcccgggtacctcgtaccggtcttccgggtagaccgtagggtacgtacgtacgggtacggtaaacttaaacgttccctaactaccgttaacccaaccttaacgtacttaaacctcgaccgtacgacggaacggtacgtaagacggtagtcggtgtactagttacttattacgttagctaactagtaattaacttcttacttactacgtactacgtttacgtcggttaccggaccgggtaacggtaccgtaggtcgtaacgggtanaccggtagaaacccggttaggacgttcgggtcggtaacc

SEQ ID NO: 193573 - DNA, 737 bp, Homo sapiens
  misc_feature: GYAE6OF01BJMNA.11.76.G10.1.454.CMB.1.raw
tcagcgagagataccacgaccggtgctcgatttagtcactcatacagggggacaacaggcaggcagggggcagcaagatggtgttgcagacccaggtcttcatttctctgttgctctggatctctggtgcctgcggagacatcgtgatcgacccagtcctccagtacttcccgtggctgtgtctcgtgggcgaggaccggccaccataccaactgacaagtccagtacaagtaacttctttagactacttaccaacgtaagtagagttatttaggttagtttacggtaaccaacgagaacgtaccgacggaccacgacctaaccgaaagcaacgtcctactatttacgtagggactacgtacgtacgtacgggttaccgttcccgggtaccttacggaaccgttacgttccggtgacgtacggtacggtactcggtacgggtaactaaacgttccgaactaccgtccaaccgtataacctaagtacgacccgttagacgtaggaccttagaaagtctgggtacgtctaacgttacgttttaatacgttagtaaccgtactaacttaaaagtttacttttaaacttacccgtttacttacccgttaccgttaaatttcccgttttaacccggtttacggggaccccggaacgggggttaaccgtaccgggttaacggacggttaacgaacgttaaccggaacggttaaaccgtaacggtttgggtacccgtaacccgg

SEQ ID NO: 193574 - DNA, 723 bp, Homo sapiens
  misc_feature: GYAE6OF01AK07V.11.76.G10.1.454.CMB.1.raw
  modified_base (311)..(311): a, c, t, g, unknown or other
  misc_feature (311)..(311): n is a, c, g, or t
  modified_base (669)..(669): a, c, t, g, unknown or other
  misc_feature (669)..(669): n is a, c, g, or t
tcagcgagagataccacgaccggtgctcgatttagtcactcatacaggggaggtctgagagaggacgccccgcccgtgggatttgcaggttattttcattgggtgctcgaggactgaaacaaagagaactcaccagtggaaccgtcgggctgagtccgttggttcttttttcgttggtggtactttaaagtttttaaaaggtcgttaccagtactaacgaacgtacgacttacgtggaactcggtgggggcgtacgttcggtcgtcgtcggaccggggtacggtccctaggacgtacttctccgtgtcgcncgtcctcgtcgttaccttcccgtagtacttcttacttcgacgtacgtcggtccggttcggcccgacacggtccggtaccggggagggggtacgtacggttggggtacggtcggtccgccgtacctaggttacgtaacgttcggtaatttcgtagtacgtaatacgtttgtagtcggtccgacgtacggtacgggacggtcttaacgttgtcgccgacgtacagacacgtacgactaacctctacctccacacgtcgtacgaccacgcgacgacgacgtacgactactagtttacgtcgttagcgttaggttagggttcggttagggttcgtcgttaacgttcggttaccgttcgtcgnggttcgccggttacgggacccggtacggttaccggtccgtaccgtccgtacccg

SEQ ID NO: 193575 - DNA, 786 bp, Homo sapiens
  misc_feature: GYAE6OF01ETUYV.11.76.G10.1.454.CMB.1.raw
  modified_base (140)..(140): a, c, t, g, unknown or other
  misc_feature (140)..(140): n is a, c, g, or t
  modified_base (774)..(774): a, c, t, g, unknown or other
  misc_feature (774)..(774): n is a, c, g, or t
tcagcgagagataccacgaccggtgctcgatttagtcactcatacaggggacaacaggcaggcaggggcagcaagatggtgttgcagacccaggtcttcatttctctgttgctctggactctcgtggtgccttggcgganacatcgtgatcgacccagtctaccagtacttccgtggctgtgtctcgtggcgagcgaccacatcactcgacagtcagtacatacttctttacgactttactccgaacgtaagacgtagtagttttagtttagttacggtaacctaaacggagtaaacgccgacggcccgtacgtaccctaacgaaacgtcaacggtcttagttaagttttacgtgggacttacttacttacggtccgggtacgtttcccgggaccttcggaaccgttacgttccggaggtactaggtacggtactacgggttaacgggtaaacctttaacgttccgacttaccggtactaacgtaacttacgaagtccgttacgacgtaaccgagtacggtaacgagtttccggtaaggtaccggtaagtttacggtttaactttttaacggtttaacgttcgaaccggttaacttaacgttaacttttaaacgttttaacctttaccgttttacctttaaccggttacctttacgttaccgtttttaccccgggttcgggtaaaaccggggacccggggtttaaccacggttaccgggttaacggggtacctacggttaacccgggaaagttaaacccggttagttccggggntttaaacccggg

SEQ ID NO: 193576 - DNA, 568 bp, Homo sapiens
  misc_feature: GYAE6OF01B1NWF.11.76.G10.1.454.CMB.1.raw
  modified_base (563)..(563): a, c, t, g, unknown or other
  misc_feature (563)..(563): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagacggccaccatcaactgacaagtccagtacagtaattcttttacgacttattaccactaagacgagtattttggtttagtttaggtaccaacagaacgccaggccacgcctaccaaagcagctactatttagtgggctatctacgtcgggtacgttcccgggtcctcgaccgtacgttccggtcggcgtaggtcggtactcgtagggactaaacttcactctacacctatacatacgctgcgagtcagaagtgtggtacgctagtcttattgtagtcagtctaatatttactctccttctaccgtattccgttacgtttcggacccgtacggggtaccgaggtcgtacggagtactcggaacgtacgacgttgngtccg

SEQ ID NO: 193577 - DNA, 741 bp, Homo sapiens
  misc_feature: GYAE6OF01EX5FB.11.76.G10.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagcgtgtcgtttctaggcgactaatttaaaggntaccagtctacgaacgagactatgaatcgaggggtctacttgcgcgtgccggtaggttccngacgctctccttnagctacgcttcgacgtattcccttnattccaatttccaatagtgtcccgtaggtccccgaactaacggtcaccgggtaaggggactcttagggacggtttcggacgtccctactagtacgtaaagttcggtaaactttcgtacgtaggtaactaagtttgtaacgtcggtacgtaccgttccgtagggaaacgggtcctaaagtttctcggaccggtaccgacgtacgtaactacgttagtaacctaaacgtaacttaaccttacgtacctacccgtacgtaacttaaccaacggccgaactacgaacaacgacgtaaccgtacgaacgttaaccgttgttacggtacgtacgggtaacggtttcgggtttacgggtacgggtacgtaaacgttcggttaccggtacccggtttaagtaccgtttaaccggccgggtttaacgggacccggttaaacggtaccccgggttacggtacccttaaccccggg

SEQ ID NO: 193578 - DNA, 649 bp, Homo sapiens
  misc_feature: GYAE6OF01B3OFX.11.76.G10.1.454.CMB.1.raw
  modified_base (610)..(610): a, c, t, g, unknown or other
  misc_feature (610)..(610): n is a, c, g, or t
  modified_base (642)..(642): a, c, t, g, unknown or other
  misc_feature (642)..(642): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgaccagtctccagacttccctggctgtgtctcgtggcgagaccggccaccatcaactgactaagtccagtacagtattactttagacttacttaccaataagagtagtagttttggttagttacggtaacaaacagaacgccgacgccacggtacctacgaaacgcacgtcttacttagttttagtggtacctactcgttacgtcgggtacggttcccgggtccctcgaaccgtcgttccggtggtacgtaggtacggtacgtacggtacgggtaacttaaactttcctaccttccgtacctacctactaactaacgtaccgtcctagacgtacggtacgtaagtacgcgttagggtcgtacgtagttactttaagtttacgttacgtactaagtacttaagttaactttacttaccttcgttacctacgtaccttcgttacgttcggtaccggacggtacgnggtacgtgacgtagtacgacgtacgtcgtggnggtaccg

SEQ ID NO: 193579 - DNA, 769 bp, Homo sapiens
  misc_feature: GYAE6OF01C5EMN.11.76.G10.1.454.CMB.1.raw
  modified_base (729)..(729): a, c, t, g, unknown or other
  misc_feature (729)..(729): n is a, c, g, or t
  modified_base (735)..(735): a, c, t, g, unknown or other
  misc_feature (735)..(735): n is a, c, g, or t
  modified_base (761)..(761): a, c, t, g, unknown or other
  misc_feature (761)..(761): n is a, c, g, or t
tcagcgagagataccacgaccggtgctcgatttagtcactcatacaggggacaacaggcaggcaggggcaacaagatggtgttgcagacccaggtcttcatttctctgttgctctggatctctggtgcctggcggagacatcgtgatcgacccagtctccagtacttcccgtggctgtgtctcggtgggcgaggaccgccaccataccaactcgacaacgtccagtacaagtaacttctttaagactacttccaagtaagagtagtattttaggtagtttacggaaccaacgaagtaacgccgaacggcccaacgtccctaaccgaaaacgcgtaccgtaccttacgtaagtttttacggtcgggtacttaacgtacccgttacgggttaccggggtaccgttttccccgggggtacctacggtaacccggttaccgtttcccgggagggtaccctaaggggttacgggtaacttcccgggtaacggggtaaactttaaaacgttttccctaaacccgttccacccgttaaccaacgttaaccgaaaacgttccggcccctaaggggtaccctaaacggggtattaaacggaaggttactacggggtacgaccgttaacgttacgtttttaattacgtacgtaccgtaaagtaacttaaatttacgttaccttactttaccgttccttagtactttacgtacggttcggaccgtacggggacctagggngtaaancggtaacacgaacgtaactgtacggngaccgtac

SEQ ID NO: 193580 - DNA, 776 bp, Homo sapiens
  misc_feature: GYAE6OF01CXBOH.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggtctttttcttgtggcttagttttaaaggtgtccagttctacgaacgagactacgtggaagtcgtggggacgtacttcgtgccgttggccggggtacggtccctggacgtacttctccgtgtcgcagcctcgtggtactttccccttagtacttcgtaccttcacgtagtcggtccgtcggtccaccgagtccggtaccggaggggggtactaggtttggacgggttcgggtaccgtcccgtacgtagttacgtaacgttacggtaaactttacgtttactacgttaacgttaaagtttttcggaacgtttcggaacggttaccggtaccggttagggacggggttactacgttttacgtggtaccgcgacgaacgtaccgtaaacgtaccgtaaacgtaaaccttaccgtttaacgttcccttaccgtacctaaccgttaaccgaacgaccggtaacgtaacgtaacgaaaccgaccgtaaccgtaacctaaactttagttccgttaggtacggttacgggtaagggttttcgggtttacgggtggggtaaccttaaggttcgttacgtccgtttcgtacggttgtcggtcgggtaccgacgggtacctcggttccgtccgtcccg

SEQ ID NO: 193581 - DNA, 821 bp, Homo sapiens
  misc_feature: GYAE6OF01C9GGA.11.76.G10.1.454.CMB.1.raw
  modified_base (169)..(169): a, c, t, g, unknown or other
  misc_feature (169)..(169): n is a, c, g, or t
tcagcgagagataccacgaccggtgctcgatttagtcactcatacagggacaacaggcaggcagggcagcaagatggtgttgcagacccaggtcttcatttctctgttgctctggatctctggtgcctgcggagacatcgtgatcgacccagtctccagtacttcccgnggctgtcgtcctcgtgggacgacgaccggccaaccatacaaacgtgaccaaacggtccagtacaagtaacttcgttttaagaccttattaccaagtaaagagtagttagtttgtttaacgtttacggtaaccaaacgtagaacgccgtaacggacccaacggaccccttaaccgaaaagtccgtaacgtccttaacctagttttacggtcgggaccttacgtccgttaaccggtccggggttaaccgttcccgggggtacccttacggtaaccccgtacgtttcccgaagtcgggtactaacgggtcggtacttccgggttaacgggtaaacctttaacgttttccactttcctaacctaaccctacttacctaaacgtcgtacccgttcgaacgtaacggtccgttaaggaacgtacggttcggtaccgtacgttaacgttacgttttaagtttacgtttaccggtactaaggttaacctttaagtttaactttacccttttaaccgtttaccctttaccgttaacccggtttacttacccggtttaaccggttttacccggggaaccggtaaccgggggtaacctacgggttccgtaagggtaaccgtacgtaaaccgtacggtaaaccgtaggttcgggttaacccggg

SEQ ID NO: 193582 - DNA, 676 bp, Homo sapiens
  misc_feature: GYAE6OF01DPW3Z.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtctccagtcttcccgtggctgtgtctcgtgggcgacggaccggccacatcaactgaccaagtccgagtacaagtaactttcgtttaacgaccttacttaccaataagagtagttattttaggttagttacgaacaagagaacgccgaggccacgacctacaaagcacgtctacgttagtttagtcggactacgtcgtacgtcgggtaccgttcccgggacctacggaccgtacgttcggcggtacaggtcgtctacggtacggtaacttacttccgactcctacacctactactaagtacgtaccgtacgtacgacggtacgtagtaagtagtacgtcgtacgtagttactttaattagtagtacctaagtaacttaactttaactttacgttacctttccgttaccgttacgttaccttacgttacggtttcccggaaccgggttacgggtacccgtacgggtacgtaacggtacgtacggtaaccggtaacggtaacgtaacggttggtccgtaacgg

SEQ ID NO: 193583 - DNA, 746 bp, Homo sapiens
  misc_feature: GYAE6OF01DF6SK.11.76.G10.1.454.CMB.1.raw
  modified_base (163)..(163): a, c, t, g, unknown or other
  misc_feature (163)..(163): n is a, c, g, or t
tcagcgagagataccacgaccggtgctcgatttagtcactcatacgagggggacaacaggcaggcaggggcagcaagatggtgttgcagacccaggtcttcatttctctgttgctctggatctcgtggtgccgtggacggagacagtcgtgatcgaccagtcncagtccttccgtggctggtcgtctcggtggacgacggccggaccaccatacaacgtcggacctaacggtccagtactaagtaactttcgttttaagactttacctaccaaagtaacggtagtaagttattttacggttagtttaacggaacccaaaggacggaaccgcgacggacctacgtacctaaaccgaaaggctacggcttataagtttaggtcgcttagtccgtacgtacgggtcgttcccgggtctacgtacgtacgtccggaggtacgtaggtcggtacttacggacggtaaccttaaaccggttcaccgttaccacctacttaactaccaacgtcgtaccgtcgtacggaaggttaaccagggtaacgtggttcggtaacggtccgttaagtttaactttagtttaccgttaggtaaccaaggttaaccttaagtttaccttaaaccgtttccttaccgttaccggtttccctaaacgtttccggtaccgttttacggggaccggttaaccgggtcccgtagggtccctaggggaccttaacgtcggtaaccgaggttcggtaacggtccgtacg

SEQ ID NO: 193584 - DNA, 678 bp, Homo sapiens
  misc_feature: GYAE6OF01B2LT9.11.76.G10.1.454.CMB.1.raw
  modified_base (137)..(137): a, c, t, g, unknown or other
  misc_feature (137)..(137): n is a, c, g, or t
tcagcgagagataccacgaccggtgctcgatttagtcactcatacaggggacaacaggcaggcagggggcagcaagatggtgttgcagacccaggtcttcatttctctgttgctctggatctctggtgcctgcgganacatcgtgatcgaccagtctccagtcttcccgtgctgtgtctcgtgggcgaggaccggccacatcaatgacaacgtcagtacaagtaactttctttagacttacgttaccaacgtaagagtagttagtttaggtttaggttacgtaaccaacgaacgaacgtccgacggcctacgtaccctacgaaagcacgtctactttatttaggtgtactacgttaccgtacggtcgggtacccggttcccggggaccctacggtaacccgtacgttcccgggtcggtacggtaggttcggtacgttacgggtaacggtaactttaaacgttcctaccgttacctacctacctattaacgacgtaccgttccgtaggtaccgaaggtacgacgtaagtcggtggtagtacgtagttacttatttacgtgtactagtaacttattaacttacttactttactccttacgttaacttccttaccggttacgaccggtcgggtacagggttgtaccggtatacggtacgacgtaaggtcgtggcgttaccg

SEQ ID NO: 193585 - DNA, 531 bp, Homo sapiens
  misc_feature: GYAE6OF01BO2N2.11.76.G10.1.454.CMB.1.raw
  modified_base (234)..(234): a, c, t, g, unknown or other
  misc_feature (234)..(234): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagtacttccctggctgtgtctctgggcgagaccggccacatcgagtgcaagtccagcgagtacttcttttanatagtgtcaacgataaggactatttagcttggtatcagacaaaaaccaggacagcctacctaaactgctcatctcctgggcagtcctacccgggcacccggacgtccctcgacccgatttcagtggcagcgggtcgngggacagtacttcactcctcacctatcacgcaacctgcaggactgaagntgtggactagtttatactgtcagtntagttagttgtacgagtctccgcttcgtacggtttcggcgggacgggtccggcgggttaggacgtatacggcgaacgtagttcggg

SEQ ID NO: 193586 - DNA, 643 bp, Homo sapiens
  misc_feature: GYAE6OF01ED9LH.11.76.G10.1.454.CMB.1.raw
  modified_base (415)..(415): a, c, t, g, unknown or other
  misc_feature (415)..(415): n is a, c, g, or t
tcagcgagagataccacgaccggtgctcgatttagtcactcatacagggagctacaacaggcaggcaggggcagcaagatggtgttgcagacccaggtcttcatttctctgttgctctggatctcgtggtgcctggcggagacatcgtgatcgacccagtcctccagtactttcccgtggctgtgtctacgtgggcagaccgccacatcaactgacctaagtccaagtcaagtaactttcttttaagacttacgttaccaactaacgagtacgttattttggtttaagtttacggaacctaacgaagtaacgccgtaggaccacggtaccctaccgtaaaagccagtctacgtatttacgttggactattcgtaacgtcgggacgtttcccgggtcctggaccgtacgttccggnggaccagtggatcgtaggtaactaagtttccaccgtctactaaccatactaatcgaccgtgtacgtagctaggtaacgtgtagtacgcgtagtctttaagttagttcgacgtacgtacttaattacgttacttacttcgtaccgttcgtacttaccgttacgttttcggaccggtacgggtaccgacggtcgacggtacgtacgtaccgtaacgtacgtacgtacggg

SEQ ID NO: 193587 - DNA, 939 bp, Homo sapiens
  misc_feature: GYAE6OF01APROU.11.76.G10.1.454.CMB.1.raw
  modified_base (210)..(210): a, c, t, g, unknown or other
  misc_feature (210)..(210): n is a, c, g, or t
  modified_base (732)..(732): a, c, t, g, unknown or other
  misc_feature (732)..(732): n is a, c, g, or t
tcagcgagagataccacgaccggtgctcgatttagtcactcatacaggggacaacaggcaggcaggggcagcaagatggtgttgcagacccaggtcttctatttctctgttgctctggatctcgtggtcgccgtggccggagactagtccgtgtactacgaccctagtcctaccagttaccttcccgtggtccttggttcgtccgtcggngggccggaaccggccgacccaactaactaccaacgtcgaaccgaacgttccaggtactaacgttaacttttaccgtttaagaaccttcttaaccgtaagtaacggaggttaagttttacgtttttaggttacggtttaaccggtaaaccaagtaacggtaaaccgggcccgtaaccggtaccgaaccccgtcccgtaaaccgaaacgcgttaaccgtaccttaacggtttaacgtttaggtttaccggacccttaacgttccggtttaacccgggttccgggggttaccccggttttaccccgggggacccttaacccgggtaccggtttaccgggtttaccgggacgttacggtaacgggtttcggaacggttttccgggtaaaagtaacccttttaaacggttcctacccggtactaaaccgtacccaacgttactaaaccgttcccgggacgttcgtaaacccgtagggtaacctagggaaacgttccgggtttaggaccgtacgtttaacccggtttnttttaaggttaacctggtaaaccgtaacttaactttaacgtttaaacgtttcccttacgtttacccgtttaacccgttaccgttaactttaccggtttaccggggttaaccccggtaccgggtaaacgggtcccgttaaagggtcccgggtagttaacccggtaacttaacggggaactttaccgggagttcccggggtaataccgg

SEQ ID NO: 193588 - DNA, 718 bp, Homo sapiens
  misc_feature: GYAE6OF01CSN0Q.11.76.G10.1.454.CMB.1.raw
  modified_base (130)..(130): a, c, t, g, unknown or other
  misc_feature (130)..(130): n is a, c, g, or t
  modified_base (173)..(173): a, c, t, g, unknown or other
  misc_feature (173)..(173): n is a, c, g, or t
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
  modified_base (450)..(450): a, c, t, g, unknown or other
  misc_feature (450)..(450): n is a, c, g, or t
  modified_base (674)..(674): a, c, t, g, unknown or other
  misc_feature (674)..(674): n is a, c, g, or t
tcagcgagagataccacgaccggtgctcgatttagtcactcatacaggggtttacaacaggcaggcaggggcagcaagatggtgttgcagacccaggtcttcatttctctgttgctctggatctctggtncctgcggagacatcgtgatcgaccagtctccagtacttcccgnggctgtgtctcgtgggacgacgaccggccaccatacaacgtcgacaacgtccagtacagtaacttcttttacgacttacttaccataagagtatagtttgttagttacgaaccaanagacgccgacggccacgacctacaaagctacgtctacgttagtttacgtggactacgttcgtaccggtcgggtaccggttcccgggtcctacgtaaccgtctttccgggngtacgtaggtcgtacgttaggtacggtaacctttaacgtttccacttaccncgtaacctactacgtaacgttccgccgtagaccgtaaggtacctaaggtaacgtacggtcggtacggtacttaccgtttaagtttactttagttccgaaacgtactaaacgtttattaaacgtttactttacccgttcttttaccgttaccgttactttacccgttaacgggttttccgggaaccgggttaacccgggttacgaacgggttcacggggttaaanacccggttacgaaccggtaacgggttaccgtgggtcccgtaccg

SEQ ID NO: 193589 - DNA, 644 bp, Homo sapiens
  misc_feature: GYAE6OF01DX7DN.11.76.G10.1.454.CMB.1.raw
  modified_base (272)..(272): a, c, t, g, unknown or other
  misc_feature (272)..(272): n is a, c, g, or t
  modified_base (446)..(446): a, c, t, g, unknown or other
  misc_feature (446)..(446): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtacttccctggctgtgtctcgtgggcgagacggccaccatcaactgcaagtccagtcagtaattcttttagactattccaataagagtagtatttgttagtttacgtacaanagaagccaggccagcctaccaaagcagctactatttgtcggctatctacgtcgggtacttcccggggtcctcggaccgttacgttcccggtggcgtaggtcggtagtcggtagggtaactaaagtttcaaccttctacacctatacaattacgcctagacgaggctaggaagtntggtacggtctagtaccttttaatttgttacgtactaaggtacttaaattacttttaacgttaccttttccgttcctttaacccggtaactttcccgtttaaccggttttaccgggacccggtaaacgggggttaccctaggggtcccttaggggaacttacgtacggaaacgtaccgttaacggttgtacgggtacc

SEQ ID NO: 193590 - DNA, 793 bp, Homo sapiens
  misc_feature: GYAE6OF01D98X9.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctcgtggtcgcctggcggagaccatcgtgatcgacccagtcctccgagtacttcccgtggctggtcgtctcgtgggcgagaccggccaacatacaactgactaacgtccagtacagtaactttcgtttaacgacttacgttaccaacgtaagagtagttagttttaggtttaaggttacgtaaaccaacgagtaaccgccgtaggacccacgtaccctaaccgaaaacgcgtacgtaccttacgttaagttttacggtacgggacctacgttaccgttaccgggttccgggttaaccggtttccccggggtaccgtacgggtacccggttacgtttccggtacggacgtaggtacggtacgtacggtacggtaaacttaaacgttacctacgttcctaccaacctaatacgtaactacgccctaaggaccgtacggaccttaaggtaaccgtgttcggtacggacttaacggtttacctttaagtttacgttacggtaactaacggtactttaaacgtttaacttccttttaaccgttcccttaaacccggtttcctaacgtttacccgtttaccgggtttaaccggacccggggtaacggggtaccccgttagggacttaacggggtacttaaccgtaccgggtaaaccgttacggaaccggttacgggg

SEQ ID NO: 193591 - DNA, 707 bp, Homo sapiens
  misc_feature: GYAE6OF01AODZP.11.76.G10.1.454.CMB.1.raw
  modified_base (178)..(178): a, c, t, g, unknown or other
  misc_feature (178)..(178): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtcgccgtggcggagacatcgtgatcgacccagtcctaccagtcttcccgnggctgtgtcgtcgtgggcgaggaccgccaccatacgaatgacaacgtccagtcaagtacttctttaagacttacttccaacgtaagagtagtattttggttagtttacggtaaccaacgtaggaacgaccacggaccacgtacccgtacgaaagccagtctactagtttagtcggctactcgtacgtccgggtacgttcccgggtcctacggtacgtaccttcgggcggcgtaggtggtacttcggtaggtaaccttaagtttcaccttcctaccgtaactatacctaagtcccggtacctggtaccgtagggtactagggtaaccgtggttacgggtacgccgtttaaggttacgtttttaagttcgttacgttaacgtccgttaaagttaactttaacgttaactttccgtttcctaccggtttaacctacgtttaccgtttacccgggttcgggttacccgggaacggggtcttacggggtccctagggtaacttacggtaccggtagtaaccgggttggtaccgg

SEQ ID NO: 193592 - DNA, 836 bp, Homo sapiens
  misc_feature: GYAE6OF01BKPSP.11.76.G10.1.454.CMB.1.raw
tcagcgagagataccacgaccggtgctcgatttagtcactcatacagggggaggtctgagagaggagccccgccctgggatttgcagggttattttcattgggtgctcaggactgaacaaagagaactcaccatggaactcgggctgagctggtctttttcttgtggcttaattttaaaaggtgtccagtctacaacgagactactggaatcgtggggcgacttcgtgcgtggccggggtacggtcctgacgctcctccgtgtcgcgacgtcctcgtggtacctttccccttgtcttcctactttcactagtcggccgttcgggtcccgaccaacggtccgtaccggggaggggggtacggtagttcggggtagggttcgggtccgtaccgtccctagtacggtaaattaccgttaagttttcttaagtaaccgtaattaaacgttttgtaaacggttcggtaccggttaaccgtccgggttaaggggaaccggggttacgttaagttttaccgtacggttccgacccgtacgacgtacctattacgggtaacaaacccgtaacccttacctttacctacccctacctaacctaacctaacccgtaacgaccgtaaccgtaacggtaccgaaacggacccgaaccgtaaacctaaacgtttacctttacgttacggttacggttaccggggttaggggttttacggggttttccggggttcgggtaacgtttaacggttcccggttcccgtttcccggttttcggccggttcgggtaccgggttccgggggacccggtaacccggggtaccccgttcggtaccccggttaccccgg

SEQ ID NO: 193593 - DNA, 849 bp, Homo sapiens
  misc_feature: GYAE6OF01BAY2V.11.76.G10.1.454.CMB.1.raw
  modified_base (75)..(75): a, c, t, g, unknown or other
  misc_feature (75)..(75): n is a, c, g, or t
  modified_base (630)..(630): a, c, t, g, unknown or other
  misc_feature (630)..(630): n is a, c, g, or t
tcagcgagagataccacgaccggtgctcgatttagtcactcatacagggagctacaacaggcaggcaggggcagnaagatggtgttgcagacccaggtcttcatttcttcgtggttgctcgtggatctccgtggtcgcctgcggacgacatcgtagactcgaccgtagtcctacgtacgtaccttcccgtggtcttgtcgttcgtcgtacgggcgacggaccgaccacctactacacgtgactactaccgacgacagtaacttctttagacttactacctaactagagtagtattttaggtttacgttacggtaaccaagaacggaacggctaaccggccacgtcctaacaaacgcgtacgtctaccttaagtttacgtcggtactaactttaccggtaaccgggtccgggtttaccggttacccccggggtaccgtacccggttaacccggttaacggtttccccggtgggtaaccgttagggttacggttaacgttaccgggttaaacggggtaaacctttaaaccgtttccacccttccgtaaccctaacccgaactttacgaaagttcccgtacgtacggaacgtacggacgtaagtaacggtgttacgtcgtaagtttaacgttnttttaacttaaggttcctaacgggtaacttacgttaaaacgtttttaacttaacggtttccccttttaacttaccccggtttaacttaacccgttaccggtttacgttttaccccggggacggggggttaaccggtaccggttaaccggggtaggttaacgggttaaaccccgtacgggtaaacccgtaaccgggtttaacgaaccccggggtttaggg

SEQ ID NO: 193594 - DNA, 897 bp, Homo sapiens
  misc_feature: GYAE6OF01EH8U5.11.76.G10.1.454.CMB.1.raw
  modified_base (262)..(262): a, c, t, g, unknown or other
  misc_feature (262)..(262): n is a, c, g, or t
tcagcgagagataccacgaccggtgctcgatttagtcactcatacaggggacaacaggcaggcaggggcagcaagatggtgttgcagacccaggtcttcatttctcttgttgctctggatctcgtggtgccgtgacggacgtacagttcgtgactcgaccctagtcctacgtagcgttcccgtggtctggttcgtacgtcggtacgggcgacggtacccggcaaccgtatacaacgtggacctaacggttccaacggtaacnccgtttaaaatttaccgttttaaagtaaccttaacttaaccaaacgttaaggtaagttaagttacgttttggtttaacggtttaacggtaaccgtaaacgacgaacggtacccgaacggacccctaccgtaccgtaccaaacggtcctacgttactttacgttacgttacggtacggtacttacgtacgttacgggaccgacgttttccccgggggtacccttacgggtaccccgtagtttaccccggtagggtaccgtaacggttcggaacgttaccggtaacggtaacctaaaacgttttcccaaccgtttacctaccttaaccaacgttaccgaaacgttaacggacccgttaggtaccgtaagggtccaaagggtacgtaaggttacgtaggtaccgtagtttcttaacgtttacgttaggtaccgtaagtaccttaaagttacctttaacgtttacgttttaccttaccgttttacccgttagtttacccggtttaaaccggttttaccgggaacccgggttaccggggtaacccggtaacgggttacccggttaggggtaaacgtttaaccgacccgggttaaaacggtaacccggtttaaccgggttaaccgggtaccggtaacccgg

SEQ ID NO: 193595 - DNA, 818 bp, Homo sapiens
  misc_feature: GYAE6OF01A8E96.11.76.G10.1.454.CMB.1.raw
  modified_base (177)..(177): a, c, t, g, unknown or other
  misc_feature (177)..(177): n is a, c, g, or t
tcagcgagagataccacgaccggtgctcgatttagtcactcatacgaggggacaacaggcaggcaggggcagcaagatggtgttgcagacccaggtcttcatttctctgttgctctggatctcgtggtgcctggcgagacatcgtagtatcgacccagtcctccagtactttcccgnggtctgtgtctcgtgggcgagccggcccaaccgactaccgaaccgcaacgtccagtcacgtaattctttatactacttaccagtaagtacgtagtatttagtttacgtttacgtaacctaacgaacgaacgaccgtacggaccacgtaccctaccgaaacgcgtacgctacgtagtttaagttgggtactagttacttaccgtacgggtacggtttcccggggtcccgttacggtacccgtacgttaccggtcgggtactagggtcggtacggttacgtcgggtaaacgtaactttacgaccgttacctactacccgtaattactaaacttcgttacctacgtaaggtcctaaggtaagtaacgttcgggtaaggtacgtacgtttacgttacttttaggtttactagtaacgttaaccgttaaagttacttttaaacctttaccgtttaccgtttacccgtttacggtaacttttcccgtttaaacgttttccggggtaacccgggttaacccgggggtaaccggtaaaccggttaccggggtttaacgggaaacgggtttaaccctaacgggtaacccggtttaaaccggggtaaacgtttcggggtttaacccgtaacccgggttacggtaacccccg

SEQ ID NO: 193596 - DNA, 614 bp, Homo sapiens
  misc_feature: GYAE6OF01A2JO5.11.76.G10.1.454.CMB.1.raw
  modified_base (426)..(426): a, c, t, g, unknown or other
  misc_feature (426)..(426): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaattcttttagacttattccactaagagtagtatttacgttagtttggtaaccaacagaacgccaggccagcctaccaaagcagctactagtttagtggcatctacgtcgggtacttcccgggtcctacgaccgtacgtttccgtggccgtaggtggactcggtagggaacctaaagtttccactctacctacactacaactacgccgtnaccgaggtaccgtagaacgtagtcggtggtacgtagttactttaagtttacgttacgtcaagtacctaattaactttaacttactttaccgttccttaccgttacttccgtttacgtttcgggacccgtacggggaaccctagggtcctaggagtactacggaacgtaaccggaacgttggtcggtcg

SEQ ID NO: 193597 - DNA, 806 bp, Homo sapiens
  misc_feature: GYAE6OF01A78Q7.11.76.G10.1.454.CMB.1.raw
  modified_base (122)..(122): a, c, t, g, unknown or other
  misc_feature (122)..(122): n is a, c, g, or t
  modified_base (762)..(762): a, c, t, g, unknown or other
  misc_feature (762)..(762): n is a, c, g, or t
tcagcgagagataccacgaccggtgctcgatttagtcactcatacagggggaggtctgagagaggagccccgccctgggatttgcaggtatttcattgggtgctcaggactagaacaaaganaactcacatggaactgggctgagcgtgtctttctaggtggacttaagttttaaaggtgtcctagtctaacacgagactagtggaatcggtggggctacttcgtgctgggaccgggacggtcctgaacgtctcgtacctgtcgacacgtcctagtggtacctttccttaggtacttctacgtttaccaacgtcgttccggccgttcggggccccgtactaacggtcccggtgggggaaagggggtacgttaggttacgggtagggttccgggtacccgttaccccgtaccgttagttaaccgttaccgtttaacggttaaattttaccgttacgtagtttaacgtttaaacgtttgtaacgtccggtaaccggttccgttaccgggtaagggtacgggttacgtttacgttaaccgtgggttaccgaccgtacgtaactaaccggaacgtaaccgtaacgtaacccttacctttaaccgttacctaccgtaacctaagttaacccgaacgtacgaacgtacgaacggtaactacggtaacccaacgttaacgttcgttttacggagttccgaacgggttacgggtttggttacgggttccgggtttagacggtttccgtacggtacgttgtaccgttcggnggttaccggtaaccggtcggtaccccgtgtccccgtaccgtccc

SEQ ID NO: 193598 - DNA, 739 bp, Homo sapiens
  misc_feature: GYAE6OF01A523Z.11.76.G10.1.454.CMB.1.raw
  modified_base (143)..(143): a, c, t, g, unknown or other
  misc_feature (143)..(143): n is a, c, g, or t
tcagcgagagataccacgaccggtgctcgatttagtcactcatacaggggacaacagggcaggcaggggcagcaagatggtgttgcagacccaggtcttctatttctctgttgctcgtggtactctgtggtcgcctggcgganacagttcgtagtatcgaccctagttcctcctagtactttcccgtggtcgttgttcgttccgtacggtcgggacgacggaccgtaccacctatactacgtgacctaacgtcacgtataagttactttacttactacttacttaccaagttaagagtagtttacttttggttagttaaccgaacctaagaggaaccgccgtaccgaccgtaaccggtacctaccgaagaccgtatacccgttagttatttacgggtatacttaccgttaccgttaccgggtaccgggtttacccggttccccgggttaccgtacgtaccgtcgggttccggacggtgtacggtgtaaccggttgggtaacgtaactttacgtacgccttaacgactaacctactactagtaccgtacgtcgtaacgtagtacgtaagtagtagtaggtcgtagttacttgtttatcgttactaacgtactagttaacttatttacctttacttaccgttacttaccgttacgttaccgtttcgtaaccggtaccggtacggtaacgcggttacgtaacggtactacggtacgtaggtacgtacggttcgtcgtaccgg

SEQ ID NO: 193599 - DNA, 760 bp, Homo sapiens
  misc_feature: GYAE6OF01A2KU6.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctcgtggtgcctggcggagacatcgtgatcgacccagtcctccagtacttcccgtggcctggtcgtctcggtggggacgacggaccggcccaacctatccaaactggaccaacgtccgacgtacaagttaatttcgttttagaacttacttaccaacgtaagagtagttagttttaggttacggtttacggtaaccaaacgtaacggtaacgcccgtacggacccgacgtaccccgtaaccgaaacgccaacggtctacgttagtttacggtcggtactagttaccgtaccggtccgggtacggttccccgggtaccctacggtaccgtacgttccggtcggtacgtaggtcggaacgttccgggtacggtaacttaaacgttcctacgtacctactacctatacctaagtacgaccgtcgacgtacggacgtacggaagtgttcgggtacgtacgttacgttaccttttagttagtttcgtaaccgtaagtacttaaacgttaacttttaaccgtttaccttacctttaacccggtttccgtaacttttaccgggttacgtttaccgggaccggtaccgggttaccgtagggtccgtaaggacgttacgtacggaacgtaacgtcggtcggtacgtaccg

SEQ ID NO: 193600 - DNA, 928 bp, Homo sapiens
  misc_feature: GYAE6OF01BNC3V.11.76.G10.1.454.CMB.1.raw
  modified_base (825)..(825): a, c, t, g, unknown or other
  misc_feature (825)..(825): n is a, c, g, or t
  modified_base (886)..(886): a, c, t, g, unknown or other
  misc_feature (886)..(886): n is a, c, g, or t
  modified_base (919)..(919): a, c, t, g, unknown or other
  misc_feature (919)..(919): n is a, c, g, or t
tcagcgagagataccacgaccggtgctcgatttagtcactcatacaggggaggtctgagagaggacgccccgcccgtgggatttgcgaggtattttcagttgggtgctcagtcgagaacgaaacgaagaacgtacctaccaaccgtaggtaacggtacgggtccggtcgtacggtcgtcggttcgtttttcgttttcggttaggttacgttaacgtttttaaaaaggtttaaacgggttcctaaccggttacttaaccgtaaaccgaacggtaactaaccttaggtaacgtaaccgttcggggggtccggggtacctttaccgttcggtccgtcgggtcccgggggtacggggttacccgtccggtaacggtaccgttcccttccgttcggtcggaccgtaccggtaccgttccggttacgggttaaccttttacccccgttttcggttaacgtttccctttaaccgttttaccttaccgaacggtttcggtccccgggttccggggttaccccggacccgtaaccggtaccgggttcccgggtaaacgggggggtaacgggttaagttacggggtacgggttaacggggttcccggtaacccgtacccgttaacggttagttaaacggttaaccggtttaactttaacgtttaacgtaacgtaacgttaaacgtttagttacggtacgtccggtaacgtcggtacggaagggtacgtactttacgcggtcgtacgactagagtaacgactaactaactacttacttccgtcactataccgaagacgacaacgtacgaacgacgtacccgtaactaatacgtttntcggagtacggtaggttcgggtttcgtagggcgtacttcggtccgttccgtagtacgtcgnggttaccgggaccgttacgggaccttcggtacnccgttcccg

SEQ ID NO: 193601 - DNA, 519 bp, Homo sapiens
  misc_feature: GYAE6OF02FT31W.11.76.G10.1.454.CMB.1.raw
  modified_base (232)..(232): a, c, t, g, unknown or other
  misc_feature (232)..(232): n is a, c, g, or t
  modified_base (279)..(279): a, c, t, g, unknown or other
  misc_feature (279)..(279): n is a, c, g, or t
  modified_base (450)..(450): a, c, t, g, unknown or other
  misc_feature (450)..(450): n is a, c, g, or t
tcagcgagagataccacgaccggtgctcgatttagtcactcatacaggggacaacaggcaggcaggggcagcaagatggtgttgcagacccaggtcttcatttctctgtttgctctggatctctggtgcctgtggggacagtccctgatgacccagtccccagatatcctggccctgtgtctctgggccgagagggccaccatcgagtgcaagtccagcgagactcttttanatagtgtcaacgataaggactatttagcttggtatcagcaaaaaccnggacagcctcctaaactgcctcatctcctgggcatctaacccgggcacccggatccctgaccgattcagtggcagcgggtctggggacagtacttcactctcaccatccagcaacctgcaggtctgaagatgtggctagtttatactgtcagccagttatgtgaagctccntctacgtttcgggccggtagggacccgcgggtcggagtacgtccacggaccggaattcggtggctacgg

SEQ ID NO: 193602 - DNA, 501 bp, Homo sapiens
  misc_feature: GYAE6OF02IPH5B.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccgggtcctgaccgattccgtggcagtggatcgtggacaaattcactctcaccatacaatagcctgcagctagaagatgtggcagcttattattgtcagctaatattatactttctcttaccgatctacttttggccgtaggggtaccagggtctggagactcgaagacgaacttggtggtcg

SEQ ID NO: 193603 - DNA, 495 bp, Homo sapiens
  misc_feature: GYAE6OF02I3S4V.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatcgtgggacaaagtttcactctcaccatcaatacgcctgcaggctagaagatgtggcagcttattatgtcagcaatattatacttctcttcgatctactttgccgtagggaccaggtctggagactacgagacgactggtgtcg

SEQ ID NO: 193604 - DNA, 512 bp, Homo sapiens
  misc_feature: GYAE6OF02G6KYH.11.76.G10.1.454.CMB.1.raw
  modified_base (398)..(398): a, c, t, g, unknown or other
  misc_feature (398)..(398): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaactagaagccaggccagcctccaaagcagctcatttatgggcatctactcgggattccggggtccctgaccgattccgtggcagtggatctgggacaaatttcactctcaccatcaatagcctgcaggctgaagntgtggcagcttattagttgtcagctaatattattacttctcttccgattcctacttttggaccctaggggtaccctagggtctggagtatcgaagacgtaactggtaggtaccg

SEQ ID NO: 193605 - DNA, 489 bp, Homo sapiens
  misc_feature: GYAE6OF02G0WD9.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctccaaagcagctcatttatgggcatctactcgggattccggggtccctgaccgattccgtggcagtggatctgggacaaatttcactctcaccatcaatagcctgcaggctgaagatgtggcagcttattattgtcagcaatattatacttctcttccgatctacttttggcctaggggacctaggctggagatcgagacgactgg

SEQ ID NO: 193606 - DNA, 496 bp, Homo sapiens
  misc_feature: GYAE6OF02F7DSX.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtgcagctttattattgtcagcaattattattacttctcttccgattctacttttggcctaggggaccaggctaggagactcagacgaactgtgtcg

SEQ ID NO: 193607 - DNA, 657 bp, Homo sapiens
  misc_feature: GYAE6OF02HV6KD.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcagtaatctttagactattccactaagagagattttgttagtttggtaaccaacagaagccaggccagccctaccaaagcagctctatttatgggcatctacgtcgggacgttcccggggtcccctggacccgtagttccggtaggcaaggtgggaacttcgtaggggtaactaaaacgtttccaccttcctaccacctaattaccaaagttacgccttagaccgtaggccgttagaaaggtcgtaggtcgacgtagtaccgttttaatttaacgtttggtacctaaggtaacctaaatttaatttaacttaacctttcttacctttacccgttattacccgtttacgttttaccgggacccggtaacggggggtaacccctaacggggtcttacggggaacgtacgttaccgtaacgggtaccggtaacgttcggg

SEQ ID NO: 193608 - DNA, 499 bp, Homo sapiens
  misc_feature: GYAE6OF02JBTN1.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaactagaagccaggccagcctcaaagcagctcattatggcatctactcgggattccgggtcctgaccgattccgtggcagtgatctaggactaaattcactctcacatacaatagcctgcaggactgaagtatgtgcagctttatattgcagcaattattatacttctcttaccgatctactttgaccgtaacggggtaccagggtctggagtactcgagtaacgacgtgtggtacg

SEQ ID NO: 193609 - DNA, 496 bp, Homo sapiens
  misc_feature: GYAE6OF02HZ0AA.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagattttgttagtttggtaccaacagaagccaggccagcctccaaagcagctcatttattgggcatctactcgggattccgggtccctgaccgattccgtgcagtgatcgtggacaatttcactctcacatcatagctgcaggctgaagatgtgcagcttattatgtcagacaatattatacttctcttccgattctacgttttggcctaggggtaccaggtcgtaggtagactcgaagtacgtaacgtcgg

SEQ ID NO: 193610 - DNA, 510 bp, Homo sapiens
  misc_feature: GYAE6OF02G2SYM.11.76.G10.1.454.CMB.1.raw
  modified_base (381)..(381): a, c, t, g, unknown or other
  misc_feature (381)..(381): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccggggtccctgaccgattccgtggcagtggatctgggacaaattcactctcaccatcaatancctgcaggctagaagatgtggcagcttattattgtcagtctaatattatacttcttcttccgattctacttttggacccgtaggggtaccagggtcctaggagtagtcgaggacgaacgtggtgtaccg

SEQ ID NO: 193611 - DNA, 510 bp, Homo sapiens
  misc_feature: GYAE6OF02HJNZZ.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccgggtccctgaccgattccgtggcagtggatcgtgggactaaatttcactctacaccatcaatagcctgcaggtctagaagatgtgcgagtcttattagttgtcagtataattattattacttactcttaccgtattctacgttttggccgtacggggtaccaggctggagatcgagtacgtatcgg

SEQ ID NO: 193612 - DNA, 511 bp, Homo sapiens
  misc_feature: GYAE6OF02HCTKM.11.76.G10.1.454.CMB.1.raw
  modified_base (226)..(226): a, c, t, g, unknown or other
  misc_feature (226)..(226): n is a, c, g, or t
  modified_base (439)..(439): a, c, t, g, unknown or other
  misc_feature (439)..(439): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggctagacggccaccatcaactgcaagtccagcgagactcttttanatagtgtacaacgataaggactattagcttggtatcagacaaaaaccaggacagcctacctaaactgctcatctcctggcatcctacccgggcacccggatccctgaccgatcagtggcaggcggtctggacagactcactctcacatcagcaactgcagctagaagatgtgctagtttatactgtacagcagttattgtagaagtcctccgntccgtacgtttcgggcgggtacgggaccggcgggttaggagacgtacgaggaaccggtaacgtggtaggtcg

SEQ ID NO: 193613 - DNA, 511 bp, Homo sapiens
  misc_feature: GYAE6OF02I7780.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaactagaagccaggccagcctccaaagcagctcatttattggcatctactcgggattccgggtcctgaccgattccgtggcagtggatcgtgggacaaatttcactctcacatcaatagcctgcagctagaagatgtgacagtcttatattgtcagtcaatattatacttctcttccgattctacttttcggaccgtagggacctaggtcctaggacgtagttcgaacgtacggtaactggtaggtacg

SEQ ID NO: 193614 - DNA, 567 bp, Homo sapiens
  misc_feature: GYAE6OF02IU8Z6.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagactattccactaagagagatttgttagtttggtacaacagaagccaggccagcctccaaagcagctcattatgggcatctactcgggattccggggtcctgaccgattcccgtggcaggtggatcgtgggactaaattcactctcacctatacaatagcctcgacgacggcgtacgtaagtatggtggcacgtacttattatttagtctagactaattaattattacttcttaccttccgtactccttacgttttaccggtcccgtaacggggtaccctacgggtcctacgggtaaggtacttacggtaacggtaaccgtaacgttacggtggtacccgg

SEQ ID NO: 193615 - DNA, 503 bp, Homo sapiens
  misc_feature: GYAE6OF02HQ5FW.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagccctccaaagcagctcatttattgggcatctactcgggattccggggtccctgaccgattccgtggcagtggatctgggacaaatttcactctcacatcaatagcctgcagctagaagatgtggcagcttaattattgtcagctaatattattacttctcttccgtatctacttttggcccgtaggggtaccaggtccgtggagtatcagacgaactgtggtcg

SEQ ID NO: 193616 - DNA, 494 bp, Homo sapiens
  misc_feature: GYAE6OF02IZC9B.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagttggtaccaacagaagccaggccagcctcaaagcagctcattatggcatctactcgggattccgggtcctgaccgattccggtgcagtgatctgggacaatttcactctcacatacaatagcctgcaggctagaagtatgtggctagctttattattgtcagactaatattatacttctcttccattctactttggccgtagggtaccgtaggtctaggagatacgagacgtatacgg

SEQ ID NO: 193617 - DNA, 766 bp, Homo sapiens
  misc_feature: GYAE6OF02I0JDA.11.76.G10.1.454.CMB.1.raw
tcagcgagagataccacgaccggtgctcgatttagtcactcatacaggggaggtctgagagaggacgccccgccctgggatttgcaggtattttcattgggtgctcaggactgaacaaagagaactcaccatggaactcgggctgagctggtctttttcttgtggcttattttaaaaggtgtccagtctacaacgagactactggaatcgtgggggcacttcgtgctgccgggaggtccctgagactctcctgtgcagcctctggacttccccttgtacttcctacttttcacagtcggcctcgggtccgccaagcctccggaggggggagtagttggaggtgggtccgcctccatgtaattcgtaattcttatgtactaattttgtatgtcggtacgttccggtaggaacgggggtctaacgttttactcggtccgccgacacggaacgtaaacgtccgaaacctaaccgtacctttaacttccctaccctaaactactttaaaccaaccgtaccgaaccgtaacggtaccgaaacgaaccgaaccgggtaacctaaaacgtttacttttcgtacggttacggtaccgggttaaacggggttttcgggttttttaccggggtttacggggggttaccttaaggtttttccgggttaccccggtttccccgttttacggtaaccggtttcgggtccgggtttacggggggacccgtaaccgggggtaacccccgtttcggggttacccgtaaccccggtttccccg

SEQ ID NO: 193618 - DNA, 515 bp, Homo sapiens
  misc_feature: GYAE6OF02ITSY4.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccggggtccctgaccgattccgtgcagtggatctgggacaaatttcactctcaccatcaatgcctgcaggctgaagatgtggcagcttattattgtcagtcaattattatacttctctttccgattctacttttggccctagggggtaccctagggtcctgggaagtactcgaaggaccgtaaacttggtggtaccg

SEQ ID NO: 193619 - DNA, 494 bp, Homo sapiens
  misc_feature: GYAE6OF02F3RNB.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctccaaagcagctcatttatgggcatctactcgggattccggggtccctgaccgattccgtggcagtggatctgggacaaattcactctcaccatcaatagcctgcaggctgaagatgtggcagcttattattgtcagtcaatattatacttctcttccgatctacttttggcctaggggacctaggctggagatcgagacgaacgtgtggtacg

SEQ ID NO: 193620 - DNA, 492 bp, Homo sapiens
  misc_feature: GYAE6OF02GH5DU.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatctacttttggccgtaggggaccaggctggagatcagacgaactgtggtc

SEQ ID NO: 193621 - DNA, 521 bp, Homo sapiens
  misc_feature: GYAE6OF02G1R9M.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtattccctggctgtgtctcgtgggcgagacggccaccatcgaactgcaagtccagtcagaatcttttagactattccactaagagagtatttgttagtttggtaccaacagaagccaggccagccctaccgaaagcagctcatttagtgggcatctactcggattccgggccctgaccgattccgtggacagtgatcgtggactaattcactctacaccatcaatagcctgcaggctagaagattgtgcagtacttattattgtcagactaattattataccttctcttaccgtatccttacttttggaccgtaagggtaccaggtctaggagtatcgaaggaccgaacgttggtggtccg

SEQ ID NO: 193622 - DNA, 522 bp, Homo sapiens
  misc_feature: GYAE6OF02GFCMH.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcttgatgacccagtctccagattccctggctgtgtctctggcgagacggccaccatcaactgcaagtccagtcagaatcttttagactattccactaagagagatttgttagtttgtaccaacagaagccaggccagcctcaaagcagctcatttatggcatctactcgggattccggggtcctggaccgattccgtggcagtggatctgggacaaatttcactctcactatacaatacgcctgcagctgaagtatgtgctagctttaattattgtacagctaaattattaacttacttcctacttccgattctacttttgggaccgtaaggggtacctagggtcgttaggagacgttacgagtacgaacttggtcgtaccg

SEQ ID NO: 193623 - DNA, 495 bp, Homo sapiens
  misc_feature: GYAE6OF02HBR0L.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattcggggtccctgaccgattccgtggcagtggatctgggacaaatttcactctcacatcaatagcctgcaggctgaagatgtgcagcttattattgtcagcaatattatacttctcttccgattctacttttggaccgtaggggtacccaggctggagactcagacgaactggtgtcg

SEQ ID NO: 193624 - DNA, 525 bp, Homo sapiens
  misc_feature: GYAE6OF02G8VXG.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggcccagcctccaaagcagctcatttattgggcatctactcgggatccgggtccctgaccgattccgtggcagtgatctgggactaaatttcactctcaccatcaatagcctgcaggctgaagatgtggcagcttattattgtcagtctaaattactttataaccttcttcctttaccgattcctacgtttttcggcccgtaaggggtacccagggtcctagggacgtagtccaacgacgtaactcggg

SEQ ID NO: 193625 - DNA, 496 bp, Homo sapiens
  misc_feature: GYAE6OF02GGVT3.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccgggtccctgaccgattccgtggcagtgatctgggacaaatttcactctcaccatcaatagcctgcaggctgaagatgtggcagtcttattattgtcagcaatattatacttctcttcatctacgttttcggccgtagggacctaggtcgtggtagatcaagtacgacgtcgg

SEQ ID NO: 193626 - DNA, 584 bp, Homo sapiens
  misc_feature: GYAE6OF02IKRZT.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccgactaagagagtatttgttagtttggtaccaactagaagcaggccagcctacaaagcagctcatttattggcatctacgtcggtacgttccggggtcctgacccgattccgtgctagtggactcgtagggactaaacgtttcaactccgtacacctatactaaatacgcccttagacgaggtctaggaacgagttggtcggacaggtcctttaattatttagtaccgtaagacctaaagttaatttaactaactttctaccttaccgtattactaacgttttcggacccgtacgggaacccgtagggtccttgggagtaacgtaccgaagtacggtaactcggttgaccg

SEQ ID NO: 193627 - DNA, 495 bp, Homo sapiens
  misc_feature: GYAE6OF02FMJ4M.11.76.G10.1.454.CMB.1.raw
tcagcgagagataccacgaccggtgctcgatttagtcactcatacaggggacaaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattcgggggtccctgaccgattccgtggcagtggatctgggacaaatttcactctcaccatcaatagcctgcaggctgaagatgtggcagcttattattgtcagcaaatattatacttctcttccgatctactttggcctagggtaccagggctggagatcgagacgaactgtgtccg

SEQ ID NO: 193628 - DNA, 547 bp, Homo sapiens
  misc_feature: GYAE6OF02G5WRP.11.76.G10.1.454.CMB.1.raw
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatctggggcacttcgtgctgccgggagggtccctgagactctcctgtgcagcctctggacttccccttgattcacttttcacatggcctgggtccgccaagctccgaggggggagagttgggagtgggtcgcctccatgaattcgaattcttatgactaatttgtatgcggtactcgtgaaggggctatttactgtcgccgcagacaagtacgaacaacactacttcctccacactacacacgacagtcgagacacgacaatattntgtgngtaggtgtttgttgggtgtagttgtcgtccttgtctgcgtttttttcgggcgacggaccgtcggtcgcgtccg

SEQ ID NO: 193629 - DNA, 490 bp, Homo sapiens
  misc_feature: GYAE6OF02GGKA1.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccggggtccctgaccgattccgtggcagtggatctgggacaaatttcactctcaccatcaatagcctgcaggctgaagatgtggcagcttattattgtcagcaatattatacttctcttccgatctacttttggcctagggaccaggctggagatcagacgaactgtggtcg

SEQ ID NO: 193630 - DNA, 564 bp, Homo sapiens
  misc_feature: GYAE6OF02GFVWE.11.76.G10.1.454.CMB.1.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttctgtggctattttaaaaggtgtccagtctacaacgagactactggaatctgggggcacttcgtgctgccgggagggtccctgagactctcctgtgcagcctctggactttcccctgattcactttcacatggcctgggtccnccaagctccgaggggganagttggagtgggtcgcctccatgaattcgaattcttatgactaatttgtatgcgactccgtgaaggggctatttacngtcgccgcagacaagtcgaacaacaccttatcctccacacttaccaacgcgacagtacgaagacaccggacaaatatttcngtgacgtaagggttcggttttggtggggtactaagttggtccgtccctttggacttgcgtcgggccgacgggtacctcggtccaccgtcc

SEQ ID NO: 193631 - DNA, 537 bp, Homo sapiens
  misc_feature: GYAE6OF02HG7P1.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgacaagtccagtcagaattcttttagacttattccactaagagagtatttgttagtttggtaccaacagaagccaggccagcctccaaagcagctcatttatgggcatctactcgggattccgggtccctgaccgattccgtgcagtggatcgtgggactaatttcactctcaccatcaatacgcctgcaggctagaagatgtggcagtctttattattgtacagtactaattatttaacttactttcttacttcccgattccttacgttttcggacccgtacggggtacctaggtcgtagggtagtacgtacgaagtaccgtaacgttcgg

SEQ ID NO: 193632 - DNA, 506 bp, Homo sapiens
  misc_feature: GYAE6OF02FUJ4W.11.76.G10.1.454.CMB.1.raw
  modified_base (342)..(342): a, c, t, g, unknown or other
  misc_feature (342)..(342): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagccctccaaagcagctcatttatggcatctactcgggattccggggtccctgaccgatttccgnggcagtggatcgtgggacaaatttcactctcaccatcaatagcctgcaggctgaagatgtggcagctttattattgtcagctaattattatacttctcttccgtatctactttggccgtaaggggacctagggctggagtactacgacgacgaactggtggtcg

SEQ ID NO: 193633 - DNA, 493 bp, Homo sapiens
  misc_feature: GYAE6OF02FRL8O.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaaagcagctcatttattgggcatctactcgggattccgggtccctgaccgattccgtggcagtggatctgggacaaatttcactctcaccatcaatagcctgcaggctgaagatgtggcagcttattattgtcagcaattattatacttctcttccgatctacttttggcctacggggaccaggctggagtatcagacgaatcgg

SEQ ID NO: 193634 - DNA, 529 bp, Homo sapiens
  misc_feature: GYAE6OF02HAJ2I.11.76.G10.1.454.CMB.1.raw
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaactagaagccaggccagcctaccaaagcagctcatttatgggcatctacgtcgggattccgggtccctgaccgtattccgtggcagtgatctagggactaaatttcactctaccactatacaatacgcctgcgaggctagaagctggngcagtcttattagtgtnagtctaattnttaatacttctaccttcgtatccttagtttcggaccgtacggggacctagggtacgtacggtacgtacgtacaaggtacgtaactcggg

SEQ ID NO: 193635 - DNA, 732 bp, Homo sapiens
  misc_feature: GYAE6OF02JYQQ9.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttccctggctgtgtctcgtgggcgaggaccggccaccatccaactgcaacgtccagtacaagtaattctttaagacttataccactaagagtagtatttgttagtttacgtacaacagaacgcacggccagcccacgaaagcagctctatttagtggctactctacgtcggggtacttcccggggtcctaggtacccgtacgtttccggtcggtacgtacggttacggacgttcggtacggggtaaaccttaaacgtttccgaacctttaccgtaccgtaaccctaacgttacgtaaacgtaccggtccttacggaccgtacgggtacgttaacggaaacggtagttacgggtacggaccgttaacgtttaccgttttaagttaacggtttcgtaacgttaacggtaaacttaaacgtttaagtttaaccttacccgttttactttaccgtttaacccgtaatttacccgtttaccggttttccgggacccgtaacgggggtaaccctaggggtccgttaacgggtaacgtacgtacggtaaccgaacggtaccgttaggtcgtaccg

SEQ ID NO: 193636 - DNA, 534 bp, Homo sapiens
  misc_feature: GYAE6OF02HHSIN.11.76.G10.1.454.CMB.1.raw
  modified_base (266)..(266): a, c, t, g, unknown or other
  misc_feature (266)..(266): n is a, c, g, or t
  modified_base (404)..(404): a, c, t, g, unknown or other
  misc_feature (404)..(404): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagactatccactaagagagatttgttagtttggtaccaacngaagccaggccagccctccaaagcagctcatttatgggcatctactcgggattccggggtccctgacccgattccgtggcagtggatctgggactaaatttcactctcaccatcaatagcctgcaggctgaagattgnggcagctttattattgtctagctaatattaattacttctcttaccgtattcctactttttagggcccgtaagggggtacccaaggggtccttagggaagtacgtcgagtaccggaacttggtcggtaccg

SEQ ID NO: 193637 - DNA, 505 bp, Homo sapiens
  misc_feature: GYAE6OF02G4FAS.11.76.G10.1.454.CMB.1.raw
  modified_base (316)..(316): a, c, t, g, unknown or other
  misc_feature (316)..(316): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctccaaagcagctcatttatggcatctactcggnttccgggtccctgaccgattccgtggcaggtggatcgtgggactaaatttcactctcaccatacaatacgcctgcaggccttagaagatgtggctagtcttattattgtcaagctaaattattatacttctcttacctatctacgtttggcctagggggacctaggctgggatatcgagacgaactcgg

SEQ ID NO: 193638 - DNA, 490 bp, Homo sapiens
  misc_feature: GYAE6OF02GGPY4.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtgcagcttattattgtcagcaatattatacttctcttcgattcacttttggcctagggacctaggctggagatcgagacgaatgtgtccg

SEQ ID NO: 193639 - DNA, 491 bp, Homo sapiens
  misc_feature: GYAE6OF02FGYAA.11.76.G10.1.454.CMB.1.raw
  modified_base (438)..(438): a, c, t, g, unknown or other
  misc_feature (438)..(438): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcaggatcttttagactattccactaagagagatttgttagtttggttaccaacagaagccaggccagcctccaaagcagctcatttattgggcatctactcggggattccggggtccctgaccgattccgtggcagtggatctggggacaaatttcactctcaccatcaatagcctgcaggctgaagatgtggcagtcttattattgtcagcaatattatacttntcttcgatctactttgctaggggaccaggctggagatcagacgactgtggtcg

SEQ ID NO: 193640 - DNA, 641 bp, Homo sapiens
  misc_feature: GYAE6OF02GZS9V.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgaggaccggccaccatcaactgcaagtccagtcagaatctttagactatccactaagagatatttgttagttggtaaccaatagaacgccagaccacgcctaccaaagcagctactatttagtggcatctacgtcgggtacgttccgggtcctcgaccgtacgtttccggtggaccgtaggtcggtacgttcgtacggggaactaaacgtttcaccgttctaccaccctaactactaagtacgtcctagacgacggtactaggaaacgtagttacggtcggacgtagttactttaagtttagttcgttaacagtaactaaattaagtttaacttactttcttacctttaccgactttacctaccgtttttacggacccggttaacgggacccgtacggtaccggttaggtacggtaacgtaccgtaaggtaaccgtacgttacgggttcggtaccgg

SEQ ID NO: 193641 - DNA, 691 bp, Homo sapiens
  misc_feature: GYAE6OF02I7YID.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagtaatctttagacttattccactaagagagtattttaggttagttacggtaacctaactaagaacgacccgaaggcccaaggtccctaaccgaaaagcaaggtctacctaattttagtcgggactattccgtacgtcgggtacttcccggggtcctaggtaccgtatttccgtggccgtaagttccgggtaattcccggtaggggtaaaccttaaacgttttccgaaccgttactaccgtaaaccctagttaccctaaagttaccgccgtttacgaccgtaaggtacccgttaggtaaacgtacggttcggtaacgggtacctaggtacttttacgtacgtttacgtccgtaagtaacctaatttaacgtttctaaactttcgtcctttacggactttacgtacgttttcggacccggttacgggtaaccctaggtcgttacggagtaccttagaaccggtagtaaccgtgg

SEQ ID NO: 193642 - DNA, 525 bp, Homo sapiens
  misc_feature: GYAE6OF02HXZVE.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctggcgagacggccaccatcaactgcaagtccagtcagaatcttttagactattccataagagagatttgttagtttggtacaacagaagcaggcagcctcaaagcagctcattattgggctatctactcggacttccgggtccctgaccgattccgtggcagtggatcgtggacaatttcactctcacatacaatagcctgcaggctagaagtagtgtacggcagtcttaattagtttgtcagactaaattattattaacttccttcttaccgtattcttacgtttggacccgtaagggtacccgtaggtctaggaagtatcgaaggtaccgaacgttgtcggtacg

SEQ ID NO: 193643 - DNA, 772 bp, Homo sapiens
  misc_feature: GYAE6OF02J13G6.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatccaactgcaagtccagtcagatctttagactattccaactaagagagtatttagttagtttcggtaacctaacgtagaaggtaccaagggtacccaggtaccctaccgaaaacgaccgaacgcctactaattttacgttcggggtactaagttccgttaacgtaccgggggtaacgtttccccggggtacccgtacggtaaccccggtaacgtttcccgggttacgggtccgtaacgggtacgggtacgttccggttacgggggtaaaccttaaaacggttttccgaaccgtttccctaccgtaaacccgtacttacccgtaaaagttaccggtaccccttaggaccctaagggtacccttagggtaaacgacgtttacggtacgggactaacggtccttttaagtttacgtttaggtaccgtaaggtacctaaagttactttaacttacttaccgttcttaccgtattaccttacgttttaccggtaccgtaaccgggggtacctagggttccgttagggtaacgtacctttacggaacggttaacccgtaacggttcggttacggtacccg

SEQ ID NO: 193644 - DNA, 496 bp, Homo sapiens
  misc_feature: GYAE6OF02JAVZ5.11.76.G10.1.454.CMB.1.raw
  modified_base (394)..(394): a, c, t, g, unknown or other
  misc_feature (394)..(394): n is a, c, g, or t
  modified_base (475)..(475): a, c, t, g, unknown or other
  misc_feature (475)..(475): n is a, c, g, or t
  modified_base (493)..(493): a, c, t, g, unknown or other
  misc_feature (493)..(493): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctaccaaagcagctcatttattgggcatctactcgggattccggggtccctgaccgtattccgtggcaggtgatcgtgggactaaattcactctcacatcatagcctgcaggcngaagatgtaggaagtcttattattgtcagacaatattatacttctcttccgattctactttgaccgtagggcaggctgganatacgagacgaagtgtgntcg

SEQ ID NO: 193645 - DNA, 591 bp, Homo sapiens
  misc_feature: GYAE6OF02FZ6U4.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatctgggggcacttcgtgctgccgggagggtccctgagactctcctgtgcagcctcgtggtacttccccttgattcctactttcacatggcctgggtccaccaagctccggagggggatagttggaggtgggtcgcctcgatgaattcgtaattcttatgactatttgtatgcggtactccggtaggaacggggtctatttactgtccgccgcagacaagtacgaaacaactaccttactcctaccactacttaaccacgcgaacagtacgaagaccgacgacctaatacttctagtcgacgtagggttggttttacgggttggggtactagttcgttccgtcctttggccttgcgtgggccgagggtacccgtcggtccaccgttcc

SEQ ID NO: 193646 - DNA, 551 bp, Homo sapiens
  misc_feature: GYAE6OF02IG5PE.11.76.G10.1.454.CMB.1.raw
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagaattctttagactattccataagagagtattttgttagtttggtaaccaanagaagccaggccagcctaccaaagcagctctatttatggctatctacgtcgggacttccgggtaccctgaccgtagttccgtggcaggtgatcgtggaactaatttcactctacaccatcaatcgctagcagctagaangtgtgctagtactttattattcgtacagtactaaattagtttaactactttaccgttcttaccgatttaccgttacgttttgggacccggtaaggggacctaggtacgtaggaagttactacggaacgtaccgtagtcgg

SEQ ID NO: 193647 - DNA, 522 bp, Homo sapiens
  misc_feature: GYAE6OF02HAMH0.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgccttcggagacatcgtgatgacccagtctccagattccctggctgtgtctctgggcgagacggccaccatcaactgcaagtccagtcagaatcttttagactattccactaagagagtattgttagtttggtaccaacagaagccaggccagcctccaaagcagctcatttatgggctatctactcgggattccggggtcctgaccgattccgtggcagtgatcgtgggactaattcacgtctcacatcaatgcctgcaggctgaagtatgtcgcagtcttattatgtacagactaatattactacttctacttcgattcttacgttttcggaccgtaacggggacctacggtcgtaggacgtacgtccgaaggtaacgtacgtaggtacgg

SEQ ID NO: 193648 - DNA, 499 bp, Homo sapiens
  misc_feature: GYAE6OF02F9ZJB.11.76.G10.1.454.CMB.1.raw
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagccctcaaagcagctcatttatgggcatctactcgggattccggggtccctgaccgtattccgtggcagtggatcgtgggactaaatttcactctcaccatcaatagcctgcaggctagaagatgtggcagcttattattgtacagctaatattattacttctcttcgatctactttggccgtagggaccaggtctagganagtcagacgaacgtgngtcg

SEQ ID NO: 193649 - DNA, 567 bp, Homo sapiens
  misc_feature: GYAE6OF02G4NMV.11.76.G10.1.454.CMB.1.raw
  modified_base (265)..(265): a, c, t, g, unknown or other
  misc_feature (265)..(265): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagcagatctttagactattccactaagagagatttgttagtttggtaccaanagaagccaggccagcctcaaagcagctcatttagtgggctatctacgtcgggtactttcccggggtccctgaccgtacgttccgtgggccaggtggattcgtcgggaactaaacttttcacttctaccactatacaatacgcctgcaggctagaagtntggngtcagtcttattagttagtcagtactaagttattaacttcttaccttcttaccgtattcctaaccgtttttcggtaccgtacggggtacctacgggtacgtacgggtagtaccttacgaacggtaccggtaacgttacgg

SEQ ID NO: 193650 - DNA, 505 bp, Homo sapiens
  misc_feature: GYAE6OF02H53WC.11.76.G10.1.454.CMB.1.raw
  modified_base (340)..(340): a, c, t, g, unknown or other
  misc_feature (340)..(340): n is a, c, g, or t
  modified_base (392)..(392): a, c, t, g, unknown or other
  misc_feature (392)..(392): n is a, c, g, or t
tcagcgagagataccacgaccggtgctcgatttagtcactcatacagggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagaatctttagactatccaataagagagatttgttagtttggtaccaacagaagccaggccagccctaccaaagcagctcattattggcatctactcggattccgggtcctgaccgattccgngcagtgatcgtggacaattcactctacacatcaatgcctgcaggctagaagntgtggcagtcttattagttgtcagtcaattattactacttctcttacgtatctactttggaccgtagggacctaggcgtggaagtacgtacgagacgtaacgttggtaggtcc

SEQ ID NO: 193651 - DNA, 669 bp, Homo sapiens
  misc_feature: GYAE6OF02IZAG8.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagacggccacatcaactgacaagtccagtcagtaattctttagactattccataagagagtatttgttagttcgtaccgtaaccaagaagacgacggacgacgacctacctaaacgacacgacgtacctatttaagtttggacgtactacttaccgtacgggtacggttacccgggttccccggtaccgtaccggtacgtttaccgtccgggtacgtacggttagggtacgttaccggttacgggtaacgtaaacctttaacgttaccgttaccttaccgaaaccctaacgtactaaacgtaagtacccgtgtaccgaggtacgtagaaagacgttgtgggcaacgttacgttattttaagtgtcctaagactaataatttactacttcctacttacgtagttaccttactttaccgggtacggaccgggtacgaacgtcggtaggagtaacgtcgtaaggaaccgtaacgttggtacggcg

SEQ ID NO: 193652 - DNA, 522 bp, Homo sapiens
  misc_feature: GYAE6OF02HJHL7.11.76.G10.1.454.CMB.1.raw
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagacggccaccatcaactgcaagtccagtcagaattcttttagactattccactaagagagtatttgttagtttaggaaccaacagaagccagaccagccctacaaagcagctacatttagtggactatctacgttcggggattccggggtccctgaccgtattccggngcagtgatcgtaggactaattcactctcacntcaatgctgcagctagaatntgtgctntctttatatgtacagctaatattattcttactnttaccgatcttacgtttggacccgtagggacctagggtctagggatacgttcaagtaccggacgttcggtagtcg

SEQ ID NO: 193653 - DNA, 822 bp, Homo sapiens
  misc_feature: GYAE6OF02JZ8XJ.11.76.G10.1.454.CMB.1.raw
  modified_base (173)..(173): a, c, t, g, unknown or other
  misc_feature (173)..(173): n is a, c, g, or t
tcagcgagagataccacgaccggtgctcgatttagtcactcatacagggagctacaacaggcaggcagggcagcaagatggtgttgcagaccaggtcttcatttctctgtgctactggatctctggtgacctgcggagtacatcgtgatgacccagtctccgagtacttcccnggcttggtcgtcctacgtggggcctaggaccggtcccaaccgattccaaactcgactaaacggtccaaggttccaaggaactttccgtttaagaccttaattcccgaacttaaggagtagtattttgtagtttacggaaccctaagtagaaacggtccaagggtaccctaaggtcccctaccgaaaaggtcctaggtcccttagtaagttttaaccgtggggacccactttacggtaccggttcggggaaccgtttcccggggttaccctaggtaacccggtcgttttcccgggtagggacctaagggtccggtaacttacccgggtttaggggaaacttaaacgttttccaaccggtttcctaaccgtaacctaacgttacgtaaacttacgggtaccctaggtaccgtacggtaccgttaaggaaccgtacgttaggtacccggttactaacgtttacccgttttaagtttaacgttccgtaacgttaacgtaaccggttaacttaaacggttttccttaaaccgtttacccggtacttttaccccgggtatttacccggttaaccgttttcggggaaacccgtccgggttaaaccgcggttacgtacgggtaacgtcgtaccgaacggttaccggtacttaccggg

SEQ ID NO: 193654 - DNA, 549 bp, Homo sapiens
  misc_feature: GYAE6OF02FRWY1.11.76.G10.1.454.CMB.1.raw
  modified_base (334)..(334): a, c, t, g, unknown or other
  misc_feature (334)..(334): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccacatcaactgcaagtccagtcagaatctttagactattccactaagagagattgttagtttggtaccaacagaagccaggccagcctccaaagcagctcatttattgggcatctactcgggattccgggtcctgaccgnttccgtggctgtggatctgggactaaagtttctactcgtcacccgatacaatagcctgcaggctagaagatgtaggtcagtcttattagttgttcagctaagttattaactactttctactttccgtattacgtacctttttcggtcccgtacgggggtaaccctacgggtaccgttagggacgtaacgttacgtacgtaacgtaacgttacggg

SEQ ID NO: 193655 - DNA, 695 bp, Homo sapiens
  misc_feature: GYAE6OF02HSVAV.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagatccctggctgtgtctgtcgggcgagacgcccacgtatacaagtgactaacgtccagtacgaagtactttacttttaacgacttacttaccaagtaagagtagttagttttagttagttacggtaaccaagaagtacgaccgtacgaccacgaccctaacgaaacgctagccttactatttacggtcggactagttaccgtacggtcgggtaccgttcccggggttaccacggtaccgtacgttccggtagtacggtagtcggtaacgtcgtaacggtaaacttaaacgttcctactccgtacgtacctactaacgtaacgtacgtccgtagacggtacgtacgagtaagtgtggttacgacgttattacgtttatagttcgtacgtaagtaacttaagttacttaacttcgttccgtaccgttactaactttcgttaccggtttacgggtacccggtaacgggtacccgagttaccggtaagtaacgtcgtaacccgtaagggttaaccggtacgtttcggggacgttacccgg

SEQ ID NO: 193656 - DNA, 487 bp, Homo sapiens
  misc_feature: GYAE6OF02I9J02.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctctgggcgagacggccaccatcaactgcaagtccagtcagatcttttagactattccactaagagagatttgttagtttggtaccaacagaagccaggccagcctccaaagcagctcatttatggcatctactcgggattccgggtcctgaccgattccgtggcagtgatctgggacaaattcactctcactatcaatacgcctgcaggctagaagatgtgctagcttatatgtcagcaatattatacttctcttcgatctacgtttgaccgtagggacctggctggagatcgagacgaacgtgtgtacg

SEQ ID NO: 193657 - DNA, 625 bp, Homo sapiens
  misc_feature: GYAE6OF02IX0AA.11.76.G10.1.454.CMB.1.raw
  modified_base (437)..(437): a, c, t, g, unknown or other
  misc_feature (437)..(437): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctatttttaaaaggtgtccagtctacaacgagactactggaatctgggggcacttcgtgctgccgggagggtccctgagactctcctgtgcagcctctggacttccccttgattcactttcacatggcctgggtccgccaagcctccggaggggggagagttgggaggtgggtccgcctccatgaattcgaatttctatgactaatttgatgcggactcggtagaggggctatttactgtccgcgcagacatgtacgaacaacacttattcccncactattacccaacgcgactagtacgaagaccacggaccaaattactttcgtgttagcgttaaaggggttcggttttacgggttgggggtaccttaaggtttcgtacccggttcccgttttggaccgtttggtacccggttcgggggacccgtaacggggtaacccccgttgggtacccctaccccgg

SEQ ID NO: 193658 - DNA, 616 bp, Homo sapiens
  misc_feature: GYAE6OF02IPDNY.11.76.G10.1.454.CMB.1.raw
  modified_base (361)..(361): a, c, t, g, unknown or other
  misc_feature (361)..(361): n is a, c, g, or t
tcagcgagagataccacgaccggtgctcgatttagtcactcatacagggggacaacaggcaggcaggggcagcaagatgggtgttgcagacccaggtcttcatttctctgttgctctggatctctggtgcctggcggagacatcgtgatcgacccagtcctccagtacttccctggctgtgtctcgtgggcgaggaccgccaccatcaactgacaagtccagtcaagtattcttttagactacttccaataagagagtatttgttagtttcgaaccaagagaagcgaggccacgcctacaagcagctctatttagtggctatctacgtcggtacgttccgggcctggaccgtagttccggngctagtcggtactcgacggactaacttccactcctacacctatacaatcgcctagcgtaggtactagaagtagtcgtggactagtactttagttagttcgtacgtagtactaattagttaacttacctttaccttaccgttaccgtacgttaccttacgttttaccgggacccggtaacggggtacccgtacggtcggttaacgggtacgtaccgttacggaacggtaaccggttaacggttcggtacggtaccg

SEQ ID NO: 193659 - DNA, 505 bp, Homo sapiens
  misc_feature: GYAE6OF02HJ78G.11.76.G10.1.454.CMB.1.raw
  modified_base (380)..(380): a, c, t, g, unknown or other
  misc_feature (380)..(380): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaatcttttagactattccactaagagagatttgttagtttggtaccaacagaagccaggccagcctccaaagcagctcatttatgggcatctactcggattccgggtcctgaccgattccgtggcagtggatcgtgggacaaatttcactctcacatcaatanctgcagctgaagatgtggcagtcttatattgtctagctaatattatacttcttccttcgattctacttttcggaccgtacggggacctagggctggagagttacagtacggaacgtgtcggtacg

SEQ ID NO: 193660 - DNA, 581 bp, Homo sapiens
  misc_feature: GYAE6OF02GJVWB.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagtacttccctggctgtgtctcgtgggcgagaccggccaccatacaactgcaagtccagtcaagtattctttagacttattccactaagagagtatttgttagtttggtaaccaacagaagccaggccagcctaccaaagcagctctatttatgggcatctacgtcgggtacttccgggtccctggaccgtacttccggtcggcaggtggatcgtgggactaaatttcacgtctaccacctatcaatacgtcctgacagggctaggaagagttcgtggactacgcttttaacttagttcgttacagactaaattatttactaactttcttacctttccgtattaccttacgttttcggacccgtacggggtaacctacgggtcttacgggagtaacctacggaacgtacgtagtacggg

SEQ ID NO: 193661 - DNA, 553 bp, Homo sapiens
  misc_feature: GYAE6OF02G5SNK.11.76.G10.1.454.CMB.1.raw
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagtaatcttttagactattccaactaagagagatttgttagtttggtaccaacagaagccaggccagcctaccaaagcagctacatttagtggctatctacgtcgggacttccgggtcctgaccgtnttccgtgcagtgatcgtaggaactaagttcactctaccacatacaatcncctgcagctagaantgtgcatcttatagttgactagtactaagttacttaacttacctttcttaccttaccgtattaccgtttaccgtttgggacccggtaaggggaccctagggtccgttagggaagtactacggaagtacccgtaagttcggcggtaccg

SEQ ID NO: 193662 - DNA, 550 bp, Homo sapiens
  misc_feature: GYAE6OF02HKRQY.11.76.G10.1.454.CMB.1.raw
  modified_base (431)..(431): a, c, t, g, unknown or other
  misc_feature (431)..(431): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagtaattcttttagactattccaactaagagagatttgttagtttggtaccaacagaagccaggccagccctccaaagcagctcatttatgggcatctacgtcgggtattccggggtccctggacccgtattcccggtggcaggtggatcgtgggactaaatttcactctacaccatcaatacgcctgcaggtctagaagattggtaggcaggtnttattattgcagctaattattaattaccttcttccttcgtacttctacgttttggacccgtaaggggccctagggtcctagggacgtactaccgaaggaccgtaacgtggtaggtaccg

SEQ ID NO: 193663 - DNA, 570 bp, Homo sapiens
  misc_feature: GYAE6OF02GN9A5.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagtatttgttaagtttggtaccaacagaagccaggccagccctaccaaagcagctcaatttatggcatctactcgggtattcccggggtcctgaccgattccgtggctaggtggatcgtgggaactaaatttcacctctcaaccatacaatacgcctgctaggctagaagatgtcggcagtctttaattattgtcaagtactaaattattaacttacctttcttacgttaccgactttacttacgttttccggacccggtaacgggggtacctacgggtcttaggggaatacgttacgaacggaaccggtaacgttgggtcggtaccg

SEQ ID NO: 193664 - DNA, 570 bp, Homo sapiens
  misc_feature: GYAE6OF02G7QB9.11.76.G10.1.454.CMB.1.raw
  modified_base (316)..(316): a, c, t, g, unknown or other
  misc_feature (316)..(316): n is a, c, g, or t
  modified_base (416)..(416): a, c, t, g, unknown or other
  misc_feature (416)..(416): n is a, c, g, or t
  modified_base (450)..(450): a, c, t, g, unknown or other
  misc_feature (450)..(450): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaattctttagactatccaactaagagagatttgttagtttggtaacctaacaagtaagaccaggcccagccctaccaaagcagctcatttatgggcatntacgtcggagttccgggccctgaccgattccgtggccagtggatcgtagggactaaatttcacgtctcaccatctaaatagccctgacaggctacgaagngtgtggactagctttaagttattcgtacaagtanaagttaatttaacttactttcctacttccgacttacgtaccttttggacccgtacggggtaaccctagggtacctacgggaacgtagtaccgaaggaaccgtaacggttggtcggtaccg

SEQ ID NO: 193665 - DNA, 719 bp, Homo sapiens
  misc_feature: GYAE6OF02FXJGI.11.76.G10.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
tcagcgagagataccacgaccggtgctcgatttagtcactcatacaggggacaacaggcaggcaggggcagcaagatggtgttgcagaccccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttagtatcanacaaaaccagganacgcctacctaactgcctcatctccgtgggctactccgtacccgggccgacccggcgtcccctgacccgtactacaggtcggcgaggccgggtactcgggactaggtaccttccacgttcctaccgaccctatccgaacgtacctaaaccctcggacgtacgggacccttaggaacgtagttcgggttacggtacgtttaacggtttttaacctttaacgtccggttaaccgtacggtaaccgttaaggttttaagttttacgggttaacgaaaccgggtttcccgtaacccggttaccgttaccggttacccgggtttacccgggggtaccggggttaaccgggggtaccccggggttacgggggtaaccgggtaacggtaacggttacccggaacgggtaaccccgtaagggttcggttaccgggacccgttaaccggg

SEQ ID NO: 193666 - DNA, 709 bp, Homo sapiens
  misc_feature: GYAE6OF02GEMF5.11.76.G10.1.454.CMB.1.raw
  modified_base (174)..(174): a, c, t, g, unknown or other
  misc_feature (174)..(174): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagtacttcccgnggctgtcgtctcgtgggcgagaccggccaccatcaactgacagtccagtcagtattctttagacttacttccactaagagtagtatttggttagtttaggtacccaaacaggtaacgccacggccacgccctaccaaacgcagcctacatttagttgggactatcctaacgtcggggtacgtttccccggggtccctacggtaccgtacgtttcccggtgggaccgtaaggtcgggtaactcggtaggggtaaacccttaaaagttttcccacgttcctaccaacctaactactaaactacgacccgtagacgacgggacgtacgaaggtaagttcgggtacggactacggttactttaagttttagttacgtaccgtaagtaacgttaaactttaactttaactttacctttacctttacctttacccgttaacttaccttaccggtttttcgggaccccggtaacgggggtaacccgtaacgggtccggtagggtaacgtaccgttacggaacggtaaccgtaggttacgggg

SEQ ID NO: 193667 - DNA, 549 bp, Homo sapiens
  misc_feature: GYAE6OF02HGG4X.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagaattcttttagactattccactaagagagatttgttagttttggtaccaacagaagccaggccagcctccaaagcagctcatttatgggcatctactcgggtattccgggtcctgaccgtattccgtggctagtggactcgtaggggactaaactttcacctctcaccatacaatacgcctcgcgaggtctagagtagtgtcgcagtctttattagttcgtcagcaattattaattacttcgttcttaccgtacttcgtacgttttggacccgtaggggtaccaggtccgttaggacgtacgtcgaacggacgtaaccgttggtaggtccg

SEQ ID NO: 193668 - DNA, 628 bp, Homo sapiens
  misc_feature: GYAE6OF02HBTOZ.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgacaagtccagtcagtaactcttttaagactattcccaataagagagtatttgttagtttggtaccaacagaagcaggccagcctccaaagcagctcatttatgggcatctactcgggacgttccggggtccctggaccgtagtccgtggctagtggatcgtggactaattcactctacaccatacaatacgtcctgcgaggtctagaaggattaggtacggacttaagttttactacgttagtacaggtactacgtttaagtttacggtacggtaacggtcccttacccggtaccgttacgttaccgttttaccgggggacccggggttaccgggggtaacccggggttcggggttacgggtaacgaacggttaccggaacggtaaccggtaaggttcgggtacgggtccgtggtaaccccg

SEQ ID NO: 193669 - DNA, 763 bp, Homo sapiens
  misc_feature: GYAE6OF02FM64F.11.76.G10.1.454.CMB.1.raw
  modified_base (268)..(268): a, c, t, g, unknown or other
  misc_feature (268)..(268): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgacaagtccagtcagaattcttttagactattccactaagagagtatttgttagttgtaccaanagaacgccgaggccacgccctaccaaagcagctactatttagtgggctattccgtacgtcggggtacgtttccccggggtccctcggtaacccgtacgtttcccggtaggcctaagggttcgggtaacgttccggtaacggggtaaacccttaaacgttttcccgaaaccctttcctacccgtaaccctaattacccgtaaacttaccggtacccgttacggaccgtaacggggtaccttaacgggaagtacgtttgggtacggtacgtaacgttacttttaagttttagtttcggtaccgtaaggtaacctaaattttaactttaacgtttaaccgttttacctttaccgtttaaccgttactttacccgtttacggtttttaccgggacccgggttaacgggggtacccgttaacggggtccgttacggggtaacgttaccggttaccggtaaccgggttaacccgtaacgggtttcggtacgggtaacccgg

SEQ ID NO: 193670 - DNA, 724 bp, Homo sapiens
  misc_feature: GYAE6OF02F80RL.11.76.G10.1.454.CMB.1.raw
  modified_base (261)..(261): a, c, t, g, unknown or other
  misc_feature (261)..(261): n is a, c, g, or t
tcagcgagagataccacgaccggtgctcgatttagtcactcatacaggggacaacaggcaggcaggggcagcaagactggtgttgcagacccaggtcttcatttctctgttgctctggatctctggtgcctgcggtagacatcgtgatgacccagtctccagattccctggctgtgtctctggcagacggccacatcaactgcaagtccagtcagaatcttttagactattccactaagagagatttgtagttgtaccaanagtaagccaggccagtcctacaaagcagctcatttagtggcatcgtactcgggacttccggggtcctgaccgtagttcccggtggacctaggtcggacttcgtacgggtactaaaagtttccaacgttccgtacgtaacccgtaagttacccgtaaagttacggacccttaggtaccgtaacggggtaccttaagggtaaacgtaggttacgggttacggaccgttaacggttaccgttttaagtttaacggtttacggttacgaaaccggttacgtaaaacgtttaacgttttaacgttaaccgttttaccgttaccgtttaacccgtatttacccgttaaccgtttttacgggaccccgttaaaggggggtaacccttaaggggtacccgttaggggttaacccgtaacgtttaccggaaccggttaaccggttaaacggttacgggtacgggttaacccg

SEQ ID NO: 193671 - DNA, 525 bp, Homo sapiens
  misc_feature: GYAE6OF02HPUMI.11.76.G10.1.454.CMB.1.raw
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccaactaagagagtatttgttagtttggtaccaacagaagccagggccagcctaccaaagcagctcatttagtgggacatctacgtcgggacttccggggtccctgaccgtattccgtggcaggtgatcgtgggaactaattcactcncaccatcaatagcctgcaggctagaagatgtgctagtcttattattgtnagctaatattatactttctcttacctattctacgttttcggaccgtaacggggacctaggtcgtggagtacgtcgaacggacgtaacgttgtgtcg

SEQ ID NO: 193672 - DNA, 613 bp, Homo sapiens
  misc_feature: GYAE6OF02IZ9O6.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagaattctttagacttattccactaagagagtatttgttagtttggtaccaacagaagccaggccagcctaccaaagcagctctatttattgggctatctactcgggtagttcccgggtccctggtacccgtagttccgtggtcgaggtggattcgtggggaactaaatttcacttcctacacctatacaatacgtccgtagacgaggctagaagacgttggtcggacctaggtacctttaagtttatttcgtactaagtactaagttattttaacttactttccttacctttaccgtactttaccgttaccgtttttcgggacccggtaacgggggtaccctaagggtcccgttaggtaacggtacgttaccgaaggtacccgaacgttcggg

SEQ ID NO: 193673 - DNA, 602 bp, Homo sapiens
  misc_feature: GYAE6OF02F1N3B.11.76.G10.1.454.CMB.1.raw
  modified_base (256)..(256): a, c, t, g, unknown or other
  misc_feature (256)..(256): n is a, c, g, or t
  modified_base (443)..(443): a, c, t, g, unknown or other
  misc_feature (443)..(443): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagactttccctggctgtgtctctgggcgagaccggccaccatcaactgacaacgtccagtccagtaacttcttttagacttattccactaaganagtatttgttagtttgtaccaacagaagcaggccagcctaccaaagcagctcatttactgggcagttctactcgggacgtttcccgggtccctagacccgtagtttccggcggtcgacggtggactcgtgggaactaaactttcactctacactacgtcagccaacctgaccaggtcctagaaaggnttaggtcgtctagttttaactcgtagttacacgtacgtagttagttgacgtacgccttcccgtcttaccgtcggttaccgggcgggtaaccggggtacccggtcgggtagggaaccgtacgtaccggtaacggaccggttaagtcgggtaggtacccgg

SEQ ID NO: 193674 - DNA, 661 bp, Homo sapiens
  misc_feature: GYAE6OF02HRGZR.11.76.G10.1.454.CMB.1.raw
  modified_base (227)..(227): a, c, t, g, unknown or other
  misc_feature (227)..(227): n is a, c, g, or t
  modified_base (523)..(523): a, c, t, g, unknown or other
  misc_feature (523)..(523): n is a, c, g, or t
tcagcgagagataccacgaccggtgctcgatttagtcactcatacagggggacaacaggcaggcaggggcagcaagatggtgttgcagacccaggtcttcatttctctgttgctctggatctcgtggtgcctggcggagacatcgtgatcgacccagtcctccagtacttcccgtggctgtcgtctcgtgggcgagaccggccaccatacaatgacaacgtccagtnaagtaattctttagacttacttaccaataagagagtatttaggttagtttacggtaccaactaagaacgccgacggccacgccctaccgaaacgcaacgcctactatttagtcgggactagttcgtacgtcggggtacgttcccggggtacccgtacggtaccggtacgttccggtaggaccgtagggttcggaacgttccggtaacggggtaacttaaacgtttccgacttcctactaacctatacctaaagtcgacctacgacgacgggtacgtaggaagtaggtcggtacggntaacgttacgttacttagtacgtacagtactaattattactttacttccttacgttacctattaccttacgtttacggcggtaacgggtaccgtagggtcgtaggactacgtacgaaggtacgtacgtggtacgtacg

SEQ ID NO: 193675 - DNA, 540 bp, Homo sapiens
  misc_feature: GYAE6OF02HLJ1H.11.76.G10.1.454.CMB.1.raw
  modified_base (337)..(337): a, c, t, g, unknown or other
  misc_feature (337)..(337): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagaattcttttagactattccaataagagagatttgttagtttggtaccaactagaagccaggccagcctccaaagcagctcatttatgggcatctactcggattccggggtcctgaccgtnttccgtggcagtggatcgtggactaattcactctcacatcaatacgctgcaggctgaagagtgtgacagtcttattagttgtacaagtactaaattaactttacttaacctttcttccttaccgtattcctacgttttcggaccgtacggggacctacggtcgtaggagtacgtcgaacgtaccggtaacgttggtaggtccg

SEQ ID NO: 193676 - DNA, 557 bp, Homo sapiens
  misc_feature: GYAE6OF02I9058.11.76.G10.1.454.CMB.1.raw
  modified_base (456)..(456): a, c, t, g, unknown or other
  misc_feature (456)..(456): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctcgtgggcagtaccggccaccatcaactgcaagtccagtcagtaattcttttagacttattccaactaagagagtattttgttagtttacggtaaccaacaagaagccaggccagcctacgaaagcagctactatttatgggcatacgtacgtcgggacttccgggtccctggaccgacgttccgtggacgaggtggactcggtgggaactaatttcgactctacaccatacaatgtcctgacaggctagaagatgtgacagtcttatttatcgtanacgtataacttagtttacttactttcctcttaccgattaccgttaccgtttggacccggacgggtaccaggtcgtaggacgtagtcgaagtacgtagtcgg

SEQ ID NO: 193677 - DNA, 758 bp, Homo sapiens
  misc_feature: GYAE6OF02HO9Y7.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtattccctggctggtcgtctcgtgggcgaggaccggccaccagtcaactgacaagtccagtcaagtaacttcttttaagacttacttccaactaaagagtagtattttgttaaggtttacggtaaccaaacgaggaaacgccgaacggccaacggtccctaaccgaaagcacgccttactagtttagtcgggactattccgtacgtacgggttacgttcccggggtacctacggtaccgtacgttccgggtaggtaccgtaaggttggacttcggtacggggtaaacttaaacgtttccgaactttcctaccgtaacctaataccgaaacgttacgtcccgtaggccgtaaaggtaccgtaaggaaacgttaggttacggtacggtacgttacgttacttttagttaacgtttcgtaacgtaagtaacttaaagttaactttaactttacctttaccgttaccgttaaccgttaactttccgtttaaccggttttccgggaacccggtaacgggggtaacccggttaacggtccggttaacgggaacgtttaccgtacggtaaacggtaaccgggtaactttcgggtacggtaacccg

SEQ ID NO: 193678 - DNA, 586 bp, Homo sapiens
  misc_feature: GYAE6OF02JHDOT.11.76.G10.1.454.CMB.1.raw
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacccagtctccagacttccctgctgtgtctcgtgggcgaggacggccaccatcaactgacaagtccagtcagaatctttagactattccactaacgagagtatttgtagtttgtaccaacagtaagccaggcagcctcaaagcagctcatttatgggnatctactcggacgttccgggaccctgacccgattccgnggcagtggatcgngggactaatttcactcttaccacactacacgactaaccgtgaccggctaggaagtaagttgagggtactagtttaacgtacttcgtacgagacttaagtactttggtactaaacggtctacccgtcttccgacgttttccgggacgggttaccggggacccggttgggtacggggtaactacggtacgaaccgggtaccgtaaacggtcggttgggaccgttacgg

SEQ ID NO: 193679 - DNA, 597 bp, Homo sapiens
  misc_feature: GYAE6OF02G00D7.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgcaagtccagtcagattcttttagactattccataagagatatttgttagtttcggtaaccaacagaacgccgaggccagcctaccaaagcagctctatttagtggactatctacgtcggggtacgttcccggggtccctaggtacccgtagttccggtcggcgtaggtggattcgagggtaactaaatttcacttcctacacctatacaatcgcctgacgagctagaagtgtgtacggactagtactttaagttattacgtatacgtactaaagttaattttacgttacctttccttaccgttaccgtatcctttacgtttcggaccggtaacggggacctagggtccgtagggtaatacgttacggaacgtacggtaacgtgggtactccgg

SEQ ID NO: 193680 - DNA, 556 bp, Homo sapiens
  misc_feature: GYAE6OF02FFJFO.11.76.G10.1.454.CMB.1.raw
  modified_base (243)..(243): a, c, t, g, unknown or other
  misc_feature (243)..(243): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaattcttttagactattccactaaganagtatttgttagttgttaccaacagaagccaggccagacctccaaagcagctcatttattgggcatctactcggggtattccggggtccctcgtaccgattccggtggccaggtggactcgtggggaactaaaactttccactctacaccatcagcaaacctgcaggctagaagtagtgtgtctagtttactacgttgtactagctagtattgtagaacgctcgtccttactacgtttcggacgggtacgggtaccggcgggtaggtacgtacgtacggaacggaccggtaagtcggtcgggccgtgtacccg

SEQ ID NO: 193681 - DNA, 555 bp, Homo sapiens
  misc_feature: GYAE6OF02GPH3W.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctctgggcgagacggccaccatcaactgcaagtccagtcagaatcttttaagacttattaccactaagagtagtattttgttagtttggtaaccaacagaagccgaggaccagcctaccaaagcagctcatttatgggctatctactcgggtattccggggcctgaccgattccgtggcagtggatcgtaggactaaatttccacttctacacctatcaaatacgtccctagccaggtctaggaagagttgtcggacagtactttaattagttgtacagtactaattattacttactttctacgttacattccttagtttcggccgtacggggacctacgggcttaggagtacgtcgaagtaccgtacgtggtacgtcg

SEQ ID NO: 193682 - DNA, 563 bp, Homo sapiens
  misc_feature: GYAE6OF02IYYXM.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagaccggccaccatcaactgcaagtccagtcagaattcttttagactattccactaagagagtatttgttagtttggtaccaaacagaagccaggccagcctacaaagcagctcatttatgggcatctacgtcggacgttccggggtccctgaccgatttccgtggctaggtggatcgtagggactaaagttcactcgtcacctactactaatacgcctgctaggctagaagatgaggtcagtcttatattgtactagtactaattattacgttactttactcgttaccgtattactacgtttacggaccgtaacgggggtaccctagggaccgttacgggtagacgttacgaaccgaacgtacgttaggtacgtacg

SEQ ID NO: 193683 - DNA, 543 bp, Homo sapiens
  misc_feature: GYAE6OF02FRR4X.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgaccccagtctccagacttccctggctgtgtctcgtgggcgagacggccaccatcaactgcaagtccagtcagtaattcttttagacttattccaataagagagatttgttagtttggtaccaacagaagccaggccagccctaccaaagcagctctatttatgggcatctacgtcgggtattccggggtcctcgaccgtattccggtggctaggtggactcgtagggactaaatttcactctacacctatcaatcgccttgcaggtctagaagtgtggtcggcagtacttattagttgtcagataattattactacttcttcttcgtattctacgtttcggccgtaagggaccaggtcgtacggagtactacgaacgtacgacgtggtaggtaccg

SEQ ID NO: 193684 - DNA, 630 bp, Homo sapiens
  misc_feature: GYAE6OF02HVTFB.11.76.G10.1.454.CMB.1.raw
  modified_base (464)..(464): a, c, t, g, unknown or other
  misc_feature (464)..(464): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtcctccagtacttccctggctgtgtctcgtgggcgagacggccaccatcaactgacaagtccagtcagaattcttttaagacttatccaataagagagtatttgttagtttcggtaaccaacaggaagccaggccagccctaccaaagcagctctatttagtgggcatcgtacgtcggggtacttcccggggtccctagacccgtacgttccggtaggccgtagtggacgtcgtacgggtactaaatttccgaacttccgtaccacctatacaactacgcctgacgacggtacgtaggaagtagttacggnggacgtagtactttaattagttacgtacgagtactaaagttaatttacttacctttccttaccgttaccgtaattacccttaccgttttcggacccggtaggggtaacccgagggtaccgtaggacgtactaccggaagtaaccggtaacgttcggtcggtaccgg

SEQ ID NO: 193685 - DNA, 667 bp, Homo sapiens
  misc_feature: GYAE6OF02FVQBK.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgaccctagtcctccagtacttcccgtggctgtgtctcgtgggcgagaccggccacatccaactgacaagtccagtcagtaattcgttttagacttacttccaataagagagtattttgttaaggtttcggaaccaagagtaacgccagggcccagccctaccgaaagctacgctataacgttttagcggactactcgtacgtacgggtccgttcccggggtccctaggtaccgtacgttccgggtacggacgtaggttcggaacttccgggtaagggtaaccttaaacgtttccaaccgtttccacctaacctagtaccgtaaacgtcggtcctacggactagggtaccaaggtaacgtgttaggtcggtactgttacgttttatacgtttagcctaaggtacctttaagttacttacgttaacctttcctcggttacaactttccgttacgttacgggacccggtagggactcgggtcgtaagtcgaatccggtaaaggtacgtacggtgtaccgtacg

SEQ ID NO: 193686 - DNA, 558 bp, Homo sapiens
  misc_feature: GYAE6OF02G3S3D.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctcgtgggcgagacggccaccatcaactgacaagtccagtcagaatcttttagactattccaactaagagagtatttagtttagtttaggtaaccaacagaagccaggccagcctaccaaagcagctctatttatgggcatctacgtcgggtagttcccggggtcctggacccgtagttccgtggcgagtggactcgtagggactaaatttcactctcaccatacaagtacgctgcagctagaagtagttggtgactagtctttattattcgtacagtactaattattattacttctcttaccgtattccttacgttttacggaccggtacgggtaccaggtcgtaggtagacgtacgtaacggaacgtacgtggtacggtcg

SEQ ID NO: 193687 - DNA, 562 bp, Homo sapiens
  misc_feature: GYAE6OF02GRT6J.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctctgggcgagacggccaccatcaactgacaagccagtcagaattctttagactattccaataagagagtatttgttaagtttggtaccaacagaagtccaggcccaagcctaccgaaagcacgctccatttattgggctatctactcgggtaattccggggtccctgaccgtattaccgtggcgagtggatcgtgggactaaatttccgactcgtcaccatcaatacgcctgcaggctagaatagtgtggcagtctttaattattcgtactgtactaattattaagtactttaccttctaccgttatacctacttttcggaccgtacggggtaacctagggccttaggacgtacgtacgtaacgacgtacgtgttacggtaccgg

SEQ ID NO: 193688 - DNA, 615 bp, Homo sapiens
  misc_feature: GYAE6OF02FPJI7.11.76.G10.1.454.CMB.1.raw
  modified_base (263)..(263): a, c, t, g, unknown or other
  misc_feature (263)..(263): n is a, c, g, or t
  modified_base (432)..(432): a, c, t, g, unknown or other
  misc_feature (432)..(432): n is a, c, g, or t
tcagcgagagataccacgaccggtgctcgatttagtcactcatacaggggacaacaggcaggcaggggcagcaagatggtgtgcagacccaggtcttcatttctctgttgctctggatctctggtgcctgcggagacatcgtgatcgacccagtctccagacttccctggctgtgtctcgtgggcgagacgccaccatcaactgcaagtccagtcagtattctttagactattccataagagatatttgttagttgtaccaanagaacgcaggccagcctaccgaaagcacgctactagtttagtcggctatctacgtcgggtacttcccggggtccctagaccgtagttcccgtggtctaggtcggatcgtacggtaactaactttcacttcaccactatcgaatcgccgtgctagggctagaactgtggngactaggttctttaagttacgttagtacagtaccttaaagttactttaacttacctttcttacccttacggactttaccgtttacggttttaccggacccggtaacggggtaaccgtacggtacgggtacggtaacggtaacgtacggtaaaccggtaacggtacggttacggtgggtaaccc

SEQ ID NO: 193689 - DNA, 581 bp, Homo sapiens
  misc_feature: GYAE6OF02IDMD8.11.76.G10.1.454.CMB.1.raw
  modified_base (369)..(369): a, c, t, g, unknown or other
  misc_feature (369)..(369): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggcgagacggccacatcaactgacaagtccagtcaagtaattcttttagacttacttaccaacgtaagagagtattttgttagtttagtaccaacagaagccgaggccagccctaccaaagcagctctatttagttgggctatctacgtcgggtagttcccggggtcctcgacccgtattcccggnggcaggtgactcgtggactaattcactctacacatacaatacgctgcaggtctaggaagtagttggtacgactagttacttaattgttagtaccaagtacctaaatttacttaactttaccttcttccttaccgacttactacgttttcggaccgtacggggtaccagggtcgttaggagtactacgacggtacgtaacgttcggtgtaccg

SEQ ID NO: 193690 - DNA, 595 bp, Homo sapiens
  misc_feature: GYAE6OF02IE47P.11.76.G10.1.454.CMB.1.raw
  modified_base (451)..(451): a, c, t, g, unknown or other
  misc_feature (451)..(451): n is a, c, g, or t
tcagcgagagataccacgaccggtgctcgatttagtcactcatacaggggaaaacaggcaggcaggggcagcaagatggtgttgcagacccaggtcttcatttctctgttgctctggatctctggtgcctgcggagacatcgtgatgacccagtcctccagacttccctggctgtgtctgtgggcgagaccggccaccatcaactgacagtaccagtacaataacttcttttacgactacttccactaagagagtattttgttagtttacggtaaccaacgtaagacgaccacggaccacgtccctaccgaaaagcgacgtctacttatttacgttggactagtctacgtacgggtcttccggggtcctcggacgtacgtcgtgcagtgactcgtagaactaattcacgtctaccacacttacatacgctagctaggctagagtatggtgntagtcttagttattacgactaacgtataattacttaattacttacgttaccttacgtaacctttcgtaaccgtttcggaccggtaacggggaccgtaggtcgtaggtaacgtagtcgaacgttacggagtcggtaggtctaccg

SEQ ID NO: 193691 - DNA, 709 bp, Homo sapiens
  misc_feature: GYAE6OF02GSJ26.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagacttccctggctgtgtctcgtgggacgagaccggccaccatcaactgacaagtccagtcaagtattctttagacttattccaataagagatatttgttagttcgaccaacagaacgccaggccagccctaccgaaagcagctctatttagtcgggactatcctacgtcgggtaacgttcccggggtccctaggacccgtactttccggtcggtctacggttcggagttcgtacggggtaaaccttaaagtttcccaaccgttcctacctaccctaacgttacctaaacgtacgtcccgtacgccgtaacgggtactacggaaacggtagttcgggtaacgtcgtaacggttactttaacgttttacgtacgtacgtaacgtaacgtaaactttaagttaactttaccgtttccgttacctttaccggtactttaccgttaccggtttttaccggacccgggtaacggggtaacccgtacgggtacgttacgggtaacgtacccgtacggtaccggtaaacccggtaacggttccggtaacggtcccgg

SEQ ID NO: 193692 - DNA, 543 bp, Homo sapiens
  misc_feature: GYAE6OF02F4MHK.11.76.G10.1.454.CMB.1.raw
tcagcgagagataccacgaccggtgctcgatttagtcactcatacagggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccacatcaactgcaagtccagtcagaatcttttagactattccactaagagagatttgttagtttggtaaccaacagaaagccaggcccagccctccaaaagcaagctcatttattgggcatctactgggacttccggggtccctgaccgattccgtggcaggtggatctgggactaaatttcactctcaacctatcaaatagcctgctaggctagaagatgtgcaacgtgtttaaatttacttgtacgtagtacgaaattaatttattaactttcttactttccgtaatctattttacggcctaaggggaccaggcgttaggagtacttcaagaacggtaactggtagtcg

SEQ ID NO: 193693 - DNA, 706 bp, Homo sapiens
  misc_feature: GYAE6OF02HXD66.11.76.G10.1.454.CMB.1.raw
  modified_base (269)..(269): a, c, t, g, unknown or other
  misc_feature (269)..(269): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagtacttccctggctgtgtctcgtgggcgagacgccaccatcaactgacagtcagtcagtaatctttagactattaccaactaagagagtatttgttagttgaccaanagagccaaggccagccctacaaagcagtctactattagtggcatctacgtcggacttccgggtcctacgaccgtacttccggtggacgtaggtcgtaactccggtagggtaaaccttaaagtttccaaccgttacctaccgtaacctaagttacctaaacgtacggtccgtacgggaccgtaacgggtccgttaaggtaaaaggtcgttacgggttacggacgttaccggttaaccttttaacgtttacgttaccggttacgtaacgtaacttaaactttaacgttttaaaccttaccgtttaccgttacccttaccgttaacctttccgtttaaaccggtttcccgggaacccggtaaacgggggttaaccctaaccgggttcggtaacggggaaccgtaacgttaaccggaacggttaaccggtaacgttccggg

SEQ ID NO: 193694 - DNA, 622 bp, Homo sapiens
  misc_feature: GYAE6OF02ILPQ0.11.76.G10.1.454.CMB.1.raw
  modified_base (326)..(326): a, c, t, g, unknown or other
  misc_feature (326)..(326): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggctattttaaaaggtgtccagtctacaacgagactactggaatcgtggggcgacttcgtgctgccgggagggtccctgagactctcctgtgcagcctctggacttccccttgtattctactttcacatcggccgtgggtccgccaagcctccggaggggggganagttgggaggtggggtccgcctccatgtaattcgaatttctatgaactaatttgtatgcggtactccggtggaaggggcgtatttcgtgtccgccgcgacgacagtgtacgaaacaacctaccttattccctacctaactaacttaacccaacgcgaacacgtacgaacgaccacggactaaattatttctgtagcggtaagggtttggttttcgggttggggctaaggttcgtccgttccgtttcgacttggcggtcggggaccgtaccgggtacccgttggtacccgtacccgg

SEQ ID NO: 193695 - DNA, 886 bp, Homo sapiens
  misc_feature: GYAE6OF02J08LL.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttcttgtggcttattttaaaaggtgtaccagttctacaacgagtactactggaatcgtggggcacttcgtgctggccgggaggtccctgacgactctcctgtgccagtcctacgttggacttccccttgactttctactttcactagtggaccttgggtcccgccaagccgtaccggaggggggtactagttgggtaggtcgggtccgcccgttaccgagttgtaacgttacgtaagtttactttagtaggtaaccttaagttttagtaagttcggaccggtacttacccgggtaggtaacgggggtacgttacgttttaaccgtcggttacccgggtacccgtacgtaacgggtaacgtaaaccggttaacggaaaccgtaaacccttaccgttttaaccctttaccccgttaacccggtaaccttaaacctttaaacccgtaaacccggtacccggtaaacccggtaacggttacccgggaaaacggttaacccggaaacccgggtaacctaaaacgttttaacgtttacttacggttaacgggtaacgggttaacggggtttcggggtttttaccggggttacgggggtccgttaaacgttttcgggttaacccggttcccggtttttaacgtacccggtttacgggtacccgggttaccgggggttaaccccggaaccgggggtttaacccccgtacggggttacccccgtaccggtttaccccccgg

SEQ ID NO: 193696 - DNA, 564 bp, Homo sapiens
  misc_feature: GYAE6OF02GTPNO.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagaccggccaccatcaactgcaagtccagtcagaattcttttagactattccaactaagagagtatttgttagtttggtaaccaacaagaagccaggccagccctacaaagcagctctatttatgggcatctactcgggacttccggggtccctggaccgtacgttccgtggctaggtggtatcgtaggactaaatttcactctacacctatacaatacgcctgcaggctagaagtagtgtaggctagcttaatttacttgtacagtactaagttacttaacgttactttcttacttaccgtactacttactttcggaccgtagggacccagggtacgtaggagtacgtacgacggtaacgtacgttacggtgtaccg

SEQ ID NO: 193697 - DNA, 697 bp, Homo sapiens
  misc_feature: GYAE6OF02GD2VE.11.76.G10.1.454.CMB.1.raw
tcagcgagagataccacgaccggtgctcgatttagtcactcatacagggagcgtacaacaggcaggcaggggcagcaacgatggtgttgcagaccaggtcttcatttctctgttgctctggatctctggtgcctgcggagacatcgtgatgaccagtctccgagacttcccgtggctgtcgtcgtctgggacgacgaccggcccaacctattaccaactcgacaacgtccaagtacagtaacttcgttttaagacttattaccaataagagtagtatttggttagttacggtaccaacgtagaacgccgtaggcctacgacctaccaaagtcacggtcttcgtacgtttagtcgggtacacgttacgtacgtcgggtacgtttcccggggtcctacggaaccgttacgttcggtacggtacgtaggttcggacttcggtacggaacgttaactttaccgtacctctacctaccgtaagtactaacgtacgtcgttacgacgtaagtcgtaacggtaggtacgttggtacgtagtacgttacgtttacttacgtacggtactaggtaactaacggtttaacttacgttaccttacgttacctaccgtacgttccgttaacggtttccggacggtaccggtaacggtacgttaccggtacggtacgtaaccgtagtaaccggtaccgtaacgttacggg

SEQ ID NO: 193698 - DNA, 591 bp, Homo sapiens
  misc_feature: GYAE6OF02F9PF1.11.76.G10.1.454.CMB.1.raw
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagacttccctggctgtgtctctgggcgagacggccacatcaactgacaagtccagtcaagattcgtttagacttacttccactaagagagtatttgttagtttggtaccaanaagagccaggccacgcctacaaagcagctcatttattgggcatcgtactcgggtnttccgggtcctgaccgtattccgtgctagtgactcgtggaactaatttcactcgtccaccatactaanacgcctgacgacggntagaacgagtgtggtactagtactttaatttacgttagttcgaacgtactaagttaattaacttaccgtttaccttacgttaccgttattaccgtaccgtttttacgggaccggttacggggaaccgttacggtacgttacggtacggtacgttacggtaacgtaaccgtacgttacggg

SEQ ID NO: 193699 - DNA, 750 bp, Homo sapiens
  misc_feature: GYAE6OF02IFGH1.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctgtggtgcctggcggagacatcgtgatcgacccagtctaccagtacttccctggctgtgtctcgtgggcgagaccggccaccatacaactgacaagtccagtcaagtaattctttagacttattaccaacgtaagagtagtacttttagttagtttagtaaccaagtagaacgccgaggacctacgtcctaaccgaaaacgccgtaacgaccttactaagttttacggtacggactacgtcttaacggtcggggtacgttccccggggtccttacggacccggttacttccgggtaggacctagggttacgacggtacgtaacggggaaacttttaaacgtttcccgaaccgtttcctaaccctaaccgtaacttaaaccgtaaacgttaccgacccgttagggaacccgtagggaccgtaaggaaggtacgttacggtacgggtaccgtaacgtttaacgtttaacgtttagttacgtaacgtaaggttaactaaactttaagttttaaccttaccctttacgttacccgttaaccttacgttacgtttacgtttaccggaacggtaacgggtaaccctgggtacgtacggtacgtaacgcgtaaaggaaccgtaaggtcgtaggtacc

SEQ ID NO: 193700 - DNA, 559 bp, Homo sapiens
  misc_feature: GYAE6OF02GX3R1.11.76.G10.1.454.CMB.1.raw
  modified_base (266)..(266): a, c, t, g, unknown or other
  misc_feature (266)..(266): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaattcttttagactattccactaagagagatttgttagtttggtaccaanagaagccaggccagcctccaaagcagctcatttatgggcatctactcgggacttccggggtccctgaccgacttccgtggcaggtggatctgggactaatttcactctcaccatcaatagcctgcaggctgaagatgtggcagtctttatattgtactagtactaattattacttaactttctacctttaccgtacttaccttaccgtttttcgggacccgttacgggggtaaccctaggggtcctagggtaagtacgttaccgaacggtaacggtaaccgttggtcggtacg

SEQ ID NO: 193701 - DNA, 793 bp, Homo sapiens
  misc_feature: GYAE6OF02J1Q6W.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagtacttccctggcttggtgtctcgtcggggacgacggaccggcccaccgataccaactcgacgtaacggtccagtaccaagtaactttcgttttaagaccttaacttaccaactaagtaaggacgttagttttaggtttaagttttacgggaaaccctaaagtaaacggtaacgaccgtaacggaccccaacgtacccgtaaccgaaaggtccacggtacttacttaagttttacggacggtactaagttaccgttaccggtacggggttaacgtttccccgggggtaccctacggtaacccgttaccggtttccggtaggaccgtaacggttgggaaccttcgggtaacggtaaaccttaaaacgtttcccgacgttaccccgttaaccaccgtaaactacctaaaccggttcgtacccgtaggtaacgtacgggtacctagggaacgtaagttccggaggtaccgtagttactttaacgttgttacgtacgtaagtaaccgtaagtttacttacgttaacctttcgttacctccgttaacgttacttacggtttacggaaccggttaccgggtacccgaaggttcccacgggtactacggtaccgacgtaacgttacgttcggtacggtacg

SEQ ID NO: 193702 - DNA, 834 bp, Homo sapiens
  misc_feature: GYAE6OF02HLIO4.11.76.G10.1.454.CMB.1.raw
tcagcgagagataccacgaccggtgctcgatttagtcactcatacaggggaggtctgagagaggagcccccgccctgggatttgcaggtattttcattgggtgctcaggactgaacaaagagaactcaccatggaactcgggctgagctggtctttttcttgtggctaatttaaaggtgtccagtctacaacgagactactgaatcgtggggcgacttcgtgcgtggccgggacgggtccctgacgactctcctgtcgcacgcctcgtcggactttcccccttgtactttcctaccttttacaactagtcggccgtggggtcccgaccgtaacgccgtacccgggaggggggtaagtacggtttggggaggttcggggtccgtcccgtccgtaatagtaactttacggtaatttcgttatacgtaactaatttgtagttcggtaccgtaccgttaccggtaggggtaaccgggggtacgttaacgttttaccgtcggttcccggtaccggaccgtaaaggtaaccgtagttaccggtaaccgtaaacccgtaaaccttaaccctttaccctttacccgtacccctaaccgttaacctttaaacccgaaccggtaaccgaacgtaacggtaaccggaaacgttaccggaaccggtaaccgtaaattactttaccgttagttcggaacgggttaacggggttttacgggttttaccggggttacgggggacgtttaacggtttcggttacccggttacccgtttacggtacgttacggtccggttccggggtaccggtaacccgggtaacccggttaccgggtacccgtaccccgg

SEQ ID NO: 193703 - DNA, 812 bp, Homo sapiens
  misc_feature: GYAE6OF02II1NS.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtcgcctgcggagacatcgtgatcgacccagtcctccagtactttcccgtggctggtgtctcgtgggcagaccggccaccatccaactgctaacgtccagtcaagtacttctttagacttacttaccaacgtaagagtagttattttaggttacgttcggtaacccaaacgagtaacgccgtaggcccacgtcccctaaccgaaaggccacggtccttacgtaattttcgtaggactaacgttacctacgggttccgggtacggtttccccgggtaccctacggtaacccgtacgtttcccgggtggtaccgtaagggtacggtaactttcgggtaacgggtaaaccttaaacgttttccaacgttaccctacgaaccctaagttaccctaaagttaccggcccttaggaccgtaggtacctaagggtaaagtcgttacggggttcggaacctaagggtttaacctttttaacgtttacgtttaacggtaccgttaaaagtacccgtttaaaaagttttacttttaaaccgttttccgtttaacccggttttcctttaaacccggtacgtttaccctttttaacccggggttttacccgggacccgggtaagggttaaaccccgccggggttaaccgttgggtaaaccttccgtaacgggtaaccggtaccgttaacggttcggg

SEQ ID NO: 193704 - DNA, 716 bp, Homo sapiens
  misc_feature: GYAE6OF02IBS11.11.76.G10.1.454.CMB.1.raw
  modified_base (477)..(477): a, c, t, g, unknown or other
  misc_feature (477)..(477): n is a, c, g, or t
tcagcgagagataccacgaccggtgctcgatttagtcactcatacaggggacaacaggcaggcaggggcagcaagatggtgttgcagacccaggtcttcatttctctgtttgctctggatctctggtgcctggcggagacatcgtagatcgacccagtctccagacttccctggctgtcgtctcgtgggcgacgaccggcccacctagtaccaacgtcgccgtaacgtcccagtaccaagtaaattctttttaacgacttaacttaccaaacgttaagaggtagttaacgttttggttttaacggtttacgggtaacccaaaacgtaaggaaccgtaccgaacggggaccctaggaccccttaaccaaaacggccgacgcgttctacgttttagtagggctaatccgttaacgtcggggtactttcccggggcctacggccgtattcccggtggcctaggtgacgttcggacggtanacgtctcctaacgtctacctaccaatcgacaccgaacgtcgactaaggccgttaggaacgtacggttagttacggtactttacgggttttaactaccggttactacgaacgtacgtaaagtttggttaagtcgtaacggtacctccgtattccgtacgggttcggacggggtaccggggacccggtcgggttaaggacgtacgtacgtaacggacggttagtacgggtcgtccgtaccg

SEQ ID NO: 193705 - DNA, 748 bp, Homo sapiens
  misc_feature: GYAE6OF02G08D3.11.76.G10.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtcctccagtacttccctggctgtgtctcgtgggcgaggaccggccacctatcaactgacaagtccagtcagattcttttagacttnttccactaagagagtatttgttagtttcgacaanagagccagccagcctaccaagcacgctctatttagtgggcatacttacgtcggggtacgtttccccggggtcctacgaccggtacgtttccgggcggacgtacggttcggtacgttcgtaaggggtaacttaaacgttttccgaacctttccttacctacccgtaacgttacctaaacgttacgacccttacgacggaacggtacgtaaggtaacgtacgtttgggcgggtacgtacgttacgttttaaacgtttagttacgtaacgtaagtaccttaaaatttactttaaaccttttaccgttttaccttccgtttaaaccgttacctttacgtttttaccccgggtttttacggtaccccggggttaacggggggtaaacccccgttaggggttcccgttacggggtaacgttaccggtttaaccgaaacggggtaacccggttaaaccggtttcgggttacggtaacccgg

SEQ ID NO: 193706 - DNA, 586 bp, Homo sapiens
  misc_feature: GYAE6OF02FIQYP.11.76.G10.1.454.CMB.1.raw
  modified_base (238)..(238): a, c, t, g, unknown or other
  misc_feature (238)..(238): n is a, c, g, or t
tcagcgagagataccacgaccggtgctcgatttagtcactcatacaggggacaacaggcaggcagggcagcaagatggtgttgcagacccaggtcttcatttctctgttgctctggatctctggtgcctgcggagacatcgtgatgacccagtctccagattccctggctgtgtctcgtgggcagacggccaccatcaactgcaagtccagtcagatcttttagctattccataaganagatttgttagttggtaaccaacagaagccaggcccagccctccaaagcagctcatttattgggctatctacgtcgggattcccggggtcctgaccgtacttccgtggcaggtgactcgtagggactaaatttccgactcctactacctatacctaatacgcctgccaggtctagaagagttgtggctacgtctttaagttagtttgacgtaagacctaaagtttaacttactttaacttccttacttccgtattaccttacgttttcgggacccgttaacgggggaccctaacgggtccttaggggtaactacgttaccaaggtacccggaacttggtcggtacccg

SEQ ID NO: 193707 - DNA, 671 bp, Homo sapiens
  misc_feature: GYAE6OF02GDZOW.11.76.G10.1.454.CMB.1.raw
tcagcgagagataccacgaccggtgctcgatttagtcactcatacaggggacaacaggcaggcaggggcaacaagatggtgttgcagacccaggtcttcatttctctgttgctctggatctctggtgcctgcggagacatcgtgatgacccagtctccagacttccctggctgtgtctcgtgggcgagacggccaccatcaactgacaacgtccagtcaagtaattctttagacttatccactaagagagtatttgttagtttggtaaccaacagaacgccaggccagcctacaagcagctactatttagtgggctatctacgtcgggtacgttcccggggtacctggacccgtagttcccggtggacctagggtggaactccggttaggggaaccttaaacttttccgaccgttacctacctaaccacttaccgaaattaccgtccctagaccgtacggtacttacggaaagtcgtaggttcggaccgtaggttacctttaagtttatttaggtctaacggtaactaagtttaactttaatttacctttacctttccgttaaccgtacttaccgttacgttttcggggacgggtaccggggtaccgtacgggtaccgttagggacgttaacgtcggaaacggtaccgtaaggtacggtcggtactaccgg

SEQ ID NO: 193708 - DNA, 733 bp, Homo sapiens
  misc_feature: GYAE6OF02GRD07.11.76.G10.1.454.CMB.1.raw
  modified_base (242)..(242): a, c, t, g, unknown or other
  misc_feature (242)..(242): n is a, c, g, or t
tcagcgagagataccacgaccggtgctcgatttagtcactcatacagggggaggtctgagagaggagccccgccctgggatttgcaggtattttcattgggtgctcaggactgaaacaaagagaactcaccatggaactcgggctgagctggtctttttctgtggctaattttaaaggtgtccagtctacaacgagactactggatcgtgggggctacttcgtgcgtggccgggaggtcccngagacctcctccgtgtgcacgtccgttcgtcggtacctttccccgttgtacttcctactttcactagtcggccgtcgggtcccaccgaacgtcgtccggaggggggagtaggttagggaggttcgggtccgtcccgttaccagtgtaacgttacggtaaacgtttcttaagtacgtacttaatttggtactggtcgacgtcggtagaagggtcgtatttcgtacgtccgacgtactacgtacagtcgtaaccgaaacctaacttaacccgttactaccctacctactaacgtacccgaaacgccgactaacggtaccgaaacgaccgtaaccggaaccttaagtttacgttccgtaggtaaccggtcgggttaacgggtttagggttttaccgggtacggggtacttaacggtttcgtacccggttccgttacgtaacgtcggtccgttacggggcccgtaaccgggtacccgttggtacccggttacccg

SEQ ID NO: 193709 - DNA, 749 bp, Homo sapiens
  misc_feature: GYAE6OF02JSM5Z.11.76.G10.1.454.CMB.1.raw
  modified_base (144)..(144): a, c, t, g, unknown or other
  misc_feature (144)..(144): n is a, c, g, or t
  modified_base (186)..(186): a, c, t, g, unknown or other
  misc_feature (186)..(186): n is a, c, g, or t
  modified_base (587)..(587): a, c, t, g, unknown or other
  misc_feature (587)..(587): n is a, c, g, or t
tcagcgagagataccacgaccggtgctcgatttagtcactcatacagggagctacaacaggcaggcaggggcagcaagatggtgttgcagacccaggtcttcagtttctctgttgctctggatcctgtggtcgcctggcggganaccgatcggtagatacgacccctagtcctcagtacttcccgnggctggttctccgtcgtcggggacgacggaaccgcccacgatcctaacgtgaccctaaggtcccagtcgaaggtaacttttacgtttagaccttacttaccaacgtaaaggtacgtaagtaattttaggtttaacgtttacggttaaaccaaaccgaagtaacggtcccgaacgggtaccctacggtaaccccttaaccggaaaacggtccaaaccgtccgtttaacgtaacgtttttacggttcgggacctaacgttaccgtaccggttaccggggtaccgttacccgggttcccgtagtaacccgttaggtccggtcggtacgtacggtggaacttcgggtacggtaaacgtaactttccgacgtctaacgccttaacgtactaaacgtccgaccgtanccggtaggtacctaagggaactggttagtacgggaccttagtactttagtagttcgacgaattaagtactttaattcctaacctacttcgtaaccgattcccttgtacggaccggttagaccggttagacgttgacgtacgtaccgaacggacgttagtacg

SEQ ID NO: 193710 - DNA, 831 bp, Homo sapiens
  misc_feature: GYAE6OF02IE16Y.11.76.G10.1.454.CMB.1.raw
  modified_base (478)..(478): a, c, t, g, unknown or other
  misc_feature (478)..(478): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtcgcctggcggagacatcggtgatcgacccagtcctccagtacttcccgtggtactgtcgttcctacggtgggcgacggtaccggaccctaacccataccaaacgtcggacctaacgtcccgaagtaccgaacgttaactttaccgttttaagaacctttacttaccctaaagtaaaggtacgtaaggttagtttttacggttaacgttttaacgggtaaaccctaaaacgaacggtaacgcccggaaggtccccgaagtcccccgttaaccgaaaaggccacgtctaccttaagttttagtcgggacttacgtaccttacgggtccgggtaaccggtttccccgggtaccncggtaaccggtagtttccggaggtcgtaggttggacttcgacggtaaattaactttccgaactttactaccgtaccaactaacctaagtcgtaccgtacgtacgacggtacgtaacggtagtaacgtcgtaaggtaccgttacgttacgttttaattcgttacgtaccgtaacgttacgttaaattaacgttttaacgttaccgttttacctcccggttttaactacgtttacccttaacggttttaccggacccgggtaacggggttaaccccgttaggggtaacccggtagggttaaccgtacggtaccgtaaaccgggtaaccgttacggttacggggtacgttacccgg

SEQ ID NO: 193711 - DNA, 833 bp, Homo sapiens
  misc_feature: GYAE6OF02IS4K1.11.76.G10.1.454.CMB.1.raw
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggcttttctgtggctattttaaaaggtgtcagtctaacaacgagactactggaatcgtggggcacttcggtgctggccgggtaggtccctgacgtactctccgtgtgacagcctcgtggtacttccccttgtacttcctactttcgactacgtcggtccgttcgggtcccgacccgaagtcccgtacccgggaggggggtaacgtagtttcggggaacggttcggggtccgtacccgtacctagtacgtaacgttacgtaatttccgttaagtacgaaccttaagttttcgtacgttacggtacgggtaaccttccgggtacggtaaacggggggtcttaacgttttaccgtcgggttccgggacccgtacggtaacggaaaccgtaaacgggtaaccggtaaaacctaaaccgttaaccctttaactttaccccgtacctaacttaacccttaaccggaaacccgtacgtaaaccgtacggtaccgaaacgggaaccgtaacccggtaaaccgttaaaacgttaacgttttaccgacgtttacggaaccgggttaaaggggttttccgggtttacggttacggggtacgttaagtttccgggttaaccgttcctttacggtacgtcgtacgggttacgggtaccggtaaaccgggtacccggtcgtacccgtacccgtttaccg

SEQ ID NO: 193712 - DNA, 629 bp, Homo sapiens
  misc_feature: GYAE6OF02FJ6ZT.11.76.G10.1.454.CMB.1.raw
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtcgtctcgtgggcgagaccggccacatcaactgcaagtccagtcaagtacttctttaagactacttccactaagagagtatttgtttagtttaggtaccaacagaacgcgaggaccgagccctacgaaaacgcagctactatttagtggctatctactcgggtcttcccgggtcctgaccgtacttccggtggctaggtagctcgtagggtaactaacgtttacacctctacacctaatacaactacgtcctggacctaggacgttaggaagtacttcgggtacggacgtaggtctttaaacgtttagttacgttacgacgttataaacgtttaatttaactaccgtttcttaccgtttaccgtatttaccgtaacgtttttcgggaaccgtacgggggtaccgtaacgggtccgtttagggaacgttacgtacgtacggtaccgtaagttcgg

SEQ ID NO: 193713 - DNA, 635 bp, Homo sapiens
  misc_feature: GYAE6OF02IKKAK.11.76.G10.1.454.CMB.1.raw
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagcgagagataccacgaccggtgctcgatttagtcactcatacaggggaggtctgagagaggagccccgccctgggatttgcaggtattttcattgggtgctcaggactgaaacaaagagaactcaccatggaactcgggctgagctgcttttctgtgctatttaaaaggtgtccagtctacaacgagactactggaatctggggcgacttcgtgctgccgggagggtccctgagactctcctgtgcagcctctggacttccccttgattcactttcacatggcctggtccgccaagcctccgagggggganagtgggagtgggtcnccgtccatgaattcgaatttctatgtactaatttcgtatgccgtactccggtaggaagggtcgtatttacgtggtccgtccgcaaggaccaacggtcgaaacaactaaccttacttccctcccaactaactttacccgaaagccgaacgacgtacgaaacgacgaccggaactaaattatttcgtagtgacggtaaagggtttcgggttttacggtagggggctaagtttcggtacgttccctttggtaccgtggtaccggttggggacccgtaacggggtaacccctgggttcccaccggttccc

SEQ ID NO: 193714 - DNA, 794 bp, Homo sapiens
  misc_feature: GYAE6OF02I2P0B.11.76.G10.1.454.CMB.1.raw
  modified_base (168)..(168): a, c, t, g, unknown or other
  misc_feature (168)..(168): n is a, c, g, or t
  modified_base (235)..(235): a, c, t, g, unknown or other
  misc_feature (235)..(235): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttcccnggctggtgtcttcgtgggcgagaccggccaccatcaactgacaagtccagtcagtaattcgttttanacttattccaataagagagtacttttgtttaggttttacggaaccaacgagaacgaccgaggcccacgccctaccgaaaagcacgctactattttagtggctacttcctacggtcggggtacgttcccggggtaccctaggacccgttacgttcccggtgggtctacgggttcggtacgttcggtacggggtaaaccttaacgtttcccgacctttccgtacctaaccctacgttaacctaaacgttaaccggtccttacgggacctacggggtacctaacgggtaaggtaaggtttcggtacggtacgtaaggtttacctttaaaggtttacggttttaccggacgttaaacggtttaacccttaaaaggttttaactttttaaccctttaaccgtttttaccgtttaccccggtttaacccgttaaattttccccgggttttaccggtttttaccggggtaccccgggtaaaccggggggttacgaacgggttccgtttaacggggtaataccggttacgaaccggtaaccggttaccgtacggggttcgtaacccg

SEQ ID NO: 193715 - DNA, 744 bp, Homo sapiens
  misc_feature: GYAE6OF02HPMAR.11.76.G10.1.454.CMB.1.raw
tcagcgagagataccacgaccggtgctcgatttagtcactcatacagggagctacaacaggcaggcaggggcagcaagatggtgttgcagaccaggtcttcatttctctgttgctctggatctctggttgcctgcggagacagtcgtgagtcgacccagtctccagtacttcccgtggctgtgtctcgtggcgagacggccacagtacaactcgcaagtccagtacaagacgttcttttaagactttattaccaactaagagagtatttagttagtttagtacctaactagaacgacagggtccagcctaccgaaacgacacgtactactaacttttacgttacggggatacgttaccttaaccggtacgggttaccggtttccccggggtaccccttaggtacccggtaacgtttcccgggtacggtacgttaacgggttacgggtacgtttacggtacgggggtttaaaccctaaaaagtttttcccgtaacgttaaccgttccctaaccgtacttaacgaaacgttaacgaccgttcgacgtacggtaccgttagaaggttacgtcgtacggtacgtagtacgtttaagtttacgttagtacgtataccgttaatttaaacttctttacttaacctttaccgtttcgaaccttttcgtaacgttttccggaaccgtacggggttaaccgtacgggtacgtacggggtactacgttaccgtaacgggtaacgtacgttacgg

SEQ ID NO: 193716 - DNA, 760 bp, Homo sapiens
  misc_feature: GYAE6OF02HTOYJ.11.76.G10.1.454.CMB.1.raw
  modified_base (170)..(170): a, c, t, g, unknown or other
  misc_feature (170)..(170): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtcctccagacttcccnggctgtgtcctctgggcgagcggccaccatcaactgacaagtcagtcagattctttagactatccaactaagagagtatttgtagtttcgacaacagagaccagccagccctaccaaagcagctactagtttagttcgggactacttccgttaccgtccggggtacgtttccccggggttccctaccggtacccgttacgtttccgggtacgggtacgtaggtacggtaacgtttccggtaaacggggtaacttaaaacgtttccctaaccgttccccttacctaacccgtaacttaacccgtaaaagttaccggtacccgttaccggtaaccggtacggtacccgttaagggtaaaacggttaggttacggtaccgggtacgtaacgttacctttaagttttacgttacggtactagtacctttaaagtttaaccgttttatttaacccgttttacctttcccgttaaccgttacgtttaccccgttaggtttttacccgggacccggtaaccggggggtaccgttaacgggtccggtacgggtaactaacggttaccgaaccggttaagaaccgtttggacggtaccg

SEQ ID NO: 193717 - DNA, 869 bp, Homo sapiens
  misc_feature: GYAE6OF02I54IE.11.76.G10.1.454.CMB.1.raw
  modified_base (130)..(130): a, c, t, g, unknown or other
  misc_feature (130)..(130): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtncctgcggagacatcgtgatcgacccagtctccagtacttccctggctgtcgtcctcgtgggacgagaccgccaccatacaacgtcgacaacgtccagtacaagtacttctttaagacttacttaccataagagtagtatttaggttacgtttacggaacctaacgtaggtaacgacccgtagacccgacggtacctaccgaaaacgcgagtaccttacttaagttttaacgttcgggacttaacgttaccgttaaccggttaccgggtaccggtttaccccggggttaccccgttacgtaacccggttaccgtttacccgggtacggacccgggtaacggtttacgggtaactttcgggtaaaccggggttaaacctttaaaacgtttttacccggtaaccgttcccttaacccgtaaccttaaccgttaaccgtaaacgttaaccgtcccgttacggtaaccggtacgggtacttaaaggaaacggttaaggttcggttaccgggtacctaaagggtcctttttaaacgtttcgttacggttaaccaacgggttaaacttaacttttaaacgttaacctttaccttacccgttctttaaacccgtcttttaacccttttaaccgggttttcccggaaaccccgggtacgggggttaaaccccgtttagggtacccggtttaacggggtaacttaaccggttaaccgggtaaacggtaacccggtttaacgtttcgggg

SEQ ID NO: 193718 - DNA, 853 bp, Homo sapiens
  misc_feature: GYAE6OF02JOO5D.11.76.G10.1.454.CMB.1.raw
  modified_base (179)..(179): a, c, t, g, unknown or other
  misc_feature (179)..(179): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtcgcctggacggagactagtcggtgatcgaccctagtcctacagtacttccgnggtctggtcgtctcggtgggacgtacggccgccacataccaacgtgaccgtaagtccagtacgaagtaactttcgttttacgaaccttctacccgaaacgtaaggagtaacgtttagtttttaggtttaggttttaaccggtaaaccaaacgtagtaaccgtaccggacggtacctaacgtacccctaaaccgaaacggccgtacgtaccttacgttaaggttttcggtacggacttacttaccggttaacggttaccgggggtacccgtttccccgggggttacctacggtacccgggttaccgtttacccgggtcgggtaaccgtagggttacggtacctttaccgggtaacggggtaaacctttaaaccgttttccaccggtttacccctactaacccgtaactaacgttaaaccgtacccggtcccttaggaccggtacggtacgtaaagaacggttgttacgggtacgtaccggttaacttaccgttttaaattacggtttccgacgtaaacggtaacctttaagtttaaaccggttttcccttaaccgttttccgttaaacccgttaccgtacgtttaccgtttacggttaccggacccgggtaacgggtcctaacggggtcgtaggtacctacggtacgtaacgtaacccggtgttcggagggttac

SEQ ID NO: 193719 - DNA, 614 bp, Homo sapiens
  misc_feature: GYAE6OF02G4ZRG.11.76.G10.1.454.CMB.1.raw
  modified_base (167)..(167): a, c, t, g, unknown or other
  misc_feature (167)..(167): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattcccnggctgtgtctcgtgggcagaccggccaccatcaactgacaagtccagtcagaatctttagactattccactaagagagtatttgtagtttggtaccaacagtaagccagccagcctacaaagcagctctatttatggctatctacgtcgggattcccgggtcctgaccgtattccgtggcaggtggaacttcgtagggtaactaaaagtttccacttaccgtactaaccgaatacaaagttacgccgtgacgtacgggactaggaaactagtcggtacggactaagtcctttaagttacgttgtacgtaagtacgtaaattagtttaacttaacgtttaccttaccttaacccgtacttacgttacgttttccgggaccgtaacggggtaaccctacgggcgttaggaacgtactaccgaaggtaaccgtaacggtcgtaggtaccg

SEQ ID NO: 193720 - DNA, 697 bp, Homo sapiens
  misc_feature: GYAE6OF02IRW94.11.76.G10.1.454.CMB.1.raw
  modified_base (226)..(226): a, c, t, g, unknown or other
  misc_feature (226)..(226): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtcctcagacttccctggctgtgtctcgtgggcgagaccggccaccatacaactggacaacgtccagtacaanaacttcttttagacttattaccaataagagtatatttgttagttcgacaanagacncagccagcctaccaagcagctactactttagtggactactcgtacgtcgggtacgttcccgggtacctcggaccgttacgttccggtacggactaggtaggtactcgtacgggaaacttaaacgtttcctaacgtcctaaccacctaatacaaacgttacgcctagtcgaacggtctaaggaacgtagttcgtacggactacgttacgttttatagtttacggactaacgtactaaacgtttaactttaacgtttacccgttttacgttaccctttacccgttaacgtttcccgtttaaccgtttttacggacccgggtaaacgggggtaacccgttacgggtaaccggtacgggttaacgtaccggttaaccgggaaaccggtaaccggttaacggttgggttaccggtaaccg

SEQ ID NO: 193721 - DNA, 627 bp, Homo sapiens
  misc_feature: GYAE6OF02HYP21.11.76.G10.1.454.CMB.1.raw
  modified_base (237)..(237): a, c, t, g, unknown or other
  misc_feature (237)..(237): n is a, c, g, or t
  modified_base (446)..(446): a, c, t, g, unknown or other
  misc_feature (446)..(446): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtcctccagcttccctggcttgtagtctcgtgggcgaggaccgccaccatcaactgacaagtccagtcagtaacttctttanactattacaactaagagagtagttttagttaggtttacggtaaccaataaggaacgaccgacgggaccacgaccctacaaagcagctctattactgggctatactacgtcggtacgttccgggtacctgtaccgtcgttccgtggacgtaggtgtacgtcgtacggtaactaactttcgactcctacactatacaactagccgtagacncgggtactaggaaccgtagtacgtcgactatacgtttgttaacgttcgtacgtagtaacgttaattacgtttactacgttaccttacgttcccttacgttccgttaacgtttccggggaacccggttacgggaccgtaagggtcctaggtacgtaccgtacgtaacgtacggtaacttggg

SEQ ID NO: 193722 - DNA, 790 bp, Homo sapiens
  misc_feature: GYAE6OF02FKWWT.11.76.G10.1.454.CMB.1.raw
  modified_base (176)..(176): a, c, t, g, unknown or other
  misc_feature (176)..(176): n is a, c, g, or t
tcagcgagagataccacgaccggtgctcgatttagtcactcatacaggggacaaacaggcaggcaggggcagcaagatggtgttgcagacccaggtcttcatttctctgtttgctctggatctcgtggtgcctgcggagacagtcgtgatcgaccctagtcctccagacttcccgnggctgtgtctcgtgggcgagaccggccaacctacgtacaacctgacaacgtccagtaccaagtaagttactttacgaccttacttacctaacgtaagtagtagttagtttaggtttagtttacggttaaccaagaagaacggaccgaacggacccacggtaccctaaccgaaacgaccacgtacctacttaagttttagttcgggtactacgttaccgtacggtccggggtaaccgtttccccggggttaaccccgtccggtacccgtaccgtttcccggtacggtaccggtaggtcggtacgtaccggggtaggtaaaccttaaacgttttcccaccgttacctaccgtactaacgtactaaacgtcgtaccgtcggtacgacgtaccgtaggacgtaggtcggtacgtcgtacttaagttttaactttcgttacgaccgttaagtacctttaaattacgtttaacgtttacctttactttaccttaccgttacctttaccgtttacccggttacgggtacccggtaaccggggtacccttacggggtacccgtaagggttacccgtaacgtacgggttaaaccgtacgttaacgggtcgggttaccgtacgg

SEQ ID NO: 193723 - DNA, 763 bp, Homo sapiens
  misc_feature: GYAE6OF02IVDG3.11.76.G10.1.454.CMB.1.raw
  modified_base (228)..(228): a, c, t, g, unknown or other
  misc_feature (228)..(228): n is a, c, g, or t
  modified_base (468)..(468): a, c, t, g, unknown or other
  misc_feature (468)..(468): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagaccatcgtgatcgaccagtctccagtacttccctgctgtcgtctcgtgggcgagaccgccacatacaactcgactaacgtccagtcaanaatttaccgtttagacttacttaccctaacgtaaacgaggtacgttagttttaggtttaaggtttacggtaacccaaacgtaaggtaaacgccgacggtacccgacggtccccttaaccgaaacggcctacgaccttaccgttaagttttaacggtcgggtactacttcgtaccggttacgggtaccgttcccgggggtccctacgggtaccgtacgttccggtacggcgtaggtacgtnttcggtacgggtaactacgtttacctccttacctaccgtaactacgtacaacgttacgtaccgtagcgtaacgtcgtacgaaaggtcgtcggtacggacttacggttactttagttacgtttccgtaacgtcgttaaattaacttaacgttttacctttaacgtttaccttacccgtttaccgtacttttaccggtaccgggttttacggaacccgggttacggggaacccttacgggttccgaacgggttaacggttaccggtaaccggtaaccggtaggtaacccggttcggg

SEQ ID NO: 193724 - DNA, 893 bp, Homo sapiens
  misc_feature: GYAE6OF02HY4FX.11.76.G10.1.454.CMB.1.raw
  modified_base (139)..(139): a, c, t, g, unknown or other
  misc_feature (139)..(139): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacntcgtgatcgacccagtcctccagtacttccctgggcttgtgttccgtcgtcgggcgtacggaccggacccaacctattaccgaaacgttcgaaccgtaaacggttccccaagttaccgaaagttacgttttaaccgtttttaacggacttttaaccgtttacccaaacgttaaacgggaacgttaaggtttaacgttttttaggttttaaggtttttaaccggtaaaaccctaaacgaaacggttaaaaccggacccgtaacggggacccctaacggtaacccccgtaaacgtaaaaaccggccgtaacgtaccgtttaaccgtttaattttacgggtacgggtacttaacgttaccgttaaccgttacgggggttaaccggtttccccggggtccgtaaccgtacccggttcgttttcccgggtaggtcgtacggttcgggtaaccgtacggtacgggtaaaccttaaacgttttcccactttacccgttaccaaaccgttactaaccgtaaacgtcgtcccgtaagtacccgtaaggtaccgttaagggtaacgtaagttcgggtacgtacgttacgtttaactttagtttaacgtttacgttaccgaattacgttaaagtttacttactttaaccttttctacgttaccttacgttaccgtttacgtttaccgggaccgtaagggtaccctagggtccgttaaggaacgttcgaacgttaacggtaaccgttaacggtcgtaccggtacgg

SEQ ID NO: 193725 - DNA, 783 bp, Homo sapiens
  misc_feature: GYAE6OF02IM5JE.11.76.G10.1.454.CMB.1.raw
  modified_base (132)..(132): a, c, t, g, unknown or other
  misc_feature (132)..(132): n is a, c, g, or t
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
tcagcgagagataccacgaccggtgctcgatttagtcactcatacagggagctacaacaggcaggcaggggcagcaagatggtgttgcagacccaggtcttcatttctctgttgctctggatctcgtggtcncctgcggagacntcgtgatcgaccctagtcctccgaagtcttcccgtggcctgttcgtccttcgngggacgaacgccggcctaccagtccaagtcgactaagtccagtcaagtactttcgttagacttatccgaataacgagtacgttatttcggttagttacgtaacgaacgtaacggtaacgtcccgaacggccctacggtacccctaacgaaaacggtctaacggtaccttactaacgttttacggcggtaactaacgttcggtaccggtacggggttaaccttcccggggttaccctaacggtacccgtacgtttacccggtgggacgtacggttacggtaaccgtaccggttaggggaaacctttaaacgtttccaaccgtttcctaccgtaaccgtaacgttacaaacgtttccgtaccttggaacctacgggtacttaggaaacggttcgtaggttaccggaccttaggttactttaacggtacgttaccggtaatacgttaaacttaaccgttttattaccggttactttacccgtcgttaacccgatttaacccggttggttaccggacccggttaacggaacccgtaggtttccgaacggttactaccggaacgtaacccggttaagtcccggttaacggg

SEQ ID NO: 193726 - DNA, 917 bp, Homo sapiens
  misc_feature: GYAE6OF02GPA0V.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcccgtgcggagacatcggtgatcgacccagtctccagtacttcccgtggtctggtcgttccgtcgtgggggcgacggacccggacccaaccactaccaactggaccgaaaccgtccgagtcaagtaactttacgtttttaacgaaccttacttacccaaacgttaaacggagtaagttagtttttaggtttacgggttttaacggttaaccctaaaacgtaacggaaacgtacccggtaacgggacccgaaccggtacccctaaccccggaaaaacgccgaacggtaccttaccgtttaaggttttaacggtttacggggtacccttaaacggtttccgtaacccggtttaccgggggttacccggtttcccccggggggttaccccgttacgggtaacccggttaaccgtttcccgggtcgggaccgttacgggtacggtaacgttccggtacggggtaaccttaaaaccgttttaccgtacccttaccgtaccgaaccccgtaacttaaccgtaaacgtccgtaccctagccgtacggtacttaacggtagtacgttcggcggtacgtaccgttagttttaacttagttaccggtacgtacgttaaccgtttaaagtttaacttttaaccgttacctttaccgtttaccttttaaccgttacctttaccttttacggtttacccgggtacccgggttaaccggggtaaccccgttgggtaccggttaacgggaacggtttacgtaccggtaaaggtcccggtttaacgtccggggttacgtaacccgg

SEQ ID NO: 193727 - DNA, 881 bp, Homo sapiens
  misc_feature: GYAE6OF02HZWQ0.11.76.G10.1.454.CMB.1.raw
  modified_base (127)..(127): a, c, t, g, unknown or other
  misc_feature (127)..(127): n is a, c, g, or t
  modified_base (180)..(180): a, c, t, g, unknown or other
  misc_feature (180)..(180): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtncctgcggagtacatcgtgatcgacccagtcctacagtacttcccgtggctgtntctcgtgggcgaggtaccgccaaccagtaccgaacgtggaccaacggtcctaggtacctaagtaactttacgttttaacgacttaccgttaccaagtaagtagtagttaagttttagttacggtttacggtaaccaaacgaggtaaccgccgacggacctacgtacccgtaacgaaaggccgtaacgtccttacgttaattttacggtcggtactcgttaacgttaccgtcgggggttaccgttccccggggtacctacggtaacccggttccgttaccgggtacggtacgtaacgggttacggtaaccgtttaccggggttaaaccgggtaaaacttttaaaccgtttttcccgaaccgttttacccggtaaacccgttaaacccttaactaaaccgttaaccgtttaaccggtaccccgggttaacggtaccggtaccgggttaaccgttaaggggtaaacgtaggtttaccgggtacgaccgtttaaacggtttaccgttttaaggtttacccgttaaggttcccgaaaacgtttaactaacgtttttaacttaaccgtttccttttccgttaaacccgttacgtttaacttccggttttaccgttccggggtaaccggacgggttacccgtaggtaccggtacgttaaacggtcttaaccggtaacggtaaccggttcgttacgggtaccgttccgg

SEQ ID NO: 193728 - DNA, 760 bp, Homo sapiens
  misc_feature: GYAE6OF02F9EDB.11.76.G10.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
tcagcgagagataccacgaccggtgctcgatttagtcactcatacaggggacaacaggcaggcaggggcagcaagatggtgttgcagacccaggtcttcatttctctgttgcttctggatcctcgtggtgcctggcggagaccagtcgtgatcgacccagtcctaccagtacttcccgnggctgtgtctcgtgggcgagccgccacntacaactgactaacgtccagtacaagtacttctttanacttacttaccaagtaagagtagttattttggtttaggtttacgtaaccaacgagtaacgccgacggaccncgtaccctaccgaagtcacgtcctacttagtttacggtcgggaccttaacgttcctacggttaccgggtaccggtttccccggggtaccctacggtaacccgtcggtttcccggtggtacgtacgggttaggtaccgttcgggtaacggtaaacctttaacgtttacccgtaccgtttacctaccgtaaccctacgtaacgtaaacgtaccgtcccgttacggaccgtacggtaccgtaaggaagtggttacgggtcgtacgtagttaccgtttagtttacgtacgtacgaagttacttaaactttagttaacctttaccgtttaccttaccgttacgttacgtttaccgtttacggtttacccgggaccggtaacgggtaccctagggtaccgtaggtaaccgttacgtacggtaacgtaccgttaacggtcggtacggtaccg

SEQ ID NO: 193729 - DNA, 750 bp, Homo sapiens
  misc_feature: GYAE6OF02FRG6W.11.76.G10.1.454.CMB.1.raw
tcagcgagagataccacgaccggtgctcgatttagtcactcatacagggggacaacaggcaggcaggggcagcaagatggtgttgcagacccaggtcttcatttctctgttgctctggatctctggtgcctgcggagacatcgtgatcgacccagtctaccagtacttccgtggtctgtcgtctcgtgggcgacgaccggccacctatacactcgacacgtccagtacaagtaacttcttttacgacttacttaccaactaaggaacgagttattttggtttaacggtttgtaaccaacgaacgaacgccgacggccgaaccgaccctaaccgaaacgccacgccttactagtttattcgggctacttccgtacgtacggggtaccggttcccggggtccctcggaccgttacgtttccggtcggacgtcggttacggtacgtacgtacgggtaacttaactttaccgtaccttcctacctactacttacgaacttccggccttacggacgtacggtacgtaacgtaaggtagttgggcgtaccgtacgtttctttagttttcggttacgttacgaagtttaacctaaatttaacttttaaacgtttccctttaccgtttacccgtttactaacgtttacccgtttagtttaccggtaccgggtaacggggtacccggttaacgggttacggacgggttaaccgtacgttaacggtaaccggttacgggtacttcgggttaacggcccgg

SEQ ID NO: 193730 - DNA, 699 bp, Homo sapiens
  misc_feature: GYAE6OF02HAFK0.11.76.G10.1.454.CMB.1.raw
  modified_base (180)..(180): a, c, t, g, unknown or other
  misc_feature (180)..(180): n is a, c, g, or t
  modified_base (497)..(497): a, c, t, g, unknown or other
  misc_feature (497)..(497): n is a, c, g, or t
  modified_base (529)..(529): a, c, t, g, unknown or other
  misc_feature (529)..(529): n is a, c, g, or t
  modified_base (563)..(563): a, c, t, g, unknown or other
  misc_feature (563)..(563): n is a, c, g, or t
tcagcgagagataccacgaccggtgctcgatttagtcactcatacagggagctacaacaggcaggcaggggcagcaagatggtgttgcagaccaggtcttcatttctctgttgctcgtggattctcgtggtcgcctggcggagacagtcgtgatacgacccagtcctccagtcttcccgnggctgtgtcctgtgggacgaggaccgccactagtacctaacgtcgactaacgtccagtcaagtaacttcgtttaacgacttactaccaagtaagagtacgtagtttttcgtagtttaccgaacaaacgtagaacgtcccgaggcctaacgccctaacgaaagtccgacgttcctacttaagtttagtcggactacgttaccttacggggtacgggttaccgtttcccgggcctaacgggtccgtacgtttccggaggcgttagggttccgaattcggtaacggtaacttaactttcgaccttcgactaactacgtanaacgttcgctcgacggtagctaaaggtacgtnttccggagttactgttaactttaagtgttaccgngtaacgtacttaaattacttaccgttaacctttccgtccgtttaccagttttacctttccggtaaagggcccggtaaagtacccggtaagggtccgttcggtaaacgtacggttggtaaacgcgtttaacggtcgg

SEQ ID NO: 193731 - DNA, 591 bp, Homo sapiens
  misc_feature: GYAE6OF02IXUJV.11.76.G10.1.454.CMB.1.raw
  modified_base (128)..(128): a, c, t, g, unknown or other
  misc_feature (128)..(128): n is a, c, g, or t
  modified_base (169)..(169): a, c, t, g, unknown or other
  misc_feature (169)..(169): n is a, c, g, or t
  modified_base (230)..(230): a, c, t, g, unknown or other
  misc_feature (230)..(230): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (541)..(541): a, c, t, g, unknown or other
  misc_feature (541)..(541): n is a, c, g, or t
tcagcgagagataccacgaccggtgctcgatttagtcactcatacagggggacaacaggcaggcaggggcagcaagatggtgttgcagacccaggtcttcatttctctgttgctctggatctctggtncctgcggagacatcgtgatgacccagtctccagacttcccnggctgtgtctctgggcgagaccgccacatcaactgcaacgtccagtcagtaattcgtttanactatccaactaagagagtatttgttagtttcggtaccaagagaacgaccagaccgacgcctacgaagcagctctaatttagttggctatctacgtcggacgtttccgggtccctcggaccgtagttccgtcggctagtggntcgtaggactaaacttccactcncactactacaatacgtcctaacgacggtctaggaacgtagtcgtaggactagtacgtttatttacgtgtacagtactaaagttattaacttacttacctttaccttacgtacttacttaccgtttacggtaccggacgggtaccgnggtacgtggtacgaagttacgaccggtaacgtacgtcgttacggcgtacg

SEQ ID NO: 193732 - DNA, 702 bp, Homo sapiens
  misc_feature: GYAE6OF02HYO0K.11.76.G10.1.454.CMB.1.raw
tcagcgagagataccacgaccggtgctcgatttagtcactcatacagggggacaacaggcaggcaggggcagcaagatggtgttgcagacccaggtcttcatttctctgttgctctggatctctggtgcctggcggagacatcgtagatcgaccctagtcctccagtacttccctggtcctgtcgttctcgtgggacgaggaccggccacctatccaactgacaacgtccagtacagtaattcttttaacgacttacttaccaagtaagagtagttatttgttagttttacgaaccaacgagaacgtccgaacggtccacgtaccctaacgaaacgcaagcctacttagtttagtcggactacgttcgttacggtcggggtacggtttcccggggtcctagtacccggtacgtttccggtggacgtaggtacggtacgttcggtagggaacttaaacgtttccacttaccactacctaagtacctaaacgtacgcccgttagaccgtaacggtaccgtaaggaactagttcggtacggactaggtttactttaattacgttcgttacgaacgttacgtaaattttacttacttacttttccgtactttacgtactttccttacgtttacggaccgggtaacgggccgttaggtcgtacggaactacggttagaacggttaacggtacgtcgggtggtacccg

SEQ ID NO: 193733 - DNA, 948 bp, Homo sapiens
  misc_feature: GYAE6OF02FRZ44.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctcgtggtcgccgtggcggagactatcggtgacgtcgacccgtagtcctaccgagtacttcccgtggtctgttcgtcgtcggtcgggacgacggaccggcccaacctacgtacctaaacgtcgtaaccgtaacggtacccgtaacggtacctaacggtaaacgtttaccgtttttaacgaacctttaacttacccgaaaagttaacggaagtacgtttagtttttaggtttaacggttttacggtaacccgtaaacgtaacggaaaccggtcccgaacgggtacccgaaccgttaacccccgtaaaccggaaaacggtcctaaccggtacccttaacgtttaacggttttacggttccggggacttaaccggtttaacccgggtaccgggttacccgggggttaccgggtttcccccgggggtacccttacggggtaaaccccgttccgttacccgggtacggtacgttaaccgggtcggtaaccggttccggttaaggggtaaaccctttaacgtttcccgtaacccttccgtaacctaacccgttaaatacccggtaacgttacccgtaccggttcggaaccgtacgggtacctagggtaacggttacgttcgggacgtccggttacgtttaacgtttagtttacgttacggttaaccgaggttaaccctttaaagtttactttaacccgtttaccgtttaccctttaacccggttccgttaacttacccggttttacgtccgggtaaccgggaacggttccggtacggtacgttaggtacgttaacgtacgggtaaccgtacggtacccgttggtcccggtaaccg

SEQ ID NO: 193734 - DNA, 695 bp, Homo sapiens
  misc_feature: GYAE6OF02ISJ5T.11.76.G10.1.454.CMB.1.raw
  modified_base (394)..(394): a, c, t, g, unknown or other
  misc_feature (394)..(394): n is a, c, g, or t
tcagcgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatcgacctagtcctccagtacttccctggctgtcgtctcgtgggcgacgaccggccaccataccaactgacaacgtccagtacagtaacttctttaagactactaccaagtaagagtagttattttggttagttacgtaaccaagtagaacgccgacggaccgtacgaccctaaccgaagcacgtaccttactagttttcgtggactacgtaccgttaccggtacgggtaccgtttccccgggtacncggtaccgtcgttcgtaggctaggtcgacgttacgacggtaactaacgtttccactactccaaacctagtaacacgtacgtcctaggactacgggtactaaggtaacgttcgtagggttacgacgttatttacgtttagttaacgttacgactagtaaacttaagtttaacttttacctaccgtttaccgtacgtttaaccgtactttaccggttttacgggttccgggaacccgggtaaggtacggttaccggtacggttagggaaccttcggaaccggtaaagtacccggttagtcggg

SEQ ID NO: 193735 - DNA, 747 bp, Homo sapiens
  misc_feature: GYAE6OF02IOICY.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctggcggacgactatcggtgactacgacccacgtcctccaagtaccttcccgtggtcctgtcgtcgtcgtgggcgaacggccggacccaacctatacctaactcgtaccgtaaccgtccaaggttaccaagttaacttcgtttaacgaacttaactacctaaacgtaaaggtacgtaagtttacgtttaggtttaacggttaaccgaaaccaaacggtagaaccgacctaacgaccctacgtaccctaaccgaaaggtccagtaccttagtttaatttacggtagtcctaacgttaccgttaccgggtacggtacccggtttccccgggtacctaccgtaccggtcgtttccgagtcgtaacggttgtacgtcggtaacgtaacttaccgttcacgtccactaacgtacgtaacaacgtcccgtactcgtacgaaccggttataacggtaacgttaggtcggtaacggacgttattaaggtttactacgttcgaagtaacgtacttaagtaactttcgttacctttagtaccctttagacttttaccgttacggttaccgcgggtaaacccggtagcggtcaggttaacacggtacaaggttccacggtagtcctacgg

SEQ ID NO: 193736 - DNA, 699 bp, Homo sapiens
  misc_feature: GYAE6OF02HY7DT.11.76.G10.1.454.CMB.1.raw
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatcgacccagtctccagtacttcccgtggctgtgtctcgtgggcgaggacgccacatacgaactgacaagtccagtcaagtattcgtttagacttattccaagtaagagaagtagtttagttaggtttacggtaaccaacgtagaacgtccgacggaccgagtaccctaccgaaacgcgagtcctctagtttagtcggtctagtctacggtcgggtacgttcccggggtcctacggacccgtagtccggtggactaggtacggacgttcggtagggtaactaactttccgtactcctaccgtaaccatacaaacgttcgccgtagaccgtacggtcgtaaggtaacgtagtcggtacggacgtaacggttactttaagtctttagaacgtaacgttactaaacgtttaatttaacttaccgtttacctccgtttaacccgtacgttaccgtttaccggttttacccggaccgggtaaacgggtacccgtacggggttacgttaccgggaacgtcgtaacggtaacggtaaccggtaacgttgggtaaccgtccgg

SEQ ID NO: 193737 - DNA, 812 bp, Homo sapiens
  misc_feature: GYAE6OF02JK2NB.11.76.G10.1.454.CMB.1.raw
  modified_base (136)..(136): a, c, t, g, unknown or other
  misc_feature (136)..(136): n is a, c, g, or t
tcagcgagagataccacgaccggtgctcgatttagtcactcatacaggggacaacaggcaggcagggcagcaagatggtgttgcagacccaggtcttcatttctctgttgctctggatctctggtgcctggcgganacagtcggtagctcggaccctagtcctccacgtacttcccgtggcttcggtatcgtccgtagggccggaacgtaccggcccgaacctagtaccgtaacgtcggactaaacggttccgaagttaccgaagtaaacttcccgtttttaaggaaccttacttaaccccgaagtaaacggtacggtaggttaaccttttaggttacggtttaccggtaacctaacgtaagggtaacgtacccgtacgggacctaaccgtacccgggtaacccaaaaggccgtaactaccgttacgtaacgtttacggttacggcctaaacgtccgttaaacgtccggggtaacgttcccggggtcttaaccggcgtaccgtttgggacgacgtacggtgtacgtgtacgggaaattaaccgttcgtacgtcctacgtaacctacgtaacgtacgttccgaacgttggaccgaggtttaccaaggtaacgttggtcgtacccggtaacgttgtctttaaagttcggttcgtactacgggtaattaacgtaaccttttacgttaacccggttctttaacggtaccgtacgttaccttacgggttaccgtacggtaaacccggggttctacggtaacggttagtaccgttaggtaacccgtagggtaaccttaaccggtggtacccgttacgg

SEQ ID NO: 193738 - DNA, 795 bp, Homo sapiens
  misc_feature: GYAE6OF02IP9YU.11.76.G10.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (660)..(660): a, c, t, g, unknown or other
  misc_feature (660)..(660): n is a, c, g, or t
tcagcgagagataccacgaccggtgctcgatttagtcactcatacagggggaggtctgagagaggacgccccgccctgggatttgcaggtattttcattgggtgctcaggactgaacaaagagaactcaccatggaactcgggctgagcgtggtctttttcttgtggtcttaattttaaaaggtgtccagtctacaacgagactactggaatcgtggggctacttgngctcggcgggtacggtccctganactctcctgtgcacgtcctcgtcggtacctttcccctgtacttctactttcactagtcggccttcgggtccccgaacaacggtcccgtaccggggaacggggggtatacggttaggggtacgggtcggggtcccgaccgtaccgtagttacgttaagtttaccggtaaacttttcgttaatacggtaacttaagttttggtagttacggaccgggttaccttacgggtaagggtaacggggtacttaactttacgtccggtaccgtcccgaagaacccggtaaagtaaccggtacgaaaacccgttaacccgttacctttaaccgttccctaacccgtaacctaaccttaaacccgacggaccgaacgtaaccgtaccgggaaacaccgtaaccggtaacctaaagtttnttccggtaaggtacgtaaccggggttagggttttaccgttttggggtacgggtacttaacggttcgtacccgttcgttgtcgtacggtccggtcggggaacctccgggtaacccttgggtaccctcccggtaccg

SEQ ID NO: 193739 - DNA, 754 bp, Homo sapiens
  misc_feature: GYAE6OF02G2JWR.11.76.G10.1.454.CMB.1.raw
  modified_base (702)..(702): a, c, t, g, unknown or other
  misc_feature (702)..(702): n is a, c, g, or t
tcagcgagagataccacgaccggtgctcgatttagtcactcatacaggggacaacaggcaggcaggggcagcaagatggtgttgcagacccaggtcttcatttctctgttgtctctggatctctggtgcctggcggagacatcgtgagtcgacccagtcctccaggtacttcccgtggtcctggtcgtcctcgtcggggctacggaccggcccacacgtacaactcgacaacgttccagtacagtaacttcgttttaacgacttaccttaccaacgtaagacgtagtagttttacgtttaaggtttcggtaaacccaaacgtacgaaacgtccgagggtacccacggacccctaccgaaaggtccacgtacttactaagtttacggtcgggcttaaacgtcgttaccggtcgggtaccgttcccggggtaccctacggtacccgtacgtttcccgggtaggtacgtaggttcgggaacgttacggtagggttaacttaaacggtttcctaactttccgtaaccctacgtaacttacaaacgttcggtaccgtgtacccgtaggtactaagggtaacctaggttcgacgggtctagttacctttagttaacgtttcaaggtcctattaaacgtttactttaacgttaccttacgttacccttaacgtctttacgttaccgtttcgaaccggttaacgggtacncgggtacgtaggtaccaggttaccgaacggtacgttaagttcgggtagaccg

SEQ ID NO: 193740 - DNA, 798 bp, Homo sapiens
  misc_feature: GYAE6OF02HUYQI.11.76.G10.1.454.CMB.1.raw
  modified_base (148)..(148): a, c, t, g, unknown or other
  misc_feature (148)..(148): n is a, c, g, or t
  modified_base (525)..(525): a, c, t, g, unknown or other
  misc_feature (525)..(525): n is a, c, g, or t
  modified_base (653)..(653): a, c, t, g, unknown or other
  misc_feature (653)..(653): n is a, c, g, or t
  modified_base (751)..(751): a, c, t, g, unknown or other
  misc_feature (751)..(751): n is a, c, g, or t
tcagcgagagataccacgaccggtgctcgatttagtcactcatacaggggaggtctgagagaggagccccgcctgggattgcaggtattttcagttgggtgctcaggtactgaacaaagagaactcaccatggaactcgggctgacgnttcggtctttttccgtggtggacttaagttttaaaaacgggtgtacctagttcctaacgtaacgtagtaacctacgtaggaacttccggtggggggaccgtacgttcggtcgtcgtcgggaccgggggtacgggtccccgtaggacgttacctaccgttccgtaggttcggaccaacgtccgttaccggtcggtaccgttccccgttggttaacttcctacgtttacgacgtagtccggtcggtaccgggtccgaacccgtaacggtccgtaccgggtaggggggataggttacgggtcggtacgggtccgtaccgttaccgtagtacgtaacttacgttaacgttaccttagtaacgtaacgttagtttacggtancggtacggtaccttaccgggtaggtaacggttaccggttattacgtcgtacggcctaacggacgtacgaacggtacgaaaccacttaaccttccgtacccgtactacgtaactaccgaagcgtaaccnggtaaggaaccgaacacgtaactaaacgttacgttgtacgtagtaccgggttaggtttcgggttcgggtaggacttacgttcggtccctggttacggngttaccggcggtacggccggaaccggtacgtcgaccgtcgttaaccc

SEQ ID NO: 193741 - DNA, 544 bp, Homo sapiens
  misc_feature: GYAE6OF02IZ961.11.76.G10.1.454.CMB.1.raw
  modified_base (240)..(240): a, c, t, g, unknown or other
  misc_feature (240)..(240): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagcgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagacttccctggctgtgtctcgtgggcgagacggccaccatcaactgcaagtccagtcagaatctttagactatccataagngagatttgttagtttgtaccaacagagccaggccagcctccaaagcagctcattatgggctagtctacgtcggacttccgggtccctgaccgatccgtgcagtcgagtcgtggactaattcactctacaccatacaacgtgacctgacgagcctagaacgntgtcgnacgtacttattagttgtctagactattaacttatactttcctcttacgtattccgttacgtttcgtccggtaagggtacccacgggtcgtacggtagtaacttccggaagtaacggtaacgttcggtcggttaccgg

SEQ ID NO: 193742 - DNA, 909 bp, Homo sapiens
  misc_feature: GYAE6OF02J1EDU.11.76.G10.1.454.CMB.1.raw
  modified_base (284)..(284): a, c, t, g, unknown or other
  misc_feature (284)..(284): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactcgggctgagctggctttttctgtggctattttaaaggtgtccagtctacaacgagactactggaatcgtgggggcacttcgtgctgccgggaggtccctgagactctcctgtgcagcctctggacttcccgtgattcactttcactntcggcctagggtccgaccaacgcgtccggaggggggatagttgggaggttcggggtccgcccgttccgagtacggtaactttcggtaaactttccgtttaagtcggtaaccgttaaagtttttggtaaacgttcgggtaacccgggtacctttcccggggtaaacggggtaaacggggggttcgttaaccgtttttaacccgtcgggtttacccggtcccggtaaccgtaacggaaccggtaaacggttacccggtaaaactaaacccggttaacccttttaaacctttacccgttacccctaaaccggttaacctttaaacccccgaaccgggttacccgaacccggttaacggtacccggtaaaccggaacccggtaaacccggggttaccaaaaacgtttttcgtttaaacccgtttcgggaaaccgggttaccggggtttaaaacgggggtttccgggtttttttacccgggggtacggggggttacgttaaaccggtttttcgggggtaacccgtttaccccggttttaggtaacccgggtttggtacccggggtttacgggggaaccccgttaccggggggtaaccccttcggggttaaccccgttacccggttccccg

SEQ ID NO: 193743 - DNA, 885 bp, Homo sapiens
  misc_feature: GYAE6OF02FMBLQ.11.76.G10.1.454.CMB.1.raw
tcagcgagagataccacgaccggtgctcgatttagtcactcatacagggagctacaacaggcaggcaggggcatcaagatggtgttgcagacccaggtcttcatttctctgttgctctggatctctggtgcctgcggagacatcgtgatcgacccagtctccgagtacttcccgtggctgtcgtctcgtgggcgagccggaccacgtactacacgtgactaacggtccaagtacaagtaatttaccgtttaagaccttactttaccgaacttaaaggagtaagtttagtttttagtttacggtttacggaaaccctaagtaacggtacgaccccgaaggtaccccgtaacgtaaccccgtaaccgaaaaccggtctaaaccggtccttactttaacgttttacggttaacgggtaccttaacgttaccgtttaaccgggtccgggttaacccggttttccccggggtaccccgtttacggacccggtttaacggtttcccgggaggtaacggtcgggtacggtaccgttaggtaccgggtaaacctttaaacctttacggcccgtttaacgacccgtaactacgtttaacccgaagttaccgtccgttaccggaccggttacggtacggttaagggtaaacggttcgtagggttacccgaagtttaccggttttagttaactttcggttacggtaccgtagtttaaacctaacgttttacttaaccgtttaccgtttcccgttacggtttaaccgtttacgtttacccgtttttaaccggggttcccggtaacccggggtttaaacggggtcccttacggggttaacggtttcgggtaaccttaccggtaacgggttaaccggtttacccggaggtttacccggg

SEQ ID NO: 193744 - DNA, 721 bp, Homo sapiens
  misc_feature: GYAE6OF02IHWOC.11.76.G10.1.454.CMB.1.raw
  modified_base (507)..(507): a, c, t, g, unknown or other
  misc_feature (507)..(507): n is a, c, g, or t
tcagcgagagataccacgaccggtgctcgatttagtcactcatacagggagctacaacaggcaggcaggggcagcaagatggtgttgcagacccaggtcttcatttctctgttgctctggatctcgtggtgaccgaacggggactagtcgtgatcgaacccagtcctccagtaccttccttatttcgtactctcgtggggcgaggacgggaccaccgatacaactgacgaacggacaacgaccaagttatttattttacacgtagtcctaccgaacaagtaaactaacttaactttacttcgtttacgtaccaacgtaaacgaaccgaaggaccacgtaccctaaccttaaacttactacttatttactccactatactagtcggccggtcccggtccccgggtacccgaccgtacttacgaggtcgacgacggtcgggtcgtacggactacgtactttccaccttacgtactaacaactcgacgtaccacggtccacggtacgaanacgtacgaagtaggtggttacggtttgttattacgtttcaactaacttattcgttactttacgtttacgttttacgtttacgggttcggtaccgggggtacggtcccgggtaaggtacggtacgtacgtaccggtaacggtacccggttaaggtcgggttaccggaccgttaccggacttaacccgttcttacggtttccgttaaccgttcccg

SEQ ID NO: 193745 - DNA, 737 bp, Homo sapiens
  misc_feature: GYAE6OF02HI6VS.11.76.G10.1.454.CMB.1.raw
  modified_base (144)..(144): a, c, t, g, unknown or other
  misc_feature (144)..(144): n is a, c, g, or t
  modified_base (299)..(299): a, c, t, g, unknown or other
  misc_feature (299)..(299): n is a, c, g, or t
tcagcgagagataccacgaccggtgctcgatttagtcactcatacaggggacaacaggcaggcagggggcagcaagatggtgttgcagacccaggtcttcatttctctgttgctctggatctctggtcgctgcggagacatcgngatcgacccagtctccagtacttccctggctggtcgtctcgtggcgacgacgccacactcactgacaactacgagtacagtactttcgtttaacgacttactaccaagtaacgagtagttagttttagttacggtttacgtaacaacgagtaacnccggaacggtcccaagtcccctaaccgaaacgacctacgtactacttaagtttacggtaggacctatccgtaaggttccggggtaccgttccgggtcctacggtaccgtacgttcggacggctaggttcgagttacgtaggtaaactaacttcacctcactacgtactacaacgtcgacctggaacgtacggcgtaagtaacgaggttcggtaggtaccgtatttcgttaacgtttgttaacgttacggaacgtttacttaaacgtttaatttaaccgtttaccgttacttacccttaacgtaaccgtttttcccttacggtttaccgggaaccgggttaaccggggtacccggttaaaggtacccggtaacggtaaccgtttaacggtaacccgggaaacggtttaaccggtacggttaccggggttacctaccggg

SEQ ID NO: 193746 - DNA, 809 bp, Homo sapiens
  misc_feature: GYAE6OF02JUAQP.11.76.G10.1.454.CMB.1.raw
tcagcgagagataccacgaccggtgctcgatttagtcactcatacagggagctacaacaggcaggcaggggcagcaagatggtgttgcagacccaggtcttcattctctgttgctctggtatctctggtgccgtgcggtagactatcgtgactgacccagtctcagtcttcctggtctgtagtcgtcgtcggggacgtacggaccggtcccaacctacttaccgaaaccgttcggacctaaacccgggttcctaccggttaccgaaacggttaaacctttaccgtttttaaacgacctttactttaaccccgaaagttaaaacggtagtaacgttaggttttagtttaaccgggtttaccggtaaacccaaacgtaggaaaccgccgtaacggggtaccccacgggttaacccctaaacgaaacggcctagtactactaacggtttagtacgggacctgtacgttacggttccgggtacgttccggggtaccctagacccggttacttccggtaggtcgtacggttacggacgttcggtaacgaaaccgttaacgtttacctacgttacctaccgtaaccttacgtaacgtaaaccgtacgtccgttaacggaccgtacggtactaggtaagtcgtcggtacggacttaacggtccgtttaagtttacgttaccgtaacgtactaacgttaacttaagttaacctttacgttcccttaccgttacttaccgttacttaccggttacggtaccgtacgggtacgtacggcgttacgggtataaccgtacgtaacggtacccgtagtacgg

SEQ ID NO: 193747 - DNA, 791 bp, Homo sapiens
  misc_feature: GYAE6OF02HGHP4.11.76.G10.1.454.CMB.1.raw
  modified_base (178)..(178): a, c, t, g, unknown or other
  misc_feature (178)..(178): n is a, c, g, or t
tcagcgagagataccacgaccggtgctcgatttagtcactcatacagggagctacaacaggcaggcaggggcagcaagatggtgttgcagacccaggtcttcatttctctgttgctctggatctcgtggtcgcctgcggagacatcgtgatcgacccagtcctaccagtacttcccgnggtctgtcgtctcgtgggcgacggaccggaccaccatacaacgtcgactaacgtccagtacgagtaacttcgtttagacttactaccaacgtaaagacgtagttagttttagttacggttacgtaaccgaaacgaaggtaacgaccgaacggtccacggtaccctaacgaaaggtccaacgtacctacgtagtttacgtcggactacgttacgttacggtccgggtacgttcccgggtaccctggtaaccgtcggttaccgtcggtacgtaggttcggtaacgttacggtacgggttaaaaccttaacgtttttccccgaaccttccgtaacccgtaacctaacgttaacgaaacgtaccgtccgtacgtacggtacggtacgtaacggttaaacgtacggtccggtagtacgtacgttaacgttttacgttacggtttacgtacgtaacgttaaacgttaaactttaacgtttaactttaccgttaccgtttacccgttaaaaccgttccttacggtttacccggtttaaccgggtacggttaacccgggtacgtaaccggtaccggttaacggaacttaccgtaacggtaaccggtaccggtacgttacgg

SEQ ID NO: 193748 - DNA, 822 bp, Homo sapiens
  misc_feature: GYAE6OF02F152W.11.76.G10.1.454.CMB.1.raw
  modified_base (175)..(175): a, c, t, g, unknown or other
  misc_feature (175)..(175): n is a, c, g, or t
  modified_base (488)..(488): a, c, t, g, unknown or other
  misc_feature (488)..(488): n is a, c, g, or t
tcagcgagagataccacgaccggtgctcgatttagtcactcatacaggggaggtctgagagaggagccccgccctgggatttgcaggtattttcattgggtgctcaggactgaacaaagagaactcaccatggaactgggctgagctggctttttctgtggctattttaaaaggngtccagtctacaacgagactactggaatcgtggggcacttcgtgctgccgggagggtccctgacgactctcctagtcgcacgccgtcgtggtcttccccttgacgtttccaacttttccacgtacgtcggtccgtcggggtcccgaccgaacgtccgtaccggtaaggggggactacggttcggaggttcgggttaccggccttaccgaacgttagtaaacgtttaccgaaagttttccgttaattcggtaacttaaagtttggtactgggaccggtaccgttcggtagggaaacggggtcgttaatttccgnggtacccggccgtacgaacgtaaccgtaaaggtaccggtaaaacaaaccttaccgtttaactacccttacccgaaccttaacgttaacccaaccgggtaccaaccgtaacgttacggaaaccgtaaccgtaccgggtaaacctaaagttacttttaccgtaggttacggtaaccgggttaagggttttacgggttttaccggggtttaacgggggtctttaagggttccgggtttaacccggttcccgttttaaccgggaccgttacggttacggtaccggggtcccgtaaaccggggtaccccgtttcgggtaaccgtacccggttaccccgg

SEQ ID NO: 193749 - DNA, 613 bp, Homo sapiens
  misc_feature: GYAE6OF02JGT09.11.76.G10.1.454.CMB.1.raw
  modified_base (122)..(122): a, c, t, g, unknown or other
  misc_feature (122)..(122): n is a, c, g, or t
  modified_base (153)..(153): a, c, t, g, unknown or other
  misc_feature (153)..(153): n is a, c, g, or t
  modified_base (170)..(170): a, c, t, g, unknown or other
  misc_feature (170)..(170): n is a, c, g, or t
  modified_base (258)..(258): a, c, t, g, unknown or other
  misc_feature (258)..(258): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (519)..(519): a, c, t, g, unknown or other
  misc_feature (519)..(519): n is a, c, g, or t
  modified_base (592)..(592): a, c, t, g, unknown or other
  misc_feature (592)..(592): n is a, c, g, or t
tcagcgagagataccacgaccggtgctcgatttagtcactcatacaggggacaacaggcaggcaggggcagcaagatggtgttgcagacccaggtcttcatttctctgttgctctggatctntggtgcctgcggagacatcgtgatcgacccngtcctccagacttcccnggctgtcgtctcgtgggcgaggaccggccaaccattcaactgacacgtccagtacaagtactttctttaagactattacccaagtaanagattatttggttagttacgaccaaacagaacgcacggtaccagccctaacgaagcacgtcctacttaattcgtcgggactatccgtacgtacggggtaccgttcccgggtacctcggtaaccgtcgttccgtggacctgggttacgnttacggaacgggtactaacgttcaccgtcctacgtaaccnttaacgattaccgctacggctggcttaaggaagtgtcggntacgacttnttagtacttgactacgataagttnttaacctctttcgacttacgtactttacctagttcgaacgggtctacggtcgtagacgttaagaccttacggntaacggacttggtacggtacc

SEQ ID NO: 193750 - DNA, 865 bp, Homo sapiens
  misc_feature: GYAE6OF02H4CPB.11.76.G10.1.454.CMB.1.raw
  modified_base (680)..(680): a, c, t, g, unknown or other
  misc_feature (680)..(680): n is a, c, g, or t
tcagcgagagataccacgaccggtgctcgatttagtcactcatacaggggacaacaggcaggcaggggcagcaagatggtgttgcagacccaggtcttcatttctctgttgctctggatctcgtggtacgccgtggcggagactagttccggtagacttacggaccctagtcctaccaggtaccttcccgtggtccgttgtacgttcgtcggtacggggcgaacggaccgccaacctagttaccaactcggtaccaaaccgttccaacggtacaagttaaacttcgttttaacgaaccttacttaacctaagtaacgaggtaacgttagttttacgttaggttttacggaaccaaacggaacgtaacgaccgtaccggacctacgtaacccgttaaccgaaaggaccgtacgtcgttaactttaacggttttaccggttacggggtacttaacggtttacgtaaccggttaccggggttaccggtttacccggggaccttacgggtaccgttcggtttccggcggtactaggggttacggtacgttacggtaaggtaactttaacgttaccacttccgtaacctaccgtaactaacgtaactcgtaccgtagccggtaacggtcgtaacggtagttacggtcggttacgacgttacgtttaacgtttacgtttacggttntaccggtaatttaaccgttagtttaaacttttacccgtttacttttaaccccttaccggttttacccgtaacgtttacggtttaccgggttttaacccgggacggggttaacgggtacccgttagggttaccggtgtaaaccggtcggtaacgtaacggtaacggttacgttcgggtacgtaccg

SEQ ID NO: 193751 - DNA, 865 bp, Homo sapiens
  misc_feature: GYAE6OF02IS48P.11.76.G10.1.454.CMB.1.raw
  modified_base (117)..(117): a, c, t, g, unknown or other
  misc_feature (117)..(117): n is a, c, g, or t
  modified_base (126)..(126): a, c, t, g, unknown or other
  misc_feature (126)..(126): n is a, c, g, or t
  modified_base (184)..(184): a, c, t, g, unknown or other
  misc_feature (184)..(184): n is a, c, g, or t
tcagcgagagataccacgaccggtgctcgatttagtcactcatacagggagctacaacaggcaggcaggggcagcaagatggtgttgcagacccaggtcttcatttctctgttgctntggatcttntggtcgtccgtggcggaagacagttcgtgatcgacccagtctaccgagtacttcccgnggtctggtcgttcttcggtagggcgacggaccgccaacctatacgaacgtcgactaacgtccgtaagttacctaaggttaactttacgtttacggaaacctttacttacccgaaagtaaaggtagtaacgtttaggtttttaacggtttaggtttaaccggtaacctaaacggaacgtaaaccggaccgtaacggacccaccggtaccccgtaaccgaaagtcctaagtccgtactttaagttttacggtacggacttacgttaccggtaccggttcgggttaccggtttcccgggtaccctacggtaccgtttacggttcccgggtacggtacgtaagggttcggtaaccgtttcggggtaacgggttaaacctttaacgtttacccgtaaccgttacttaccctaaacccggtaattaacgggtaacccgtttacgtccggtacggtaccgggtaacgggtaacgtaaggttaaccggtttacgggtaggaccggttaacgtacgttttacgtttatttccgggtattaaccggattacgttacggtttggtaacctaagggtctacccggttccgtaccgttaccggttacgggtcccggggtaccgggtacgggtaccggtacgggttacgaaccgtaggttcccggaaagttaaccgggtggttacggttaccggg

SEQ ID NO: 193752 - DNA, 569 bp, Homo sapiens
  misc_feature: GYAE6OF01B5Y7S.52.86.H09.1.454.CMB.1.raw
  modified_base (127)..(127): a, c, t, g, unknown or other
  misc_feature (127)..(127): n is a, c, g, or t
  modified_base (129)..(129): a, c, t, g, unknown or other
  misc_feature (129)..(129): n is a, c, g, or t
  modified_base (132)..(132): a, c, t, g, unknown or other
  misc_feature (132)..(132): n is a, c, g, or t
  modified_base (135)..(136): a, c, t, g, unknown or other
  misc_feature (135)..(136): n is a, c, g, or t
  modified_base (139)..(140): a, c, t, g, unknown or other
  misc_feature (139)..(140): n is a, c, g, or t
  modified_base (142)..(142): a, c, t, g, unknown or other
  misc_feature (142)..(142): n is a, c, g, or t
  modified_base (144)..(144): a, c, t, g, unknown or other
  misc_feature (144)..(144): n is a, c, g, or t
  modified_base (151)..(152): a, c, t, g, unknown or other
  misc_feature (151)..(152): n is a, c, g, or t
  modified_base (154)..(154): a, c, t, g, unknown or other
  misc_feature (154)..(154): n is a, c, g, or t
  modified_base (156)..(156): a, c, t, g, unknown or other
  misc_feature (156)..(156): n is a, c, g, or t
  modified_base (165)..(166): a, c, t, g, unknown or other
  misc_feature (165)..(166): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(181): a, c, t, g, unknown or other
  misc_feature (179)..(181): n is a, c, g, or t
  modified_base (183)..(185): a, c, t, g, unknown or other
  misc_feature (183)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
tcagcgcagtacgacacgaccggtgctcgatttagtgctatagacttgggtttgggggaagaggaagactgacggtccccccaggagttcaggtgctggagcgggcgtggcaaggcggcaatttagnanagntgnnatnntncnctgtgtnngngntgttctgtnntntagngcncngnnngnnngngngngngtggnggggngtgtcgngngtggcgtcgngacgctctcgtgtgcncgtctgtgtactctactctactactatanatcgcgcgtcgcgcgcgcgcgacgacggaggtcgnggtggtggtaggtacgtagtatacgtacgtagtagtagtagagacgtaagtaacgacgacacgacgtacgtacgtacggtacggacggtacgtacgtacgtacgtactacacgacgacgaacgaacgtaacgtaacgtaacgttacgttactaactaacgtaacgtaacgaacgacgtacgtacgacgacgtacgtacgacggacgtacgtagttacgttacgttacgtaggtacggtacggaacggtaaggtacgtacgtagtacg

SEQ ID NO: 193753 - DNA, 511 bp, Homo sapiens
  misc_feature: GYAE6OF01BDCBH.52.86.H09.1.454.CMB.1.raw
  modified_base (422)..(422): a, c, t, g, unknown or other
  misc_feature (422)..(422): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtcgttggtgatgtataaagacactgagaggccctcagggatccctgagcgattctctggctccaggtcagggacaacggtcacattggccatcagtggagtccaggcagaggacgaggctgactnttattgtactaatcaacagacaccattagtacttagtgtcttcggaactgccgaacctaaggtcaccggttcctgggtccagtaccccg

SEQ ID NO: 193754 - DNA, 577 bp, Homo sapiens
  misc_feature: GYAE6OF01CL397.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccacggcccctgtgttggtgatgtaataagacactgagacggccctacgagggactcccgtgacgcgtattctcgtcggctccgaggtcgagggacaacgggtcacgtagttcggaccagtcgaggtggacgtccgagggccaaggacgggacggaggctagaacttattagttgtacaatacaacgacgaaccacctagttacgtacttagtcgttacttcggaactgaccgaaccgtaggtaccgaccggttcgtcgggtccacggaccccgaaacggacccccaaccccagtccgtcctcgttcccg

SEQ ID NO: 193755 - DNA, 737 bp, Homo sapiens
  misc_feature: GYAE6OF01ACYLP.52.86.H09.1.454.CMB.1.raw
  modified_base (370)..(370): a, c, t, g, unknown or other
  misc_feature (370)..(370): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtgggggggctggtccaggctgggaggtccctgagactcgtcctgtgcagcctcgtggattccaccttcacgtaccccatagaaatcgacacgtcgggtccgccgaggctccgaggcgaaggggctgggaggtggggngcgtagttatacgttcctagtcggagttagggaaacgtacgtaaagtaacggacctaaccgttaaccgacgtaaggtaccggttaccgggttacgggaaacggggtccccgtaagtttaccggaacccgttacgtacccgtacccgtaaggaaccgtaaccgtaaacccgttacgggaaacgttaaacgtttaacccgggtttaccttaaccgttaaaccgtaaagttacggtaaaaccgacggtaccccgtaggtaacggacgtaccgttaagggaccggtaaccgtaccgggtactttaacgttcggtttaacgtggttacggtacggtaacggtaaccgggtacctacggtaacgttaacccgg

SEQ ID NO: 193756 - DNA, 495 bp, Homo sapiens
  misc_feature: GYAE6OF01DURWQ.52.86.H09.1.454.CMB.1.raw
  modified_base (400)..(400): a, c, t, g, unknown or other
  misc_feature (400)..(400): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
tcagcgcagtacgacacgaccggtgctcgatttagtgctatagacttgggtttgggggggagctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcagggatcccgtgagcgattctctgggtcctccgaggtcgagggacaacggttcacattggccatcagtggngtccgaggcagaggacgaggctgacttattattgtacaatcaacagacacctattggtacttatgtcttgactgcacagtcacgtnggcngaccc

SEQ ID NO: 193757 - DNA, 947 bp, Homo sapiens
  misc_feature: GYAE6OF01BIORD.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgtatacgtgtctttaagttcggtaaccaggtaccaaggaaacggccccggggacccacgggtcccccgttggttggttcgggtggtaacgttaggttaaagtaaaacggaacctaacgtggaacggacggtacccccgtagaacgggggtacctccccgtaggaacggtaccgttaatttccgtcggtcggtcccttacccggaaggggttaccggaacggggtaaaccgtaaacccggggttacaaccgttaacggtttcgggaccctaagttaccgggaacgggttcggggtaaccgttccccgggaagggtacccggaaaggggaacggggtaacccggggaacgggtcccgttaacgggttaacgttttaatttttaacggtttccgggtttaaacctaaacgtttaacccgaaaaccgtaaacggtaaccccgtaaacccgtttaacggtttttaaccgggtttaaaccttttaggtttaccgggtttacccgtttaaccggggtaaaccgttacggtaaccccgggttaaaaccccggtaacggggtttacccccgaaacccccgggttttaccccgggttaccggggttaaaccccgaacccgggaaacccccccgggaaaacccgggtaaccccccctaaaaccccccgggttacccgttaacccgggttaccccttaacccggttttacccccccggg

SEQ ID NO: 193758 - DNA, 577 bp, Homo sapiens
  misc_feature: GYAE6OF01DX7NA.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccagggcgtgggaggtccctgacgactctcctgtgcagcctctggattcaccttcagtacccatcgaaatgcacgtgggtccgccaggctccgaggcaaggggctggagtgggtgcagttatatcctatgatggagcaaataagcactacgcagagtccgtgaagggccatgacatctcagacgacaacgtcgaagtaactcggttacttactaacaaagttcgaaacagacctggaagagacgtacggtaaggaccgaacgggtacttaagtttcgtttttaaccgtggttacggtacggaaggaggggtaaacctcggtattaaaccgg

SEQ ID NO: 193759 - DNA, 621 bp, Homo sapiens
  misc_feature: GYAE6OF01C42PG.52.86.H09.1.454.CMB.1.raw
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtgggggggctggtccaggctgggaggtccctgagactctcctgtgcagcctcgtggattcacctttcacgtaccccatagaaatgctacgtcgggtccgccaggcctccgaggcgaggggctgggagtgggtggctagttatacttcctagtgataggaagacaaagtagcacgtacgcgaggacgtccggtagaacgggccgtagttacgaaccatcctaccgaagacgaacaacgtacggaaagtaacgttaccggtttactttacgtaaactaaagtacgaactacgtaccgtaggaacgtacgacgtagggaagaccggtacggtctttaacgttcgttttacgtggtacgtacggaagggtaggtaacctggtaacgttaacg

SEQ ID NO: 193760 - DNA, 726 bp, Homo sapiens
  misc_feature: GYAE6OF01B7J92.52.86.H09.1.454.CMB.1.raw
  modified_base (104)..(104): a, c, t, g, unknown or other
  misc_feature (104)..(104): n is a, c, g, or t
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (570)..(570): a, c, t, g, unknown or other
  misc_feature (570)..(570): n is a, c, g, or t
  modified_base (623)..(623): a, c, t, g, unknown or other
  misc_feature (623)..(623): n is a, c, g, or t
  modified_base (676)..(676): a, c, t, g, unknown or other
  misc_feature (676)..(676): n is a, c, g, or t
tcagcgcagtacgacacgaccggtgctcgatttagtgctatagacttggggtttggggggggagcctagctgtgctgtgggtccaggaggcagaactctgggtntctcaccatggcctggactccctctacttcctcccctctcacctctcgngcactaggctcgtgacgtcctctagngagctagaccacgacgccctacccggttggtgtacacggttccgaccccgaaggaccacggacggccgaagtcctaccaccgtgccgttagngggaacagtcgactagtaccgaacctaaaacgtnttagtcgttacgtttaaggtaccgacggacgacggaaagggaccccgggcccggaccgtccggttcctgggtttgttaggaagtaagttaacgtaaacgtaaacggacctaggtaagggaccggtccggttaccgacggtaacggtacctcggtaacgtaccgtcgtttacggttcgtaccgtcggttccgaacggttaacggacggaacggtaccgacggtactaggttcgacgacaagtcgggttaacgcgtacggcgaaggngtaacgggcgacgtagtcgtaatacgtttgattacggaactacgtaaaccganaaccgattaccgttaggttactttaaccgtgttaacccgttcggaaaggtccngtaacccggaacttcggtccgtacggtgaccggtaccaacccggtacccg

SEQ ID NO: 193761 - DNA, 558 bp, Homo sapiens
  misc_feature: GYAE6OF01ETJZ0.52.86.H09.1.454.CMB.1.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (426)..(426): a, c, t, g, unknown or other
  misc_feature (426)..(426): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattgtacagcagacgccggccacggccctgtgttgngatgtaataagacatgagacgcctgagggtactccctagagctattctcgtcgcctcgaggtcaagggtaccacgtcactagtcggaccagtcgaggtcggagtcccgaggcaaggacggacgnggctagtactagttatacgtacaatacaaacgtagaccactacgtttggttaaccttagttacgttcgttaccggtactcggacgtaacccgtaacggtccctacccgtcggtcggtccaacggtaccccgg

SEQ ID NO: 193762 - DNA, 718 bp, Homo sapiens
  misc_feature: GYAE6OF01CQLTY.52.86.H09.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttcctccccctcctcactctctgcacaggctctggacggcctcctatgagctgacacacgcccacccgtggtgtcagtccgtaccccaggacaggacgccaggactccacgtgctcgnggganagtgacagttacggaacccaaaacgtattaagtgtacctttagtacggtaaccaggaccgaaggtaaccggccccgggacctaccgggtccccgttggttggtttaggagtaagtaacgttaaagaaaacggcctaacgaggacggaccgggccctacggaacggtacctccggagacggtacgtctttctacggtcggtacccgtacgacgggtaacgacgggtaacctacgggtacaactgtcgactatcgtaaggtgacggtaccgaggtacgaaggacggagacgcgtaaggtaactttagtagttacgtaacaacgtaacaaacgacggtaacctaaccgttagtttacggttaaacttaggttacgggttacccgtaagggtaaccctcggtaacccgtaaaccgtaaccgggtacccggtacccgttacggaccggggtaccaaccgaaaccccccggg

SEQ ID NO: 193763 - DNA, 693 bp, Homo sapiens
  misc_feature: GYAE6OF01C80SV.52.86.H09.1.454.CMB.1.raw
  modified_base (189)..(189): a, c, t, g, unknown or other
  misc_feature (189)..(189): n is a, c, g, or t
  modified_base (331)..(331): a, c, t, g, unknown or other
  misc_feature (331)..(331): n is a, c, g, or t
tcagcgcagtacgacacgaccggtgctcgatttagtgctatagacttgggtttggggggaagaggaagactgacggtcccccaggagttcaggtgctgggcacggtgggcgatggtgtgacgttttgtcaacgaagatttgggctcaactctcttgtccaccgttggtgttgctgagctgggttttccncgttgctcttttaagaggcgtccagtgtcaggtgcagctggtggagtcgtggggggggctggtccaggctgggaggtcctgagactctcctgtcagtctctggtattcaccttaaataactatggcatcgagctcgggtccnccgaggctccgagggaagggctgggagtgggtctcgtatttatcgaaggtggttaacgtgggtggtagacactatacgtacgcagtaccgtccggtggaacggggtccgttacaccgtacttaccgtaccaaaaaggacctaacgttaacccgaaacgtaaactaccggtacctttaggtaacttttaaacgaaaacgttagaaaacctaggtacccttagggacggaacggtacccgggaagggaacccgtaacccgggtaccgttaagttaacgtttaccgttaggtaggttaacggaaaagtaccttacctacccgtaccgttaccttccccgtcccccgtttaggtcgttttaacggg

SEQ ID NO: 193764 - DNA, 789 bp, Homo sapiens
  misc_feature: GYAE6OF01AT26P.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttgtccaccttggtgttgctgagctgggttttcctcgttgctctttaagaggcgtccagtgtcaggtgcagctggtggagtcgtgggggggctggtccaggctgggaggtccctgagactctccgtgtgcagcctcgtggtattccacctttcacggtaccccatagaaatgcacgttcgggtcccgccgaaggtcctaccgaggcgaaacgggggtcctagggagtggggtacggactaggtttaactacgttacccgtaagtacgtacgttaggggaaacgaccgtaaaagtaaccgacctaaacgttaacccggaccgtaaacgggtacggttacccgggtaacgggtaaacgggggtaccccgttaaacgttaaccggaaacccttaacgttacccgttaaccccgaaaggtaaacgtaaacccgtaaacccggttaacggtaaaacggtaaacggttttaacccgggtttaccctttaaaccgttaaaccgtaaaacgttacggaaaaccgtaacggtaccccgttaaggaacggtacgaccgttagggaacgggaacccgtacggtactttaggttacggttttaacgtcggtacgtacgggaaggtaacgggtaccgtacgtaacgttaaccgg

SEQ ID NO: 193765 - DNA, 763 bp, Homo sapiens
  misc_feature: GYAE6OF01E23QR.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccacctgctctggagatgcattcgaccaaaccgtatatgtcttattcggtaccagcagacgccgggccacggccccgtgtgtttcggtgtagtgtaataaagacacgtggaagacggccctacgacgggactcccgtagacgcgtacttctcgtcggcctccgacggtacggaacgggaaccgtaacggtaccaacgttacgttcgggaccctagtacgagggttacgggaccgttccggaaggtacggaaggggtaacgggaaccggtaacggggaccttacgggaacctttaagtttaacgtttacggtaaacctaaagttaaccaaaaccggtaaccgtaacccgtaaaccccgttaaggtttaacgggttttaaaccttttaagtacccggtttttaccggtttaacccgggttaaacccgttcgggtaaccccggtaaaaccccggtaaaccggggtttacccccgtaaacccccggggtttccccgggttaccgggggtaacccgtaacccgggttaaacccccccccggg

SEQ ID NO: 193766 - DNA, 753 bp, Homo sapiens
  misc_feature: GYAE6OF01BJSJ0.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttgtccacttggtgttgctgagtcgttgggtttttcctcgttgtcttacgtttttaaaggacggccgttccgaggttgtcgagggtgccgagtcgtgggtgggacggttcggggtggggggggtccgttgggtaccgagggtccgtgggggtacggtcccgtaggacgtaccttcgttccgtgtcgcgacgtccgttcgtggtacttcctaccgttacacgtaccaagtacgaaagtcgcgtacggtccggtccgcggacgtccgtacgaggacgaagggcgtagggaggtgggtagtcgtaagttactacgtaccttagtaggtagtaggaacaacgtaacgtaacgtaccgtaacgtacgtacgaggtacggtaccggtagggaacggtaccgtagttaccgacctacgtcctaacgaaggtacaacgtaaccgtaggtaacgtaacgttacgttactaacgtaaactaacgtaagtaaccacggtccgtaggagtacggtaccgtagggaaccggtacgtacggtactttacggtttacgggttacgtagggacggttaacggtaacgggtaacgtaaccggttacgtaacgtaaacccggg

SEQ ID NO: 193767 - DNA, 831 bp, Homo sapiens
  misc_feature: GYAE6OF01EC2U9.52.86.H09.1.454.CMB.1.raw
  modified_base (103)..(103): a, c, t, g, unknown or other
  misc_feature (103)..(103): n is a, c, g, or t
  modified_base (127)..(127): a, c, t, g, unknown or other
  misc_feature (127)..(127): n is a, c, g, or t
  modified_base (302)..(302): a, c, t, g, unknown or other
  misc_feature (302)..(302): n is a, c, g, or t
tcagcgcagtacgacacgaccggtgctcgatttagtgctatagacttgggtttggggggggagcctagctgtgctgtgggtccaggaggcagaactctgggtntctcaccatggcctggactccctntacttcctcccctctcactctctgcacaggctctgacgcctctatgagctagacacacgccctaccgttcggtgtcacggttccgaccccgaaggaccaggtaccggcctaaggactaccgaccgtgtcctcgtagggactactcgactacgttaccggaaccctaaaaccggtnttaacgtcgttaaccgtttaacgttaccggtaaccgaacggtaccgaacggtaaccgggcccgggtacccggtaaccggtccccgtttggttacggtttaggtacggtaacgtttaacggtaaaacgttaaaacggacgttaacgtgggaaacggaccggttaccgtaacggaacggggtacctaccggtacggtaacggtcttacgttccgtcggtacggaccgttacggacggttacggaacggggaaccttacggtactaacgtacggttacgaccgtagacgtaggtacgtaaccgtcgacggaagtacgggacgtaacggacgtacgttacggtaactttagtacgttacgtaacgtaactacgtaaacgaaccggttaactacgttaaacgtttcggttaaactttggttaccggttacccggtttaagaaccggttaacgggtaacccccggaaacggttaaccggtttaccgaccccgggtttacggtaccgggttaaaccgacccccgtaaaaccccggg

SEQ ID NO: 193768 - DNA, 692 bp, Homo sapiens
  misc_feature: GYAE6OF01CVFW3.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagttttgtcacaagattgggctcaactctcttgtccaccgttggtgttgctgagtctgggttttcctcgttgcttacgtttaagaggcgtcctagtgtacgaggtgcaggcgtgggtggaggtcgggttggggggggctcgggtcgagggcgtgggtacgggtccctggagtacttcgtccgtgtacgcgtacgtcctgtcggtactctaccttcacgtaccctatagaactcgacctacgtcgggtccacgacgtcctacgacggacggaacgggtcgagggtaggtcgggtggtactaggttactacgttaccagtaggtacgtaggaacacgaaagtacgactacgacgcgaacgtacggtccgaggacggcctagacgtacacgtaccacggacgaacggaactaccgtaacgtaagaacgttccggttaactaacgtaacgaaagttcgaaacgtcgtacctaagggtacgacggttacgaccggtaaggtaccgtaaccgggtatttaacggtttcggttaacgttggaccggtaaggaacgggtaaggttacctaggtacgtaaccgg

SEQ ID NO: 193769 - DNA, 843 bp, Homo sapiens
  misc_feature: GYAE6OF01CML3I.52.86.H09.1.454.CMB.1.raw
tcagcgcagtacgacacgaccggtgctcgatttagtgctatagacttggggtttggggggggagcctagctgtgctgtgggtccaggaggcagaactctgggtgtctcaccatggcctggatccctctacttcctcccctcctcactctctgcacaggctctgacggcctctatgagctgacacacgcccacccgtggtgtcagtcgtcccaggacaggacgcagatccaccgtgctcgtggagatcgactattcgaaccaaaaccgtattaacgtgttactttaagtttacggtaaccaagacgacggaaacgggccccggggaccgaaccgggtcccccgtttgggttcggtttgggtaggtaacgttaagttaaacgtaaaacggaacgtaacgttacgggaacggtaccgggtaccccgtacggtaacgggtacccttacccggtaggacggtacgttaccgtttccgttcggtcgggtacctccggtaacgggttaccggaaacggggtaccgtaaaccgggttctaaccgtacggttacggaccctaagttccgaagggttacgggaccggttaccggaagggccgaaacgggtaacgggaacggtacgggtacgtaacggttactttaagtttacttacggtaactaaacgtacaaaacgtaccgtaacctaacccgttaggtttaaccggttaacgttttacgttaccggtttaccggttaaccggtaaccgttccgggtaaaccccggtaaacccggttaaaccgggttccccggttaaccccgggttcccgggttaccccggggttaacgtaccccgggtaaaaccccccggg

SEQ ID NO: 193770 - DNA, 1139 bp, Homo sapiens
  misc_feature: GYAE6OF01BO9W3.52.86.H09.1.454.CMB.1.raw
  modified_base (64)..(64): a, c, t, g, unknown or other
  misc_feature (64)..(64): n is a, c, g, or t
  modified_base (105)..(105): a, c, t, g, unknown or other
  misc_feature (105)..(105): n is a, c, g, or t
  modified_base (131)..(131): a, c, t, g, unknown or other
  misc_feature (131)..(131): n is a, c, g, or t
  modified_base (212)..(212): a, c, t, g, unknown or other
  misc_feature (212)..(212): n is a, c, g, or t
tcagcgcagtacgacacgaccggtgctcgatttagtgctatagacttggggtttggggggggancctagctgtgctgtgggtccagggagcagaactcgtgggtntctcaccagtcggcctggactccctntacttcctcccctctcactcgtctgcacaggtctcgtggacgtccttctatgacgctacgacacacgcccacccgttggtntcagtcgacccaggacaggtaccgcaggtactccgaccgtcgtccttgtacgggactcgtacgctacgttaccgaacccgtaaacgtatacgtacgttacgtttaacggttaccggtaccgacggtacggaacgggtaaccgggccccgggtacccggtacccggtacccggttgggttacggttagggtacgtagtttaacgtaaagtaacggtaacgtacggtacgggtaacggaccgggttaccccgtaacgggtaaccggtaacccgtttcccggtacgggtaaccgttaccgtttaaccggtttccggtaaccggtttcccggggtaacccgtttaccgggtaacccgggttaaccgggtaaacccgggggttaaaccccgttaaaccgggggttacccttaaacccgggtttccgggtttaaccgggtaacccgttacgggtttaaaaccgggttaccggggttaacgggttaacccccggtaacggggtaacggtaacccggggtaaacggggtaaacccgggggtaacggttacgggttaacccggtttaaccgggttaaacgtttttaacggtttttaacccgggttaaccgttaaaccggttaaaccgtttaaaccgaaaaccggggttaaccctaccccttttaaacggggttaaacccggttttttaaaccggtttaaaccgggtttttaaccccggttttaacccgggggttttaaacccggttttaaaaccccggggggtttaacccgtttaaaacccggggttaacccccccggggttaaaacccgggggttttaaaacccccccgggttcccccgggttttaaaaacccccgggggtttccccggggggtttaaaaccccgggttaacccccgggttaaaacccccccggggttaaaaaccccccccgggg

SEQ ID NO: 193771 - DNA, 870 bp, Homo sapiens
  misc_feature: GYAE6OF01EWS5A.52.86.H09.1.454.CMB.1.raw
  modified_base (197)..(197): a, c, t, g, unknown or other
  misc_feature (197)..(197): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttcctccccctctcactctctgcacaggctctgaggcctctatgagctgacacagccacccgtcggtntcagtcgtaccccaggacaggaccggccaaggactccaccgtgctcgtggagtatgctattcgaaccaaaccgtatagtgtacttacgttacggtaaccgagacgaaggaaccggcccgggacccgaccgggtccccgttgggttaggtttcgggtagtagttacggttaaagtaaaacggactaacgtggaacggaccggtcccctaacggacggggtacctcccgtaggacggtccgttaacttccgtcggttccggacctaccggtacgggtaaccggacgggtaaaccgtaaccgggttacctaacgttacggttaccggacctaacgttaccgtacgggtacgggtaaccggttacccggacgggtacggaaacgggaaccggggaaccggtacggggtaaccgttaacggtaaccgttttaaacgtttaacgtttacggttaaacctaaaacgtttaacccaaaacggtaaccgtaaacccgtaaccgttacggtttttaacggttaaacccgtttttacgtttacccgggtttaaccggtttaaccggggtaccgttaaccggggtaaccccggtaaacccggttaaaccgggtttacccccggttaccccgggtttacccggggtacccgggtttacccgaaacccggggtaaaacccccccggg

SEQ ID NO: 193772 - DNA, 727 bp, Homo sapiens
  misc_feature: GYAE6OF01B3T4E.52.86.H09.1.454.CMB.1.raw
  modified_base (250)..(250): a, c, t, g, unknown or other
  misc_feature (250)..(250): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttcctccccctcctcactctctgcacaggctctgacggccctcctatgagctagaccacacgcccacccgtcggtgtctagtcgtccccaggacacgaccggccaggactcacctgctcgnggagatgctagttcgaccaaaccgtatagtgtctttagttcggaccagacgaaggaacggcccggccgaccggtccctaggttggttggtagattagtaaactaaaggaacagtaggaggaccggtacccgttacggacgggtactcccggtaggacgtaccgtatttccgtcgtacggtccgttaccggtacgggtaccggacggggtaaccgtaaccgggtcgtaacttagggttcccggaccgtaacgttacggaggttacgggtaaccgtacccgggtaggacggtaacgggaacgggacggaacggtcgttaagtaaccgtttaatttaacgttacgtaacttaactaaccgaaacgaacgtaaccttaacggtagtttacgttaacgtttagtacggtttccgttacgaacggttccggaaccgtaaccgtacggtccaaccggttccggcggtaccgaccgtaaccccgg

SEQ ID NO: 193773 - DNA, 724 bp, Homo sapiens
  misc_feature: GYAE6OF01CGJ0M.52.86.H09.1.454.CMB.1.raw
tcagcgcagtacgacacgaccggtgctcgatttagtgctatagacttgggtttgggggaagaggaagactgacggtccccccaggagttcaggtgctgggcacggtgggcatgtgtgagttttgtcacaagatttgggctcaactctcttgtccaccttggtgttgctgagctggttttcctcgttgcttcttttaagaggcgtccagtgtcaggtgcagcgtggtggagtcggtggggggggcgtggtccgaggcgtgggacggtcccgtggacgtacctcttcccgtggtcgccgacgtccctcgtggactttcctacccttcacgtaccccaatacgtaaatcgcgtacgtcgggtcccgccgaggtcctccgaggtacgaaggggcgtgggaggtggggtggacgtagttaatacgtacctagtaggagtacggaagtacaaagtaacgctaacgtcgacaaggtacgttccggaggaaacgggtcccgtaagtaccgacacttccgtaaccaaggtaccgaaacgtaaccgtaacggaaacgtaaacggtttacccggtttacctttaaccaaacgtaaacgttgaaaacccgtagtacccgtaggaacggaagtaccgtaagggaaccggtaacggacccgttagttaacgttttgtttaccgtaggttacgggacggtaaacgggaagggttaaaccgttcggaaagtttaacccgg

SEQ ID NO: 193774 - DNA, 756 bp, Homo sapiens
  misc_feature: GYAE6OF01E5270.52.86.H09.1.454.CMB.1.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttctcccctcctcactctctgcacaggctctgaggcctcctatgagctgacacagccacccgtcggtgtcagtcgtccccaggacagacggccaggactcacctgctcgtgganatgcaattcgacccaaaaccgtntatcgtcttaagttcggtaccagcgaagaacggcccggcgacgtccctgtgttggtagatagtaanaaacgacaacgtggacggtacccgtccgtacggacgtaccgtcgaggacgtactacgtttcgacggtccgacccggtacgtaaccgggacggaaccggtaaacgggttacgaccgtaacgttcggtaccggtactacggtaacggtcgggtacgggtaacccggtacggaacgggtacggaacggggaaggtaccgggtaacggttacgtaacggtttaaacgtttaagtttcggttaaacctaacgtaaacgtaacctaaaccggaactaaccctaagtttacgtttacgggtttaactaccggtttacgtttaccggtaaccggttacccggtaacggtacccggttaaaacccgggtaccggttaccccggtaccccggttacgggttacccgaaacccggtaaccccggtaaacccccgg

SEQ ID NO: 193775 - DNA, 657 bp, Homo sapiens
  misc_feature: GYAE6OF01EGJX5.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagtttttgtcacaagatttgggctcaactctcttgtccaccttggtgttgctgagctgggttttcctcgttgcttcttttaagaggcgtccagtgtcaggtgcagctgggtggagtcgtggggggggcgtggtccaggcgtgggagtccctgagactctcctgtgcacgcctcgtggattccaccttcacgtaccccatagaaatgctacgtcggggtcccgccgaggcctccgagggacgaagggggctgggaggtggggtcggcgagttatatcctataggagtagggaaagactaaagtaaacgactaaccgtaacgacgaacggtacggttacccggtaggaaacggggccctaagttcgaacctaactcctaccgaagaacgaacaacgtacgaagtaacgttacggtttaccttaactaacgtaaagtacgaaacacgacctagacgagacgtaggaacggaccgtacggtacttagtttcggttttacgtggtaggacggaagggtaacgggaacgttacgtaagttaaccgg

SEQ ID NO: 193776 - DNA, 652 bp, Homo sapiens
  misc_feature: GYAE6OF01A7JZB.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtgggggggggcgtggtccaggcgtggggacggtccctggagactctcctgtgcaggcctctggacttcacccttcagtaccccataggaaatcgcacgtcgggtccgccgaggcctccgagggccgaaggggctgggagtggggtggcagttatactcctagtgagtagggaactacaaagtaacgcaacgtacgcagacgttccggtaggaacgggccgtagttcgaaccgtatccgtacagtgaaccaacgtacgaagtaacgttacggttactaacgtaactaaacgtacgaaacgtcgaccgtaggaagcgtacgtaggacggtaaccgaccgggttacttaaggtttacgtttttaaccggtggttcggaaccggaacggggtaacgggttaacgtccggttaacgttaaaccgg

SEQ ID NO: 193777 - DNA, 823 bp, Homo sapiens
  misc_feature: GYAE6OF01EIMSH.52.86.H09.1.454.CMB.1.raw
  modified_base (64)..(64): a, c, t, g, unknown or other
  misc_feature (64)..(64): n is a, c, g, or t
  modified_base (104)..(104): a, c, t, g, unknown or other
  misc_feature (104)..(104): n is a, c, g, or t
tcagcgcagtacgacacgaccggtgctcgatttagtgctatagacttggggtttggggggggancctagctgtgctgtgggtccaggaggcagaactctgggtntctcacatgcctggactccctctacttcctcccctcctcactctctgcacgaggctcgtaggacgccctctagtgacgtctacgacacgacgccctacccgtggtctcgacgtccgtacccgaggaccacggaccgacaggtactccgacctgcctgtacggagctgactagtaccgaacccaaacggttatagttcgtactttaagtacggaaccaggcgaacggacccggcccggaccgtaccggtcccgttggtcggttaggtcgtaagtacgtaaagtaacgacgtacgtacgggacggtacccgtccgtaacgacgggtacctccggtaagcgtacgttcgttcgtcggtacgtccgtacggtacggtaccggaacgggtaacgtaaccggtacctacgtacggtcgtacttagacggtagggtacggaaccgtacgggaacggtacggaacgggtaccgggacggtacggtaaccggtttgtaacgttttaacgtttacgtaacggttaaccgtaaaccgtaaccgtaacgaaaccgttaaaccgttaacccgtttaaggtttaaccgtttaaaccgttacgtttaaccggtttaacccggttaacgggtaaacccgtccggtaaaccccggttaaacccgttaccggggttaacccccgttacccggttccggggttaaacccggtcccgtaaaaccccgggtaacccccgg

SEQ ID NO: 193778 - DNA, 636 bp, Homo sapiens
  misc_feature: GYAE6OF01EMMH4.52.86.H09.1.454.CMB.1.raw
  modified_base (240)..(240): a, c, t, g, unknown or other
  misc_feature (240)..(240): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (503)..(503): a, c, t, g, unknown or other
  misc_feature (503)..(503): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttcctcccctcctcactctctgcacaggctctgaggcctcctatgagctgacacacgcccaccctggtctcacggttcgtccccaggaccagccggcccaggactcacctncgtctagggatacgtgtaccgattcgaacccgaaaaccgtataacttggtcctttaagttcggtaaccagacgaagaaccgggcccgggccgacccgggttccctggttcggttggtagagttacgtaaataaacgactgtagacgcggtcctcgaaggnttcccgngaggccttagttctcgtcgccgtaccgagggtacgagggaacctacgctacctagttcggacctagtcaggtcgacgtacgaggcaggcgtaacgnggtcagtatacgttattacgacaagtcaacgaacgacaacttcgttacttacgttacgttcgtttacgtaacggattcggaccgtaaccggacggtacccgccccgttgtaccggtcgaccccggtaacccgg

SEQ ID NO: 193779 - DNA, 790 bp, Homo sapiens
  misc_feature: GYAE6OF01BRHLV.52.86.H09.1.454.CMB.1.raw
  modified_base (63)..(63): a, c, t, g, unknown or other
  misc_feature (63)..(63): n is a, c, g, or t
  modified_base (103)..(103): a, c, t, g, unknown or other
  misc_feature (103)..(103): n is a, c, g, or t
  modified_base (111)..(111): a, c, t, g, unknown or other
  misc_feature (111)..(111): n is a, c, g, or t
  modified_base (179)..(179): a, c, t, g, unknown or other
  misc_feature (179)..(179): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
tcagcgcagtacgacacgaccggtgctcgatttagtgctatagacttggggtttgggggggancctagctgtgctgtgggtccaggaggcagaactctgggtntctcaccntggcctgatccctctacttcctcccctctcactctctgcacaggtctctaggacgtcctctatggacnctacgacactaccgccctaccgtggtntccgagttccgaccccaggacacggaccggctaagctccacctgccgttagnggaatntcganacgttccgaacctaaccgtatagtcgtacttacgttacgacagcaaggaccggccgggtcaccggtccttggtacggttggatagttaacgtaagtaacgaccgtagtacggaaccgggtccgtacccgtcggaacgggtaacctcccgggagtacggtcgttccttacgtccgtcgggttaccctacgggtaacgacggaccgggtaaacctcggtacgaacctacgtaccgtctacggtaccgtagggacgttaccgacggacggaacggaacgggtacggacggtacggttacggttaacttacgtttaacggttactttacggtaaaccctaaaggttaacccaaaacgttacccgaacgtttaaccgttggttttaacggtaacccgtttttaggtttacccggttaccgttaacccgggacgtttacccgggaaccccttaaaccggttacccgggttaaacccggtcccccgggtttaggtacccggtaaacccggacccggtaaaccccccgg

SEQ ID NO: 193780 - DNA, 604 bp, Homo sapiens
  misc_feature: GYAE6OF01ALRUL.52.86.H09.1.454.CMB.1.raw
  modified_base (299)..(299): a, c, t, g, unknown or other
  misc_feature (299)..(299): n is a, c, g, or t
  modified_base (380)..(380): a, c, t, g, unknown or other
  misc_feature (380)..(380): n is a, c, g, or t
  modified_base (520)..(520): a, c, t, g, unknown or other
  misc_feature (520)..(520): n is a, c, g, or t
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttagtccaccttggtgttgctgagctgggttttcctcgttgctcttttaagaggtcgtccagtgtcaggtgcagctggtggagtcgtggggggggtctgggtccagggcgtgggtaggtcccgtggacgacttcgtcctggtgcacgcctntggtaacttcaccttcacgtacccagtagaactgctacgtcgggtccgcgagcctacgaggcgtaaggggctgggagtggngactagttactacgtcagtgatggaacacaagtacgcacgtacgatacggacgtcgtacggacggtacgtacgtacgacctagtcctaccgagacgacaacgtacgaagtaacgtacggttctaactacgaactagaacncgacgtacgagagtcaggaggtacgacggtcttacggttacgtttacgtggtacgtacggaggaacggtacttaggattaacgg

SEQ ID NO: 193781 - DNA, 743 bp, Homo sapiens
  misc_feature: GYAE6OF01B6XOL.52.86.H09.1.454.CMB.1.raw
tcagcgcagtacgacacgaccggtgctcgatttagtgctatagacttgggtttggggggaagaggaagactgacggtcccccaggagttcaggtgctgggcacggtgggcatgtgtgagtttttgtcacaagatttgggctcaactctcttgtccaccttggtgttgctgagcttgggtttttcctcgttgcttcttttaagaggcgtccagtgtcaggtgcagctgggtggagtcggtgggggggcgtggtccgaggcgtgggacgtcctgagctctcctgtgcacgccttacgtggtattctaccgttcacgtacccatagaaagtcgccgacgtcggggtacccgccgacgggcctacgacgggtacgaacgggggtcgtgggtacggtggggttcggacgtagtttaatacgttacctacgtaggtagtaacgggaacgaacgtaaataaacgccgaaacgttacgaccgtaaggtaccggttaccgggtaaggaaccggggtccgtaacgttcgaaacccgtacgttaccgtaccgaaggaaccgtaacgtaaccgtaacggtaaagtaaccgtttacgggtttaacctttaaccgaacgtaaacgtacgaaaccgtaacgtaccgtaaggacgtaggcgtaaagggaaccggtaccggaccggtattaacggtttttcgttacggtttaggacgggacggttaagggtaaccggtaactaacggtagttaaacccgg

SEQ ID NO: 193782 - DNA, 813 bp, Homo sapiens
  misc_feature: GYAE6OF01DPUQD.52.86.H09.1.454.CMB.1.raw
  modified_base (220)..(220): a, c, t, g, unknown or other
  misc_feature (220)..(220): n is a, c, g, or t
tcagcgcagtacgacacgaccggtgctcgatttagtgctatagacttgggtttgggggaagaggaagactgacggtcccccaggagttcaggtgctgggcacggtgggcatgtgtgagttttgtcacaagatttgggctcaactcttcttgtccaccttggtgttgctgagtctgggttttcctcgttgtctcttttaagaggtcgtccagtgtcaggtncagtcgtggtggagtcggtggggggggcgtggtcgaggtcgtggggagtccctggagtacctcgtccctgtcgactacgtcctcgttaggtacttaccaccctttactaacggttaccccaagttacggtaaaacgttggtacccggtaaccggttcggggttccccggaccgtaaccgggtcccgttaccggaacgggtaacggtaacgggggtccgtggggtaagggttcgggggtcggtaacgtaacggttttaacgttaacgttaccttaaggtacggtaagttacgggaaacgtaacgaaaagtacgtaccgtaacgtaacccggtataacggtacggtacgggttacggaacggggtaccggtaagttaccgaacctagttaccctaacgtacgtaacgtaacgtaaccgtaaccgtaacggtaaaccgtttaacggttacctttaaccgttaacgtaaactacgaaacgtacgtacccgttacggagtaaccgggtctaacgggtaacggtaacgtacccgtagttacgtttagtttaccgtcggttacgggtacgggagacgggtaaccgttgtaacgtaaccgg

SEQ ID NO: 193783 - DNA, 768 bp, Homo sapiens
  misc_feature: GYAE6OF01BXCN4.52.86.H09.1.454.CMB.1.raw
  modified_base (191)..(191): a, c, t, g, unknown or other
  misc_feature (191)..(191): n is a, c, g, or t
  modified_base (500)..(500): a, c, t, g, unknown or other
  misc_feature (500)..(500): n is a, c, g, or t
  modified_base (754)..(754): a, c, t, g, unknown or other
  misc_feature (754)..(754): n is a, c, g, or t
tcagcgcagtacgacacgaccggtgctcgatttagtgctatagacttggggtttggggggggagcctagctgtgctgtgggtccaggaggcagaactctgggtgtctcaccatggcctggactccctctacttcctccccctcctcactctctgcacacggctctgacgtcctctatgagctagacacacncccaccgtcgtgtctagtccgtcccgaggacacggaccggccaggactcccaccgtcgtcttacgtggagtatcgtactaagttcgaacccgtaaaaccgtattacgtggtaccttttagttaccggtaccgacgacgtaacggacccgggtccccgggaaccgccggtccccgtaggttggtcgggttagtacgttagtaaaagtaaacgacgtacggtacggtaacggaccgtccgtacgacgggtaacctcccgtaggacgtctacttctcggtcgctacggacggtacgacggaaccgtacggtntaaccgtagtccggactacgtacggtagggtaccggtacgaccggaacggcggtaaacgggagggtaacgtacggtcgttaacgttagttaacgtttcgttacctaagtaaacccttacgaaaaccgggttctaaaacccgttacgttacgggtttacggttaaaccttaagttcggttaaccggttaacgtaacggtcccgtaaccgaaaccgttacggtaccccttaccgggtacggtccgggtaaacccgnggtaaacccccccg

SEQ ID NO: 193784 - DNA, 836 bp, Homo sapiens
  misc_feature: GYAE6OF01BKUBK.52.86.H09.1.454.CMB.1.raw
tcagcgcagtacgacacgaccggtgctcgatttagtgctatagacgttgggtttggggggaagaggaagactgacggtcccccaggagttcaggtgctgggcacggtgggcatgtgtgtagttttgtcacaagattggctcactctcttgtcctaccttggtgttgctgagcgttgggttttcctcgttcgtctttacgttttaaaggacggtccgttccgtaagttcggtccgtagggttcgccaggtcggttgggtgggtagggttcgggggtgggggggggtccgtacgggtccggacgggtcggtacggggaccgttccgtcgacgtaccgtccgttccgtggtacgccgtaccgtccgttcggtagtaccttacccgacctttacggtaaccgtaaccctaaggtaaccgtaaagttccgaccggtaccggttccgggtacccgtaccgacggtccctaccggagggtacgggtaacgggtcgtagggtaggttcggggacgtacgtagttactacgtacgtagtgtacggaggtacaagtaataacgtactaacgtacgtgaacggtcgtaacggtaacggacggtagtacggttacgaccctaggtaccccaaggaaaggaccgtaaaacgtctaaacgggtaacttaacccggtttacggtttaaacccgtaactaaaaccgtaagggttaacccggtaaacgttcgaccggaacggtaacgcgttaaacgggttaacggaccggttaacggtacgttttccggtttaaaagtttcgttacggtcggtagggaaccgttaagggactaccgtttaggtacctaaacgg

SEQ ID NO: 193785 - DNA, 803 bp, Homo sapiens
  misc_feature: GYAE6OF01CR50N.52.86.H09.1.454.CMB.1.raw
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttagtccaccttggtgttgctgagcgttgggttttcctcgttgcttacttttaaggaggcgtccagtgtcaggtgcagcgtgggtggaggtcgggtggggggggcgtaggtccgagggtcggtgggaccggttcccgtggacgtaccttcgtcccgttggtcggccacggtccccgtgttcggtaacctttcccgtaccctttaccgacgttacccccgtagtaacgaaagtcgacgtaaccggtccgggtcccgccgaacggtccgtaccggtaacggaccgggtaaggggccgtaggggagggttcggggtaggacgtaaggtttactaacgttcctaagtagtaaggtacggaacgaacgaaaacgttcgacgtaaccgtgaccgtaaggtacggtaccgggtaggaaccggggttaccgtagttacgaaccctacggtaccgtaccgacgaaccgtaaccaacgtaaacgaaggttaacgttacggtttactaacctaaacgtaacgtacgaaccgtccgtaacgtaggaacgtcggaccggtaaggtaacggaccggttaaccggtagtttacggtttacgtttcccggaaggttaccggtaaacggtacggggaacgggttaaaccgtacggtaacgttaaacccggg

SEQ ID NO: 193786 - DNA, 673 bp, Homo sapiens
  misc_feature: GYAE6OF01COFFO.52.86.H09.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (219)..(220): a, c, t, g, unknown or other
  misc_feature (219)..(220): n is a, c, g, or t
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (402)..(402): a, c, t, g, unknown or other
  misc_feature (402)..(402): n is a, c, g, or t
tcagcgcagtacgacacgaccggtgctcgatttagtgctatagacttgggtttgggggaagaggaagactgacggtccccccaggagttcaggtgctgggcacggtgggcatgtgtgagttttgtcacaagatttgggctcaactctcttgtccaccttggtgttgctgagcggtcggtttcgtcgtagtcgtcgttaagtaggcgtcngtgtnaggtnngcgtgtgaggtcggtgggggcgtgtacgngcgtggacgtcctgacgctctcgtgtcncgctcgtgtgtactctccgtactactaccgattacgatcgatcgtcgcncncggtcncgagacgagggtcgnggnggtggcgtagtagtagtagtaccgtagagtagagaagaattaaccggaanacgtacgtacgtacgtaggtacggtacggtacggtaacggtacgtaacgtacgtaacgtacgtaccgtacgaacgtaacgtaaacgtaacgtaaacggtaaacgttaacgttacgtttaaccgttaaccgtaaacgtaaacgttaaccgtaacgtacgtacgaacgtaacgtacgtacggtacgtaacggtaaccggtacgtacgttacgtttacgttaacggttacggacggtaacggtaacggtaaggtaacgttacgttaacggtacg

SEQ ID NO: 193787 - DNA, 885 bp, Homo sapiens
  misc_feature: GYAE6OF01AM51F.52.86.H09.1.454.CMB.1.raw
  modified_base (524)..(524): a, c, t, g, unknown or other
  misc_feature (524)..(524): n is a, c, g, or t
  modified_base (828)..(828): a, c, t, g, unknown or other
  misc_feature (828)..(828): n is a, c, g, or t
tcagcgcagtacgacacgaccggtgctcgatttagtgctatagacttgggtttgggggaagaggaagactgacggtcccccaggagttcaggtgctgggcacggtgggcatgtgtgagttttgtcacaagatttgggctcaactcttcttcgtcctaccgttggtgttgctggagtcgttcgggtttttcctcggttgtcgttacgtttttaaggacgggcggttccctaaggttggtaccgtacggtggtcaggtccgtcggggtaggtacgggttccggggtcgggggggggtccgtcgggttcccgagggtccggttcgggggtaccggttacccgtacgggaacgttccgttccttaccgttgggtcgacgcgtccttacgtcggtacttcctaccgttaccgtacgtaccctagtacgtaaacgtcgacgccgttacggggtcccgaccgtaccggtccggtccgagggaccggtaggggtcgtaggggtcggtggggtacgtaccggtagtttaaccncgtttaccgtagtagtaggtaggaacgagtaaaacttacggaccgtaacggtaccgacgtaacggtacggttaccggtaacgggtacggggtacctaacgttaccggtacctacgttaccctaacggagtaaccggaactaacgggtaaaccgtaaaggttaaacgtttacccggttttaaccgttaaccgtaacgtaaacgttaccgtaaaacggcgttacccgtaaggtaacgaacggttacggtaaacgggtaaccggttacccggtacgggtactttaacggtttaccgtttttaacggngttaacggggacggttaacgggtaaccccgggtaatttccgggtaactaaacccggg

SEQ ID NO: 193788 - DNA, 837 bp, Homo sapiens
  misc_feature: GYAE6OF01ACBZY.52.86.H09.1.454.CMB.1.raw
  modified_base (419)..(419): a, c, t, g, unknown or other
  misc_feature (419)..(419): n is a, c, g, or t
tcagcgcagtacgacacgaccggtgctcgatttagtgctatagacttgggtttggggggaagaggaagactgacggtcccccaggagttcaggtgctggcacggtgggcatgtgtgtagttttgtcacaagtatttgggctcaactctcttgtcctaccgttggtgttgctgagtcgttgggttttcctcgttgtcttacgtttaaggacggtccgtccgtaaggtcgtacgaggtgcctaggtccgttggggtaggtaggttcggggtcgggggggtcttcgggtccgtaggtccggtgggtacggttccctggacgtacttccgtcgtagtcgcgtacgtccgtagtacggtcttcctaccgttcgaacgtaccatacgtaaatcgaccgtacgtccgggtcccaccggtaggtccncggaacgggaccgtaagggtcgtaggcgggttgggacggtcttaaggttactacggttcctaagtaggtacggtaaggaaaccgtagaaaacttcgggaaccctaacgtacggtaacgtaacgggtaccggtaacgggtacggggtaaacccgggtaacgttacgggtaactaaccgtaacgtacccgttaacgaacggttaaacccgaacgttaaccgaacgggtttaaagaaccgttttaaccggttaaccttaacgtaaaacgttaaaccgtaacgtaaccgacgtaccggtaagacccggtatacccgggtagaaacccggttacggtacccgttagttttaacggttaccgtttaccggaggttcccgggaacgggttaacggtaacgtaaccgttacgggttctaaaccggg

SEQ ID NO: 193789 - DNA, 529 bp, Homo sapiens
  misc_feature: GYAE6OF02IJNUU.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtaataaagacactgagaggccctcgagggatccctgagcgattctctggctcgaggtcagggacaacggtcactattggccatcagtggagtccgaggcaggaaggacggaggctgacttattagttgtactaatcaaacagaccactattaggtacttatgtacttacgaactgacgaccaaggtcaaccgtcgtagggtccacgacccgaacggacccaacccgtctcgtccactccg

SEQ ID NO: 193790 - DNA, 606 bp, Homo sapiens
  misc_feature: GYAE6OF02IWVUA.52.86.H09.1.454.CMB.1.raw
  modified_base (203)..(203): a, c, t, g, unknown or other
  misc_feature (203)..(203): n is a, c, g, or t
  modified_base (433)..(433): a, c, t, g, unknown or other
  misc_feature (433)..(433): n is a, c, g, or t
  modified_base (535)..(535): a, c, t, g, unknown or other
  misc_feature (535)..(535): n is a, c, g, or t
tcagcgcagtacgacacgaccggtgctcgatttagtgctatagacttgggtttgggggggagcctagctgtgctgtgggtccaggaggcagaactctgggtcgtctcaccatggccgtggactccctctacttctccccgtcctcactctctgcacaggctctcgaggcctcctactgagctgacctacagccaccctcggtntcagtgtccccaggacagaccggccaggactccaccgtggctcgtggagatgctattgaccaaccgattaatgtcttattggtaccagacaggaacgcccggaccacggcccctgtcgttcggtagtatcgttaataaacgactaccgttggaacggaacggcccgttacgaggggtactccgttgagcggtattcgtcgtggcctcgaggtcgaggtacacggtcaacntcggccatcgagtgactccgaggcagacggtacgagtactcgtactgttattcgtactaatacaacgtaacgtacctaccgttagttccggtacgttaacgngttacgttaccggtaacgtcgtaccgaaccgtaacggttccacccgttcgtccggtacctacgtaaccccg

SEQ ID NO: 193791 - DNA, 548 bp, Homo sapiens
  misc_feature: GYAE6OF02F7EQH.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtcccccaggacacgacggccaggactcacctgctctgggagatgcattgacccaaaccgatatgcttattggtaccagcagaacgcccgggccacggcccctgtgttggtgatgtataaagacactgagacggccctgagggctcccgtgagcgattctcgtggcctccgaggtcgagggacaacggtcaactatggccatcagtggagtccaggcagaggacgacgctgaacttagttacttgtactaatcaaacagaccactagttacggtactttatcgttacttacggaacttcggaccgtaccgaaggtccacccggtccgtcgggtccacgtaccccg

SEQ ID NO: 193792 - DNA, 515 bp, Homo sapiens
  misc_feature: GYAE6OF02G6DKQ.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgatattattgtcaatcaacagacaccattcgtacttatgttcttcggaactgacgacctaaggtccaccggtcctgggtccacgcccgaaggcccaaccccactcgtcacttcccg

SEQ ID NO: 193793 - DNA, 645 bp, Homo sapiens
  misc_feature: GYAE6OF02G7LCA.52.86.H09.1.454.CMB.1.raw
  modified_base (328)..(328): a, c, t, g, unknown or other
  misc_feature (328)..(328): n is a, c, g, or t
  modified_base (525)..(525): a, c, t, g, unknown or other
  misc_feature (525)..(525): n is a, c, g, or t
  modified_base (548)..(548): a, c, t, g, unknown or other
  misc_feature (548)..(548): n is a, c, g, or t
tcagcgcagtacgacacgaccggtgctcgatttagtgctatagacttgggtttgggggaagaggaagactgacggtcccccaggagttcaggtgctgggcacggtgggcatgtgtgagttttgtcacaagatttgggctcaactctcttgtccaccttggtgttgctgagctgggtttttcctcgttgctcttttaagaggcgtccagtgtcaggtgcagctggtggagtcgtggggggggctggtccaggctgggagtccctgagactctcctgtgcagcctcgtggacttcaccttcagtacccatagaaatgcacgtggggtccnccgaggcctccgaggccgaagggggctagggaggtggggtggcgtagttatcttcctagtgagttaggaagactaaagtaacgaccgtaactaccggcgaagtacggtccggtaggaacggggccgtagtacgaccgactccgtacgtacgaacgaacaaccgtacgaaaggtaacttacgggtttacttacctaanaaacgtagaaaccacggtaaccngtaagacgtaccgtaggacggtacgtacggtaccttagtttacgtttacgttggtacgtaccggtaaggaacgggtaaccgttacgtaagttaaccg

SEQ ID NO: 193794 - DNA, 532 bp, Homo sapiens
  misc_feature: GYAE6OF02FSTM1.52.86.H09.1.454.CMB.1.raw
  modified_base (365)..(365): a, c, t, g, unknown or other
  misc_feature (365)..(365): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccgaggcaaggggctggagtgggtggcagttanatcctatgatggaagcaataagcactacgcagacgtccgtggaagggccgatgaccatctccagagacaactcgaagtaactacggtttcttactacaaatacgaacagcctagacagctagagaacgacgcttatgttttactgtgcggaggaggaactcgatacg

SEQ ID NO: 193795 - DNA, 544 bp, Homo sapiens
  misc_feature: GYAE6OF02FRLL3.52.86.H09.1.454.CMB.1.raw
  modified_base (519)..(519): a, c, t, g, unknown or other
  misc_feature (519)..(519): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtctggggggggctggtccaggctgggaggtccctgagactctcctgtgcagcctctggattcaccttcagtaccccatgaaatgcacgtgggtcccgccaggcctccgaggcaaggggctgggaggtggggtgcagttatatcctatgatggaagcaataagcaactacgcagacgtccgtaggaacgggcgattacgacctatctaccagagacaactacgaagtaatacggttctactactaaatagaacagcctagagagctgagacgacggactattcgtttacnggtgcggtagaggactacgtatacg

SEQ ID NO: 193796 - DNA, 582 bp, Homo sapiens
  misc_feature: GYAE6OF02IG7XO.52.86.H09.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagntgcattgccaaaccgntatgcttattggtacagcagaagccggccaggccctgtgttggtgatgtaataaagacactgagacggccctgacgggactcccgtagacgcgtattcctacgtcggccttccgaggtcgaagggaccaacggtcactacgttggaccatcaggtggacgtccgaaggcaggaggacggaggctagaacttagtttatcgttacaagtcaacacgaccaaccgtagtttagtaacttagttcgttcttacggaacttgaccgtaaccgaggtccgaccgttccgtgggtacctacgacccgaacggtaccccaaaccccgtcgttacgtcctaaccgttcccg

SEQ ID NO: 193797 - DNA, 591 bp, Homo sapiens
  misc_feature: GYAE6OF02JHNPM.52.86.H09.1.454.CMB.1.raw
  modified_base (325)..(325): a, c, t, g, unknown or other
  misc_feature (325)..(325): n is a, c, g, or t
tcagcgcagtacgacacgaccggtgctcgatttagtgctatagacttgggtttggggggaagaggaagactgacggtccccccaggagttcaggtgctgggcacggtgggcattgtgtgagttttgtcacaagatttgggctcaactctcttgtccaccttggtgttgctgagctgggttttccctcgttgctcttttaagaggcgtccagtgtcaggtgcagctggtgagtctggggggggctggtccaggctgggaggtccctgagactctcctgtgcagcctctggattcaccttcagtacccatgaaatgcactgggtccnccaggctccgaggcaaggggctggagtggggtggcaggtttatactacctatgataggaagcaaataacgcactacgacagacgtccgtagaagggccgtagttcgaccatctaccgagacgaacaacgtacgaagaacttacggttcttaccgtaactaaatacgaaacgacgtaccgtaggaacgagacctaggacggaacaccgggtactagttacgtttacgtagttacgccggtaaggacgggtaactacgtaagtaaccg

SEQ ID NO: 193798 - DNA, 580 bp, Homo sapiens
  misc_feature: GYAE6OF02GT845.52.86.H09.1.454.CMB.1.raw
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcacgtgggtccgcaggctccgaggcaaggggctggagtgggtgcagttatatcctagtgatggaagcaagtagcactacgcagacgtcgtaggacgggccgatcgacctatctaccgagacgacaactacgaaagtaatacggttacttacgtaactaaactacgaacgacgaccgttagaacgacgcgtaggaacggaccgtacggtacttagttcgttttaacgtggtacgacggtaaggacgggtaactcggtaattaaccgg

SEQ ID NO: 193799 - DNA, 607 bp, Homo sapiens
  misc_feature: GYAE6OF02HAUHT.52.86.H09.1.454.CMB.1.raw
  modified_base (327)..(327): a, c, t, g, unknown or other
  misc_feature (327)..(327): n is a, c, g, or t
  modified_base (574)..(574): a, c, t, g, unknown or other
  misc_feature (574)..(574): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatagaaatgcacgtgggtccnccgaggctccgaggcaaggggctgggagtggggtggcagttatagtcctatgatggaagcaatacgctacgtacgcaggtacgtccggtaggaacggggtccgaagtttacggaaccctacgtaccgtccgaaggaacgaaccaacgtacggaaagtaacgttaccggttcttactaacaaagttcgaaactacggcctagaacggagtcgtaggacggaaccgacggtacttagttcgttttacgnggtcgacggaggaacggtacgtcgtaagttacg

SEQ ID NO: 193800 - DNA, 686 bp, Homo sapiens
  misc_feature: GYAE6OF02IXH1V.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatccacctgctctggagatgcattgccaaaccgatatgccttattggtacctagcagaacgccgggccaggccccgtgtcgttggtgtagtgtaataaagacacgtagagacggccctcgagggactcccgtgagtcgattctcgtggcctccgtaggtcgacgggaactaacgggtacctacgagtttcggaccgtaatccgaggtacgggtaacgtcccagggcgaaggagggtaaccggaaggccgtacgaaccttaagtttaacgttacgtacgtaaacttacgaaaccgtagaaacctaccctagtttaaccggttacgtttaacttcgttaccggttttacccggaaacgttcgtacccggaacgtaaccgggtaccctaacccggttacccggttaggggtaccccgaacggtaccccggtaaccggaaccccgtaaaccccctacgttaccgttaccacccgtttacccg

SEQ ID NO: 193801 - DNA, 683 bp, Homo sapiens
  misc_feature: GYAE6OF02HVYBS.52.86.H09.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
tcagcgcagtacgacacgaccggtgctcgatttagtgctatagactttgggtttggggggggagcctagctgtgctgtgggtccaggaggcagaactctgggtgtctcaccatggcctggatccctctacttctccccctctcactctctgcacaggctctgacggcctcctatgagctgacacagcccacctcggtgtcagtcgtccccaggacagacggccaaggntcactgctcgtgganatgcattgaccaaaaccgatatgcttagttggtaccagcagaagccggcaggccctgtgttgnagtagtactaaagcactgagacggcctacgagggactccgtagacgcgtactttctcgtaggtccctccgaggttacgacggggaactaaaccgggtctaacgtaagtttcggacccgtaattccgaagggttacgggacggttacccgaagggcccgaagggaacgggtacggaacgggtactaggtaaaccgtttaatttagttacgggttactaaacgttaccaaaacgtaacggaaaccttaaccgtaacgtttacgggttaactttacgttacggttaaccgtttaccgggtaaaacgtcggtaacccggaaccggtaaacgggttcccgaacccggtttccggtacgggttaccgacccggaaacccccgg

SEQ ID NO: 193802 - DNA, 531 bp, Homo sapiens
  misc_feature: GYAE6OF02FZLX7.52.86.H09.1.454.CMB.1.raw
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccgaggtcagggacaacggtcacagttggccatcgagtggacgtccgaggcagaggacgaggctgactattattgtacaatcaaanagaccactattaggttacttatgttcttacggaacgtgacgacaaggtccgaccgttccgtgggtcctagcccgaacggacccaaccccgactcgtaccactcccg

SEQ ID NO: 193803 - DNA, 592 bp, Homo sapiens
  misc_feature: GYAE6OF02GM7C0.52.86.H09.1.454.CMB.1.raw
  modified_base (395)..(395): a, c, t, g, unknown or other
  misc_feature (395)..(395): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcacgtgggtccgcaggctccaggcgaaggggctgggagtgggtgcagttatatctatgatggaagcaataagcacgtacgngagagtccgtaggaacgggccgaagttcgaacctacgtacctaccgaagacgaacgaactacgaagtaacgttacggttccttacgtaactaaatacgaacacgtacctagaagcgctaggacgacgacggtacttacgttacgttttacgtggttacgacggtaacggaacgggtaacgttccggtaattaaccgg

SEQ ID NO: 193804 - DNA, 628 bp, Homo sapiens
  misc_feature: GYAE6OF02HJ2HF.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatccacctgctctggagatgcattcgaccaaaaccgatatgtcttagttggtaccagcaagaagcccgggccacggcccctgtggttggtgtatagtaataaagacacgtgagaccggtccctacggacgggtactcccgtaggacgtacgtacttcgtcgtacggtccttacccgaagggtacggaacggggtaacctaacgggtccaacgttagttcggacctagtacgtaggtggaacgtccgaaggacaaggacggacggaggactagtacttaattacgttagtactaataccaacgtagaaccacgtagttacggttactttagtcgttacgtaccggtaacgtacggaccgtaaccgtacggtccgaccggttccgtacggttacacgtacccgg

SEQ ID NO: 193805 - DNA, 807 bp, Homo sapiens
  misc_feature: GYAE6OF02I8C58.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttctcccctcctcactctctgcacaggctctgaggcctcctatgagctgacacagcccaccctcggtgtcagtcgtccccaggacagaccggccaggatcactgctctggagatgactagttcgaccaaacgatatgactttagttgtaaccagcgaagaacggtcccgggaccaacggcccccgttggtggttacgggtgtacgttagtaaacgttaaaacgaactacgtaggaacgacggtacccctggaacgggacttacccgtgacgtacgtaacgttcttcgtacggtcctaccgtaggtcgaacgggtaacgtaaccggtcgaactaagtttcggacctaagttcagggttacggacggttacccgaaggggactaacgggacgggaaccgggtaacgggtccttaacgtaaccgtttaaagtttaacttttaccggttaacgtaaaccgttaaccgaaaccgttaaacggaaacccctttaaaccgtaacgttttaacgggtttaaaccttttaacggtttaccggttttaaacccgggttttaacccgggtaaacccgtttacgggtaaacccccggttaaaccccggttaaaacgggtttcccccgttaaaaccccgggtttccccgggtaacggggttttaacccccgacgggtaaaacccccccggg

SEQ ID NO: 193806 - DNA, 575 bp, Homo sapiens
  misc_feature: GYAE6OF02GTASN.52.86.H09.1.454.CMB.1.raw
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctggggagtccctgagactctcctgtgcagcctctggattcgaccttcagtaccccatagaaatgcactggtccgccaggctccaggcgaaggggctgggagtgggtgcagtttagtactcctatgatggaancaataagcactacgcagntcgngaaggcgatgacntcncaganacactcgaagatacggttcctactaactaatagaacacgtcctaggacgagtccgtaggaaggaaccgtaacgggtaccttaggtttacgtttttacgttggtacggtaccggaagggtacggggtaaccgtacggtaattaaccgg

SEQ ID NO: 193807 - DNA, 608 bp, Homo sapiens
  misc_feature: GYAE6OF02F8MLF.52.86.H09.1.454.CMB.1.raw
  modified_base (571)..(571): a, c, t, g, unknown or other
  misc_feature (571)..(571): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctggggaggtccctggagactctcctgtgcagcctctggattcaccttcacgtaccccattagaaatgccacgtcgggtcccgccaggcctccgaggcgaaggggctggaggtggggtcggcgtagttatacgtcctagtgagtaggaagcaaatagctacgtacgcgagacgtccgtaggacgggccgagttcgaccatccgtaccgaagacgactaacgtacgtaaagtaacgttacggtttacttactaacgtaaatagaacctagacctagaacgagacgtaggacgaccgacggtacttacgttagttttacgngtacggacggtaggacgggtaactacgtattaaccgg

SEQ ID NO: 193808 - DNA, 534 bp, Homo sapiens
  misc_feature: GYAE6OF02I9E6T.52.86.H09.1.454.CMB.1.raw
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctggggaggtccctgagactctcctgtgcagcctctggattccacctttcacgtacccatgaaatgcacgtgggtccgccaggcctccagggcgaagggggctgggaggtggggtggccagttatactcctatgatggaagacaatagcaactcgcagagtcgnggaggccgatgaccatcncagnacacacgaagatacgttcttctaanaatgaacngaccagagagcgtagacgacaggtactagttgtttactgtcgaggaggaggtaactgtatacg

SEQ ID NO: 193809 - DNA, 671 bp, Homo sapiens
  misc_feature: GYAE6OF02JN1MC.52.86.H09.1.454.CMB.1.raw
  modified_base (544)..(544): a, c, t, g, unknown or other
  misc_feature (544)..(544): n is a, c, g, or t
  modified_base (657)..(657): a, c, t, g, unknown or other
  misc_feature (657)..(657): n is a, c, g, or t
tcagcgcagtacgacacgaccggtgctcgatttagtgctatagacttgggtttggggggggaggcctagctgtgctgtgggtccaggaggcagaactctgggtgtctcaccatggcctggatccctctacttcctcccctcctcactctctgcacaggctctgaggcctcctatgagctgacacacgcccaccctcggtctcagtcgtcccaggacacggacggccaggactccacctcgctcgtggagatcgcattcgaccaaacgattatcgtactttattacggtaccacgacgacgaacggcccgggccacggtccccgtaggttcggtttcgggtgtacgttaggtaaacgtaaacggaaccgtacgtaggaacgggaccggccctaggtaacggggtacctccgtaggacgtcggttactttccgtcgtacggtccctaccggtacggtacggtaacgggaccgacggtactacgtaagttcggacctacgtcgaggtaggaccgtcgaggcgaggaggacgacgggctagtaacttnttaacgtcgtacaacgtacaacgtacgacctaacgtagtttcggttacttaggttacttccggttaacgacggtacgtacccgagtaaccggtcctaccggtcgtaccggtanacccggtaacccgg

SEQ ID NO: 193810 - DNA, 541 bp, Homo sapiens
  misc_feature: GYAE6OF02G8A9R.52.86.H09.1.454.CMB.1.raw
  modified_base (240)..(240): a, c, t, g, unknown or other
  misc_feature (240)..(240): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccgggccaggcccctgtgttggtgatgtataaagacactgagaggccctcgagggactccctgagcgtattctcgtggcctccgaggtcgaagggacaacggtcacgtagttcggccatcgagtggacgtccaggcaggaggacgaggctagactattagttgtacaatacaacagaccaactattaggtacttagtcgtcgttacgacgtcgaccgtaaccgtacggtcctacccggttccgtcgggtacacgaccccg

SEQ ID NO: 193811 - DNA, 511 bp, Homo sapiens
  misc_feature: GYAE6OF02GAQXX.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtcgttggtgatgtataaagacactgagaggccctcgaggggactcccgtgagcgattctctggctcaggtcagggacacggtcactagttggccatcgagtggacgtccaggcaggaggacgaggctgacttattattgtacaatcaacagacaccattgtacttatgttcttcggaactgccgacgacgtcaccgtctcgggtcacgtacccg

SEQ ID NO: 193812 - DNA, 680 bp, Homo sapiens
  misc_feature: GYAE6OF02F0DNP.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggactcacctgctcgtggagatgcattcgaccaaaccgtatatgtactttagtcggtaccagtcaggaacggcccgggtaccgaccggtccccttggtcggtttacggtagtaagttagtaaacgtaaaacgactacgtacggaaggaccggcccctaggacgggtaccttcccgtaggacggtcgtacgtttcctaccggtcgacccgttaccgacgggtacgaacggggtaacctaaccgggtaccaacgtagttcgaccacgtacagggtcgacgtccgaaggcgaacggagggacggtacggctacggtacttagtttagttacgtacaaacgttacaacaacgtaccgaacgttcgtttacgttactttacgttacggttacgttacggaactcggtaccgtaaccgtacggtacccttacccggtacgttccgggtacctccggaacccgg

SEQ ID NO: 193813 - DNA, 663 bp, Homo sapiens
  misc_feature: GYAE6OF02HOZ67.52.86.H09.1.454.CMB.1.raw
  modified_base (566)..(566): a, c, t, g, unknown or other
  misc_feature (566)..(566): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagtttgtcacaagatttgggctcaactctcttgtccaccttggtgttgctgagctgggttttcctcgttgctcttttaagaggtcgtccagtgtcaggtgcagctggtggagtcggtggggggggctggtccgagggcgtggggacggtcccgtgacgacttctcctggtgcacggcctcgtggtacttctaccttcacgtacccatacgaaatcgcgaccgtcggtcccgccacgggcctccgaggcgaacggggctgggtaggtggggtggcctaggttatatcctagtgacgttaggaactacgaaacttacggacaacgttaaccgagacggtacggtaccggtaaggaacggggacctaggttaccggaacctacgtcctaccggaagtacgaactaacgtacgaaagtaacgtacggttacttacgtaactaagtacgaacncgacgtacgaagtacgctaggacggtacgacggttaccgtatttaccggttcgtagttacggaccggaagggtaacggaactaccggtaataaccgg

SEQ ID NO: 193814 - DNA, 846 bp, Homo sapiens
  misc_feature: GYAE6OF02IZIPD.52.86.H09.1.454.CMB.1.raw
tcagcgcagtacgacacgaccggtgctcgatttagtgctatagacttgggtttggggggggagcctagctgtgctgtgggtccaggaggcagaactctgggtgtctcaccatggcctggatccctctacttcctccccctcctcactctctgcacaggctctgacggcctcctatgagctcgacacagcccacccgtcggtgtcaggtcgtccccaggacaggaccggccaggactccaccctgcctcgtaggacgatcgctattcgaacccaaaccgtattacgtcgtactttagttacggtaaccacgtacgaaacggaaccgggccccggggacccgtaaccggggtcccccgtttgggtttacgggttttacgggtaacggtaacgtttacggttaaaacgtaaaaacggtaacccgtaacgttaacgggaacggggtaacccgggtacccccggttaaccggaacggggttaacccttccccggtacgggtaaccggtccgttaaccgttttccgttccggttccggtacccgttacccgggaacgggttaccgggaaacggggtaaccctaacccggggttacccaaacgttacggtttacccggacccttaacggtaccggtaagggttaccgggaaccggttcccggaaggggtaaccgaagggaaccggggtacggtaaccgggtcgttaacgtacgtttaagttacgttacgtactaacgtacgaactacgaccaacgttagttacgttacgttacgtcgttacggttacgtaactccggaccgtaccggtaacgttccggaccgttaccggtagggttacccaccggtaaccccg

SEQ ID NO: 193815 - DNA, 789 bp, Homo sapiens
  misc_feature: GYAE6OF02JYRT9.52.86.H09.1.454.CMB.1.raw
  modified_base (296)..(296): a, c, t, g, unknown or other
  misc_feature (296)..(296): n is a, c, g, or t
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagcttgggttttcctcgttgctcttttaagagtcgtccagtgtcaggtgcagctggtggagtcggtggggggggcgtggtccagggcgtggggacggtccctggacgacgtctcctgtgcagcctntggtattccacttcacgtaccatagaactgtcacgtcgggtccgcacggtcctccgaggccggaaggggctgggacggttggggngactagttactaactccgtagngtagtaggaacgactaaataaccggctacgttaaccggactaaggtacggttaccggacggggtaaacggtacccggtaagtttacgaacccgtaagttcccggtaaccgaaggaaccggtaaacccgaaaacgttaccgggaaacgttaaaacgggttcccggtttaaacctttacccgtaaactaaaaacgttaacggaaaccccgtaacgtacccgttacggtaaagtaaccgggtaccgttaaacggaaccgggtaacccggtaacccgggttaacgttttaaccggttttaggtttttaaacccggttaggggttaaccggttaacccggggaaaagggttaaccggggtaaaacttcccggggtaaaactttaaaccggg

SEQ ID NO: 193816 - DNA, 697 bp, Homo sapiens
  misc_feature: GYAE6OF02J02YI.52.86.H09.1.454.CMB.1.raw
  modified_base (319)..(319): a, c, t, g, unknown or other
  misc_feature (319)..(319): n is a, c, g, or t
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagcgccaggactcacctgcttcgtggagatgctattcgacccgaaaccgtatattcgtctttaacgttcggtaaccgagtcgaagaacggcccgggccgacgggccccttggtcggttggngtacgtagtaataaacgacacgtacggaaggaccggtcccgacgtaacgggtaccgtacccgtaggacgtacgtacgttcctcgttcgccttccggaacgggtcgaacgggtaaccgtaacggtaccgactacgttcggccatcgagtcggtacgtaccgtaggcgtaaggaggaacggacgtcgtagaacgttagtttagttagtaccgaataccgaactaacgaccaagtacgttacgttaagttacttaggttaaccgttcggtaaccgttcgaacccgttacgtaacgtcccggtaaaccggtccgtacgttacccgaccggtaaccccgtacgtacccccggaacccgttctaccgttacctaccgttacccg

SEQ ID NO: 193817 - DNA, 638 bp, Homo sapiens
  misc_feature: GYAE6OF02FMSVC.52.86.H09.1.454.CMB.1.raw
  modified_base (326)..(326): a, c, t, g, unknown or other
  misc_feature (326)..(326): n is a, c, g, or t
tcagcgcagtacgacacgaccggtgctcgatttagtgctatagacttgggtttggggggaagaggaagactgacggtcccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggctgggaggtccctgagactctcctgtcgcagcctctggattcaccttcacgtacccatgaaatgcactgggtccnccgaggctccgaggcgaagggggctcggaaggttggggtcggactaggttaatattacccgtagtacggaatgggtaagacaaagtaacgacctaacgttaacgcgaaggtacgttaccggtaggaacggggccgaagtttacggaaccacgtacctaccgaaggacgaaccgaaccgtacggtaaacgaacgttaaccggtttacttacctaacgtaaagtacgaacgtacgccgtagacgagctagacggaccgacggtcctagttacgtttacgtgttacgacggaagtagggaacctacgtactaacg

SEQ ID NO: 193818 - DNA, 719 bp, Homo sapiens
  misc_feature: GYAE6OF02G58ZN.52.86.H09.1.454.CMB.1.raw
  modified_base (260)..(260): a, c, t, g, unknown or other
  misc_feature (260)..(260): n is a, c, g, or t
tcagcgcagtacgacacgaccggtgctcgatttagtgctatagacttgggtttgggggtgggtccaggaggcagaactctgggtgtctcaccatggcctggatccctctacttctccccctctcactctctgcacaggctctgacgcctctatgagctgacacgacgcccacccgtggtagtcagtcgtcccgaggacacggacggccagactccaccgtgcgttcgtaggagctcgactagttaccgaacccaaacgtnttacgtcgttactttagttacggtaccagcgtaacggaaccggcccgggaccgtaccggtcccgttggttggttggtcgtaagttacgtaaataacggactacgtggacggaccgtccctaggacggtacctccgtaggaccgtcgttacttccgtcgtacggtcccgtacggtacgggtacggaaccgggtaaccggtaaccgtactaaccgtagttccggactagtcggtacgggtacggtaccgtacgaggacggagggaacggacggaggtacgtagtaacttagtttagtacgtaactacacgaactacgtaacctagtttagttacgttaccttgttacgttacgtacggacgtcgaacccgtacgtacggttacccgtccggtacggtacgggtcccaacccggaccgaacccgtacccctaaccgtacgtacctaccgttacccgttcccg

SEQ ID NO: 193819 - DNA, 629 bp, Homo sapiens
  misc_feature: GYAE6OF02G141D.52.86.H09.1.454.CMB.1.raw
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggactcacctgctctggagatgctattcgacccaaaccgatagtgtactttattcggtaccagcagaagccggcacggcccctggtgttggtgatgtaataaagacacgtagacgacggccctacgacgggctcccgtggacgcgtacttccgtcgtcggtcctccgaggtacgacgggtaaccgaacgggtccaacgtacgttcggacctagtcgaggtcggtacgtccgaggcgaggtacggacggaggcgtagtacttagttagttcgtacaatacaacagacctacgtagttacgttacttagttcgttacgttacggaacttcgaccgtaccgtacggtccgtaccggtaccgtacgggtaccaccggacccgtaaccggacccctaaccccgtacgtccgtacctaccttacccg

SEQ ID NO: 193820 - DNA, 659 bp, Homo sapiens
  misc_feature: GYAE6OF02I3C5N.52.86.H09.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagcgcagtacgacacgaccggtgctcgatttagtgctatagacttgggtttgggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtggggggggctggtccaggcgtgggacggtccctgngctctcctgtgcngcctctggtattccacctttcacgtaccccatagaaattgactacgtcggggtccgccgacggcctccgaggcgaacgggctgggaggtggggtcggactaggttatacttcctagtgtacgtaggaagacgaaagtaacgcctaacgacgtacgaagtacggtaccggtagggaacgggccgtaagttcgaacctactccgtaccgaaggaccgtaacaacgtacgaaacggtaacgttaccggttacttactaacgaaatacgaactacgtaccacggtagacgtcgtaggacgaccggacggtaccttaaggtttcgtttaacgtcggtacggtacggtaagggtacgggtaaccttacgttacggttaaccg

SEQ ID NO: 193821 - DNA, 755 bp, Homo sapiens
  misc_feature: GYAE6OF02FMC30.52.86.H09.1.454.CMB.1.raw
  modified_base (225)..(225): a, c, t, g, unknown or other
  misc_feature (225)..(225): n is a, c, g, or t
  modified_base (741)..(741): a, c, t, g, unknown or other
  misc_feature (741)..(741): n is a, c, g, or t
tcagcgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatccaccgtgcctctgganagtcgctagttcgacccaaaccgatagtcgactttagttcggttaaccagctaaggaaggtcccggggcccagggtccccccttaggtcgggtttggtacggtagttggtaaacgttaaaacgaccgtaaccgtaggaacggacgggtcccctcggaaggggtaccttccccgtaggaggtccggtactttacctcgtacgggtcctacccgaagggttccgaaggggaacctaaccggggtacactaggttcggacctagtccaaggttggacgtccgaaggctaaggacgggaacgaggctacgggaaacttagttaacttggtaaccctaattaccaaacgtaacgtaacctaaccgtaggtttacggttaaactttaacgttcgttaaaccgttacggaacctttacggaccggtaaccgtaacgggtaccgttaacccggtaccggttacgggtaaccctaacggtaaccccgaaccggtaccccaaacccccgtacgtaccggttacccnccgttttaccccgg

SEQ ID NO: 193822 - DNA, 690 bp, Homo sapiens
  misc_feature: GYAE6OF02FTVLQ.52.86.H09.1.454.CMB.1.raw
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctgggttttcctcgttgctcttttaagaggcgtccagtgtcaggtgcagctggtggagtcgtgggggggggctggtccaggcgtgggaggtccctggagactctcctgtgcagcctctggacttcaccttcacgtacccatgaaatgactacgtcgggtcccgccgaggcctccgaggcgaaggggctgggaggtggggtggctagtttatactcctagtgtagtggaacgactaagtaacgccaacgtacgacgaacggtacgttaccgggtaggaacggggcccgtaagttcgaacccgtactcccgtaccgaaggacgaaccctaaccgtaccggaaacgtaacgttaccgggtttaccttaccgtaaacgtaaacgttacggaaaccgtacgtacccgttaggaacggtacgtaccgtaggaacggtaacccgtaacgggttacctttagtttacggttttacgtggttacggacgggtaagggtaacgggtaccgttacggtacgttaaccgg

SEQ ID NO: 193823 - DNA, 622 bp, Homo sapiens
  misc_feature: GYAE6OF02FQRIY.52.86.H09.1.454.CMB.1.raw
  modified_base (129)..(129): a, c, t, g, unknown or other
  misc_feature (129)..(129): n is a, c, g, or t
  modified_base (222)..(222): a, c, t, g, unknown or other
  misc_feature (222)..(222): n is a, c, g, or t
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
tcagcgcagtacgacacgaccggtgctcgatttagtgctatagacttgggtttgggggtgggtccaggaggcagaactctgggtgtctcaccatggcctggatccctctacttctcccctcctcactcnctgcacaggctctgaggcctcctatgagctgacacagccacctcggtgtcagtgtccccaggaccagaccggcaggactcacctgctctaggngactgcatttcgaccaaaccgagtatacggtctttaactggtacccaggtccaagaacggccggggccaacgggcccctggtgttcggtgatagtacaaaagtccgaatgacgaggcccctcgaggggactccctaggacgcgtaacttcgtactggcttccgaggtcaaggggtacaaccggctacgtatcggtaccagtcgagtgagtccaggtacgagagggacagggctagacgtttatagttacgtcaaagtcctaaacgngaaccacgtacggtttntaaccggttattgtacttaccgggtactaggccgtaaccgaaggtccgaaccggtcgaacggggttcccagggtaccctaaacggcccctaacccgactcggaccttaccggttacc

SEQ ID NO: 193824 - DNA, 635 bp, Homo sapiens
  misc_feature: GYAE6OF02F2QQ0.52.86.H09.1.454.CMB.1.raw
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
tcagcgcagtacgacacgaccggtgctcgatttagtgctatagacttgggtttggggggggagcctagctgtgctgtgggtccaggaggcagaactctgggtgtctcaccatggcctggatccctctacttctcccctcctcactctctgcacaggctctgaggtcctcctatgagctgacacacgcccacccgtcggtgtcagtcgtccccgaggacaggacggccaggactccacctgctcgtggagatcgctattcgaacccaaacgtatatcgtactttattcggtacagcgaacgacgcccgggccgacggcccttggtcgttgngtatgtaaagtaagactagtgagcgaccctgacggactccgtgacgtcgtacttcncgtgcctaccgaggtacgagggtacaaccggtcacgtatcggacctagtacgaggtcggacacgtaggacgaacggacggtacggacgttacgtacggtaactttagtttacgttacgtacctaaacgttaccaaaccgtaacgtacctaacctaggtttaccggttattacgttcggttaacgtaaccggttagtacggaccgtaacgtaccgttaccggccgtcggtccggtagacccgtaaccccg

SEQ ID NO: 193825 - DNA, 748 bp, Homo sapiens
  misc_feature: GYAE6OF02JM9ZL.52.86.H09.1.454.CMB.1.raw
tcagcgcagtacgacacgaccggtgctcgatttagtgctatagacttgggtttggggggaagaggaagactgacggtccccccaggagttcaggtgctgggcacggtggcatgtgtgagttttgtcacaagatttgggctacaactctcttgtccaccttggtgttgctgagtctgggttttcctcgttgcttcttttaagacggtcgtccagtgtcgaggtgcagtcgtggtggagtcgggtgggggggtcgtggtccgaggccggtgggacggtcccgtagacggactccgtcctggtcgcgacgccgtgtacggtacttaccgtaccttaccgtacgttacccagttacggaaattcgacctaccggtccggtaccgaccgtaccggccgtacccgacgggacggtaacggggtcgtacgggtaggtcggggtacgacgtaacggtttatacttaccgtagtacggagtagggacgaacgtaaagtacgacgaacgtaacgacgaacgtaccggtaacggtacgggaacggtaccgttagtaaccgtacctacgtaccctacgaacgaacttacgaaacgtaacgtaaacggtactttaacgttaccttaagtaaacctaaacgtacgtaaaaccgtcgtaacgtaggaacacggtacgtagaaccggtaaccgttaacggtacctttagttccgtttacgtcggacggttaagggaggaacggtaacttacggtacttaaccgg

SEQ ID NO: 193826 - DNA, 729 bp, Homo sapiens
  misc_feature: GYAE6OF02JZSVZ.52.86.H09.1.454.CMB.1.raw
  modified_base (130)..(130): a, c, t, g, unknown or other
  misc_feature (130)..(130): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
tcagcgcagtacgacacgaccggtgctcgatttagtgctatagacgttgggttgggggagaggaagacgtgacggtcccccaggagttcaggtgctgggcacggtgggcatgtgtgagtttgtcacaagntttgggctcaactctcgttgtacctacgttggtgttgctgagctggtttccngttgctctttagngctacagtgtcngtgcagcgtaggtggagtcggtcgggggggactggttccgaggcgtaggggtacgtcccgtggacgtaccttccgacgttgtcggactaccgccgttcgtacggtacttacctaccgttacacggtaccctaagtaccgtaagtccgaccgtacgtccgggtaccgtcgaaccgggtctaccggtacggacgtaacgggggcgttagggtaccgggtgggtaaccggtgtacggtttagtacgttaccgtagttaccgggaagtacggtaaagtacccgttaaagaccggtaactaccgtacgacgtacgtacggttccggaaggcggtaacgtcgtaacgaccgtattaccgtacgagaaccgagttacccgtaagtaactaggttacgtacttcggaactaagaccgtaaatcgtaccgcgttaaaggcttaaggacacgggttaacggaccgttaggttacgttaccgtttagaccggttacgtcgggtaaattacgggtacgttacgtacggttaacg

SEQ ID NO: 193827 - DNA, 818 bp, Homo sapiens
  misc_feature: GYAE6OF02HEV5I.52.86.H09.1.454.CMB.1.raw
  modified_base (183)..(183): a, c, t, g, unknown or other
  misc_feature (183)..(183): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
tcagcgcagtacgacacgaccggtgctcgatttagtgctatagacttgggtttggggggaagaggaagactgacggtccccccaggagttcaggtgctgggcacggtgggcatgtgtgagttttgtcacaagatttgggctcaactctcttgtccaccttggtgttgctgagctggttttccngttgctcttttaagaggcgtccagtgtcaggtgcagctggtggagttcggtggggggggctcggtccagggcgtgggaggtccctgagactctcgtgtgnacgccgtntgattcccaacttcgacgtacccatagaaangacctacgtcgggaccgccgacgtcctaccgaggacggacggggtgtacggggtaggtcggggtaggtccgtaaggtttaataccgttaaccgttaagtcggtaaaggttaacggaaccgggaattaaacggtaaacgaccgtaaccgttaaacccgggtaacggaaccgtacgggtttaacccgggtaaggggaaaaccgggtcccgggttaagtaccgtaacccgtaacgttccgtaacccgaaagggttaaacccgaaaccttaaaccggtacggaaaacggttaaaccggttttacggttaaccccgtttaacaaacggtaaacgttaacggaaacccgttaggtaacccgtagtaacggaacgggttaccccgtagggaaacccgggtacccgaacgggttaaacccggttttagttaaccgggtttttaaccggtaggtttacgggaccggttaaagggaccgggtaaaccggtttaccgtaataaccgg

SEQ ID NO: 193828 - DNA, 705 bp, Homo sapiens
  misc_feature: GYAE6OF02JWILT.52.86.H09.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagcgcagtacgacacgaccggtgctcgatttagtgctatagacttgggtttgggggaagaggaagactgacggtccccccaggagttcaggtgctgggcacggtgggcatgtgtgagtttgtcacaagatttgggctcaactctcttgtccaccttggtgttgctgagctgggtttcctcgttgctcttttaagaggtcgtccagttgtcaggtncagctggtggtagtcggtgggggggctggtcccaggccgtggggacggtccctgngactctcctgtgcacgcctcgtcggacttccgaccttcacgttacccagtacgaaatgacctacgtcgggtccgaccgtcggacctacccgacgggacggtaacgggggtcgtacggggtaagggttgggggtcggccgtaagtttaacgtacttcccgttagttacgagtagggaagtaactaaagtaaccgtacctaacgtacggaaccgaaaggtacccgttacggtacgggtaacgggcccggttaagtacgacctactaccgccgtaagaccaacgaaccgtacggaaataacggtcgttaacgttacaaacctaagtaacgacgtaaccgtcgtaacgacggatcgggtagacggtaaccgacgggtttacacgttttaccggtttaacgtgacggttcggaacggtacgtaaacgtgtaactaccg

SEQ ID NO: 193829 - DNA, 884 bp, Homo sapiens
  misc_feature: GYAE6OF02GR82N.52.86.H09.1.454.CMB.1.raw
  modified_base (105)..(105): a, c, t, g, unknown or other
  misc_feature (105)..(105): n is a, c, g, or t
  modified_base (130)..(130): a, c, t, g, unknown or other
  misc_feature (130)..(130): n is a, c, g, or t
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (426)..(426): a, c, t, g, unknown or other
  misc_feature (426)..(426): n is a, c, g, or t
tcagcgcagtacgacacgaccggtgctcgatttagtgctatagacttggggtttggggggggagcctagctgtgctgtgggtccaggaggcagaactctggggtntctcaccatcggcctggactccctntaccttcctcccctctcactctctcgacacgaggcttctaggacggtcccttaccgttagtggacgtctacgaaccacgaccgaccccgtacccgtcggtgtccacgggttcccnccccggaaagaccacggaccggcctaagggtaccnccgaaccttggctccgtaggaagactcgtaactacgtccaaccgaaaaccgtntagttacgtcttacggtacgaccgtagcctaagggaccgcccggccggaccgtcccgtggtggttacggacgttagttaactaaagtaaaacnccacgggttacggaacggtaccggtaccctacggtaaccggtacctttccccggaaggtacggtaccggttaccctttcgtcccggtcggtacccggttacggaacggttccggaaacccggtaccgtaacgggtccttaaacgcgttaacccgacggtttaaccgcgtttaaccgggagggtttaaccccggacgtaacggggtacgaagggaaacccggggtaagccggtttcggttaaaccgtttaaacggttttataaccgttttaaccgtaaccgttaaaacggaacccgttaaaacgggaacccgttaaacccggttaaaccgtttcgttaacgttaaccggttttacggtacggtttaacccggtaacgtaaccgtaaccgggttaacgaaacccccgtttagttacccccgaaggtttacccggaccggttaacccggcccgaaacccgg

SEQ ID NO: 193830 - DNA, 783 bp, Homo sapiens
  misc_feature: GYAE6OF02IALQD.52.86.H09.1.454.CMB.1.raw
  modified_base (63)..(63): a, c, t, g, unknown or other
  misc_feature (63)..(63): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (661)..(661): a, c, t, g, unknown or other
  misc_feature (661)..(661): n is a, c, g, or t
  modified_base (696)..(696): a, c, t, g, unknown or other
  misc_feature (696)..(696): n is a, c, g, or t
tcagcgcagtacgacacgaccggtgctcgatttagtgctatagacttgggtttggggggggancctagctgtgctgtgggtccaggaggcagaactcgtgggtgtctcaccagtggcctggactccctctacttcctccccgtctcacttcgtcgtgaccacgaggtctcgtaggacgtcctctaagngacgctacgaacncacggccctaccgtggttcgtcgaaggttcccgacccgaaggtaccgaggtaccggaccgaggtacctccgtacggtcgtcgttacgggtggaaaggcttacggtactacgttaccgaacctaaaccgtaacgttgtcgttacgttacggttacggaccgaagacggaaccggtaaccgggcccggtaccgtaccggttcccgttggggttacggttcgtaacggtagttaagtaaacgttaaccgacgtaacgtcggtaacggccgtacgtacggacgtccgtacgcgtacggtcttacgtcgtcggtacggtccgtacgggtacggacgggtaaccgacgttaaccgtacgtacgttcccgtaacggtccaacgggtaccgtacgggtaccggtacgacggtaaccggtcggaaacgggacgggtacgagggttaccagttaacggttaactcggtanacctaaggaccaacgtactacgtacgtattacgtnttacggtacgtacgggtactacggaccggttaacacggttacggtaccgtaccggttacggtacggtacccgaacgttaaccccggg

SEQ ID NO: 193831 - DNA, 804 bp, Homo sapiens
  misc_feature: GYAE6OF02IZ2K8.52.86.H09.1.454.CMB.1.raw
  modified_base (142)..(142): a, c, t, g, unknown or other
  misc_feature (142)..(142): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
tcagcgcagtacgacacgaccggtgctcgatttagtgctatagacttgggtttgggggaagaggaagactgacggtccccccaggagttcaggtgctggacacggtgggcgatgtgtgagttttgtcacaagatttgggctnaactctcttgtccaccttggtgttgctgagctgggttttcctcgttgctacttttaagacggtcgtccagtgtcaggtgcagctggtgagtcgtgggggggctggtccaggcgtgggacgttccngagactctccgtgtagcagcctgtggtatccaccttanacgtaccctagtagtaaactgactacggtccggtccgccgaggtccctacgtagggacgtaaggggccgtaggggtacggtacggggtacggtacgtaacgggttttacttaacgtttacccgttaacggtaagttacgggttaaccgggaaaaggtaccgttaaaacgttaaacgaccgttaaccgtaacgggtaccgttacggtaaacggtttcccgggtaaacgggtaaacggggtacccggttaaacggtttccgtaaacccgtaccgtttaccgaccgggaaagtaaccgggtaaacctaaaccgttaacgggtaaaacctaaacgggttttaaccgtttaccgttaacgtaaaccgtaaacgtttacggaaacccgttaccgtaccgtaacggtaccggttaacgacgggttagaaaccgggacgttacggtacgttacgtttacgttacggtcggttacgacggtaggacgtacgttaccggtagttaaccg

SEQ ID NO: 193832 - DNA, 882 bp, Homo sapiens
  misc_feature: GYAE6OF02GDCUY.52.86.H09.1.454.CMB.1.raw
tcagcgcagtacgacacgaccggtgctcgatttagtgctatagacttgggtttgggggaagaggaagactgacggtcccccaggagttcaggtgctggcacggtgggcatgtgtgtagttttgtcacaagagtttgggctcaactctcttcgtcctaccttggtgttgctgagcgttggttttcctcgttgtcttactttaagaggtcgtccagtgtcaggtcgcagcgtggtggtacggtcggtgggggggcgtggtccgaggcgtgggaccgtccgtaggagtaccgttcctccgtagtcgtcgacgtcctcggttcggtaccttacctaccttcgtaaccgtaccctagtaagtaacgtccgtaccgaccgggttccggtacccggtccgacggtcccgtaccggaacggggtacggaacggggtcgtacggggtacgggtggggttacggcgttaacggtttaacgttacgttaccgtaggttacgtagggtaaggtaaccgtacgtaaacgtaaacggtaccgtaaccgttacgaccggtaaacggtaccggttaaccgggtaacggtaaccggggtcgttaacgttacccggtaaccgtacccgtaaccgttaccgaaacgggtaccggtaaaccgtaaccggttaaacggtaaaccggtttaaacggttttacccggttttaacttaaacccgttaaaccgtaaacgttaaaccgtaaccgttaacccggttacgtaacggtaaaggtaaccggtacggtaacgggaccggtaacccggtaacggtttacgtttaacggttttcgttttaccggtaggttacccggaacgggttaacggggtaaccggtaacgttacccggttaaaggtaaccgg

SEQ ID NO: 193833 - DNA, 705 bp, Homo sapiens
  misc_feature: GYAE6OF02F80XB.52.86.H09.1.454.CMB.1.raw
  modified_base (169)..(169): a, c, t, g, unknown or other
  misc_feature (169)..(169): n is a, c, g, or t
  modified_base (186)..(186): a, c, t, g, unknown or other
  misc_feature (186)..(186): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (486)..(486): a, c, t, g, unknown or other
  misc_feature (486)..(486): n is a, c, g, or t
tcagcgcagtacgacacgaccggtgctcgatttagtgctatagacttgggtttgggggtgggtccaggaggcagaactctgggtgtctcaccatggcctggatccctctacttcctccccctcctcactctctgcacgaggctctgacgcctcctatgacgctgacacncgcccacccgttcggtntcacgtcgtccccaggacacggaccgcgaggactcactgctcgnggagtactcgactgttacgaccaaacgtntagtcgtcttacgtcgtaaccgagacggtagaccggtccggccacggtcccttggttcggtgggtgtaagtgtaaacgtaagtaccgtgtaggaccgtacggacccgtacggacggtcctacgtaggagtaccgttacgttcctcggtccgtacgtaccgtacgggtcgaaccggaacgtaaccgtctaacgttacggtccgtactacgtacgacggtaacggtacncggtacggacgtagggacgtacggacgtcggttaactacgttaagttcgacggtaccttaagtaccgaaactccgaacgttacgttaggtttacgttacttacgtcgtttaccgtaggtaactccggtaccgtacggtacccgtacgttcccgacggtacgaccgttaaccgaccggaccctaaccccgtacgtacttaccgtaccgtacttaccccgg

SEQ ID NO: 193834 - DNA, 689 bp, Homo sapiens
  misc_feature: GYAE6OF02F8YVW.52.86.H09.1.454.CMB.1.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagcgcagtacgacacgaccggtgctcgatttagtgctatagacttgggtttgggggtgggtccaggaggcagaactctgggtgtctcaccatggcctggatccctctacttctccccctctcactctctgcacaggctctgagcctcctatgagctgacacagcccacccttcggtgtcagtcgtccccaggaccagaccggccaggactcacctgctcgtggagatgctattcgacccaaaacgntatgtctttattggtaccagcagacgccggcacggccctgtgttggngatagtataagacagtgagacggccctcgagggactcccgtgacgtcgtactttcgtcgtcggcctccggaggtcggaacggtacgaacgggtacacgtagttccgggacctagtacggtacggtgggtaccgtaccggaggacggaagggtaacggacggtacgggtcgtacggttaacttagtttacgtttacggaacttaacgtaccgtaaaccgtaacgtaaccctaacggttaaggtttaccgtttaactttagttaccgtttacgttaccgggtaactcgggtacccgtaaccgttaacggttccggtaaacccggttccggttaccgggcctaaccgggtacccgaaccggcccctaaacccgtacgtccttaccctacgttccccg

SEQ ID NO: 193835 - DNA, 589 bp, Homo sapiens
  misc_feature: GYAE6OF02FY08D.52.86.H09.1.454.CMB.1.raw
  modified_base (418)..(418): a, c, t, g, unknown or other
  misc_feature (418)..(418): n is a, c, g, or t
  modified_base (491)..(491): a, c, t, g, unknown or other
  misc_feature (491)..(491): n is a, c, g, or t
tcagcgcagtacgacacgaccggtgctcgatttagtgctatagacttgggtttgggggaagaggaagactgacggtcccccaggagttcaggtgctgggcacggtgggcatgtgtgagttttgtcacaagatttgggctcaactctcttgtccaccttggtgttgctgagctgggtttcctcgttgctcttttaagaggctccagtgtcaggtgcagctggtgagtcgtggggggggctggtccaggctgggacggtcctgagacgtctccgtgtgcacgtcctcgtggattccaccttcacgtaccatagaatcgctacgtcgggtcccgcgtacggcctaccgaggacgacggggcgtggaggtgggtgactaggttatacgtcctatgagtacgagactaagtagacacgtacgnaggtacgtcggtaggacgggctagtcgaccatcacgtagactacaacgtcgaagtacgtacgttactactaanaacgtcgaactactcctagcgacgctaggtaacggactcggtacgttagttacgtttacgtggtacgtcggtaaggaacggtacgacgttataaccgg

SEQ ID NO: 193836 - DNA, 514 bp, Homo sapiens
  misc_feature: GYAE6OF01BRVEF.36.46.E02.1.454.CMB.1.raw
tcagtacgctgtctcacgaccggtgctcgatttagactcatctacagggaaaggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagaccaggttcagtggcagtgggtctgggacaggacttcacgctcaccatcagcagactggacctgaagattttgctagtctattactgtcagcagtatggtaatactacctcggacgttcgccaagggaccaaaggtaggaaatccgaaaggaactgtggactacgacaccatctgtcttacg

SEQ ID NO: 193837 - DNA, 514 bp, Homo sapiens
  misc_feature: GYAE6OF01EDZ1N.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacaggttcagtggcagtgggtctgggacagacttcacgctcaccatcagcagactggaccctgaagtatttgctagtctattactgtcagcagtatggtaatacaccgtcggacgttcggaccgaagggaccgaaggtaggaaagtcgaaaggacgtggtaggctgcacatctgtcttacg

SEQ ID NO: 193838 - DNA, 729 bp, Homo sapiens
  misc_feature: GYAE6OF01CR08S.36.46.E02.1.454.CMB.1.raw
  modified_base (299)..(299): a, c, t, g, unknown or other
  misc_feature (299)..(299): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgccaccctctcctgcagggccagtcagagtatcagaagcgactacgtagcctggtaccggcaagaaacctggccaggctcccagtcctcctnatctatgatgctactccgaaggtacgggccgtcgtcggacacgtccccgaagaacctaggttccaggtcggcgtagggtgggtcgtagggaacacgtaccttcgacgtcctaccaaccatcacgacgaacgtaccgtcggaaaccctaggtaaaacgtttcgttttacggaccgttaacggtttacctttaaacgttttaaccgttacggttaaccgtaacggtaccgttaaagtttaacgttaacgggtttaaaaccttacccgtaacccgggtttacccgggtaaccggttttacccgggaacccggtaaaacggggtaaacccgtaaaaggggttaaggaaaacgttaaacgggtaaaacggtaacggttcgggtacggtaccgtacggaaccctaaccgtaagtttcgttccgttaccgtttaccg

SEQ ID NO: 193839 - DNA, 461 bp, Homo sapiens
  misc_feature: GYAE6OF01AYA9N.36.46.E02.1.454.CMB.1.raw
  modified_base (449)..(461): a, c, t, g, unknown or other
  misc_feature (449)..(461): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgcaaaaacgggagacccgcccaggtcgggggcttatcattacgactactggggccagggaacccggtcaccgtctcctcacgcctccaccaacgggccccatccggtccttcccccgtggccgcccctgcctccgaggacgccaccctccggagagccacaggccggccctggggctgcctggtcaaggactactccagacagcgtactgacgcgggctgggacaaggcgacagtagnnnnnnnnnnnnn

SEQ ID NO: 193840 - DNA, 568 bp, Homo sapiens
  misc_feature: GYAE6OF01AKSUX.36.46.E02.1.454.CMB.1.raw
  modified_base (319)..(319): a, c, t, g, unknown or other
  misc_feature (319)..(319): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccacctctcctgcagggccagtcagagtatcagaagcgactacgtagcctggtaccggcagaaacctggccaggctccagtctcctcatctatgatgcatccagtagggccnctggcatcccagacgacgtcgtacgtggcgagtgggtcgtggacgacgacgttcacgctcaccactcacgcacgacgtcggacccgtacgtaagtactttgtacacgtacttattacttcgtcacgtactacgtaatacggttaatacgtacccgtacggtaccgttacggaccgaacgggtaccgaaaggtacggtaaacgtacgtaaaggaacgtggtcggacgtcgacaccatcgtgtcgttaccg

SEQ ID NO: 193841 - DNA, 593 bp, Homo sapiens
  misc_feature: GYAE6OF01DPA65.36.46.E02.1.454.CMB.1.raw
  modified_base (268)..(268): a, c, t, g, unknown or other
  misc_feature (268)..(268): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagccgtggtacccgnacgaaacctggaccaggcctcccagtcctcctcatctatgatgcatccaggtacggccgcgtggccacgtcccagactaggttcaggtcggactaggtcgggtcgtgggacaggtacttcgacgtctacaccatacagcagtacgtcggacctagtaagtagtttcgactacgtacttaattactgtactagtactaagtattaggtaacttaccgaccgttacggtacgttcggaccgaacgggtacgaaacggtaaggtaaacgtacgaaaggtaacgttaggtacggtacgtacgtaccaactactacgttcgttcttaccg

SEQ ID NO: 193842 - DNA, 590 bp, Homo sapiens
  misc_feature: GYAE6OF01CY83I.36.46.E02.1.454.CMB.1.raw
  modified_base (335)..(335): a, c, t, g, unknown or other
  misc_feature (335)..(335): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgccaccctctcctgcagggccagtcagagtatcagaagcgactacgtacgcctaggtacccggacaacgaaacctggcccaggcctacccagtcctcctcatctatgatgcatccgaggtacgggccncgtggccactcccagactaggttcagtggctaggtgggtcgagggactaggtacttcgacgcctacaccatcagcagacgtcggacctagaagtatttgactagtctattactcgtcagtcgtaagtagttaggtaactaccgtacgtcggtacgttcggaccgaacgggtaaccgaagggtaaggtaaacgtacggaaaggtaacgttacgggtacggtacgtcgaccgtaacctagttacctcgttcttaccg

SEQ ID NO: 193843 - DNA, 715 bp, Homo sapiens
  misc_feature: GYAE6OF01A0KB9.36.46.E02.1.454.CMB.1.raw
  modified_base (206)..(206): a, c, t, g, unknown or other
  misc_feature (206)..(206): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagatatcactggagaaatagtgatgacgcagtctccaggcaccctgtctgtgtctccgaggggaaanacgcccaccctctcctgcagggccagtcagagtgttagtaccgacttggcctggtaccagcagaacctggccaggcctccgaggcctcctcatctagtcggtcgcactcccaccgagggcccacgttggtactccccgagggtcccgttcaggttcggcgtagggtcgggtcgtcggggacaggtacgttccgaacgtcttaccaacctagtccgaggcctaacggtccctaggaccgaaggtaggttaggtaaacgtacgttttccggacgtttaaggtttttagtttacgtttggtaccgtaaggtaccgtaagtttaaacttaaacgttaaccgtcgggtacccgttaccgggttaccgttaccggtttccggggaacgggtaacggggtaacccggtaaggggttacgggaacggtaacgttaaccggaaaaccggttaacggttcgggtacgggtacccgttaacgggaccctaaacccgtcgttacccgttcggtttaacccg

SEQ ID NO: 193844 - DNA, 565 bp, Homo sapiens
  misc_feature: GYAE6OF01D7IOH.36.46.E02.1.454.CMB.1.raw
  modified_base (205)..(205): a, c, t, g, unknown or other
  misc_feature (205)..(205): n is a, c, g, or t
  modified_base (361)..(361): a, c, t, g, unknown or other
  misc_feature (361)..(361): n is a, c, g, or t
  modified_base (525)..(525): a, c, t, g, unknown or other
  misc_feature (525)..(525): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccgggggaaanagccaccctctcctgcagggccagtcggagtgttttcagctacttaatgtggtaccaacagaaacctggaccaggctcccaggctcctcatctatgatgacttaccaaaacggcccctggccatcccaacaggttcagtgccagtggtctgggacngacttcactctcacatcagcagcctaggacacctagaacgtattttcgacttacttttattactcgtacaacacgtaccgtaccaacgtcggaccggtaccggttcggaccgaacgggaccgaacgggtacgaacggtaccaaacgtaactcgtagctgcaccntctcgtcttcattcctcccgctactctagancngcgtacg

SEQ ID NO: 193845 - DNA, 664 bp, Homo sapiens
  misc_feature: GYAE6OF01EPYJB.36.46.E02.1.454.CMB.1.raw
  modified_base (320)..(320): a, c, t, g, unknown or other
  misc_feature (320)..(320): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccgcagaacctggccaggctccagtcctctcatctatgatgcatccaggtacgggccnctggacactcccagactaggttcaggtcggcaggtgggtcgtgggaacagacttcgacgctccaacctatccgagcgagactcgggtaccctaggaacgttattttcgacctagttccttaagtttactggtaccaggtactaaggttaatacggttaactaccgtacccgttacgggtaaccggtttaccgggaacccggtaaacggggtaacccgtaaaaggggttaacgggtaaaaaccggttaaccggtaaaacggggtaaaccgttcgggttaacggggtacccgttacgggtaacccgtaaaccttaacggtttccgttacgtttcccgtttaacccg

SEQ ID NO: 193846 - DNA, 557 bp, Homo sapiens
  misc_feature: GYAE6OF01A70PY.36.46.E02.1.454.CMB.1.raw
  modified_base (437)..(437): a, c, t, g, unknown or other
  misc_feature (437)..(437): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcaagaaacctggccaggcctccagtcctcctcatctatcgatcgcatccaggtacgggccgctggcactcccagaccgaggttcaggtggctaggtgggtctgggacagacttcgacgctacaccatcagcagactcggaccctagaacgtatttagctagttctattacngtacagctagtataggtaactacgtaccgttcggacgttcggaccgtaacggaaccgtaaggtacggaaagtacgaaaggtaacgtcggaggtacgacgtacactatcgtcgtcttaccg

SEQ ID NO: 193847 - DNA, 493 bp, Homo sapiens
  misc_feature: GYAE6OF01COV4W.36.46.E02.1.454.CMB.1.raw
  modified_base (355)..(355): a, c, t, g, unknown or other
  misc_feature (355)..(355): n is a, c, g, or t
  modified_base (478)..(493): a, c, t, g, unknown or other
  misc_feature (478)..(493): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgacaaaaacgggagaccccgcccagggtcgggggcttatcattacgactactggggccacgggaacccggtcaccgtctcctcacgcctccaccaagggcccagtccggtccttccccctggcccgccctcgcctccgaggacnccacccgtccgagacgccacgacggccggccccgtggggcctcgcccgtggtaccgaaggtacctaccttccaagaccaggcgtacgtggacggcgggaccgtggacaacgggcgacagtagnnnnnnnnnnnnnnnn

SEQ ID NO: 193848 - DNA, 579 bp, Homo sapiens
  misc_feature: GYAE6OF01DM759.36.46.E02.1.454.CMB.1.raw
  modified_base (410)..(410): a, c, t, g, unknown or other
  misc_feature (410)..(410): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctccagtctcctcatctatgatgcatccaggtacgggccgctggcactcccagacaggttcaggtggcaggtgggtctggggacagaccttcgacgtctcaccatcagcagactcggaccctgaagtntttgctagtctattactgtacagcagtataggttaactaccgaccgttacgggtacggttccggaccgtaaacgggtacccgtaaagggttacggaaaacgttacggaaaagggtaacgttagggtacggtaccgtacgaccgtaacctagttccttcgttccttaccg

SEQ ID NO: 193849 - DNA, 557 bp, Homo sapiens
  misc_feature: GYAE6OF01D4S01.36.46.E02.1.454.CMB.1.raw
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (443)..(443): a, c, t, g, unknown or other
  misc_feature (443)..(443): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcaagaaacctggccaggctcccagtctcctnatctangatgcatccaggtacgggccgctggcactcccagactaggttcagtggcaggtgggtctgggacagtacttcgacgctacaccatcacgcagaccgtggaccctagtaacgtattttgctagttactattactgtcagtnaagtataggtaatactaccgtcggtacgtcggaccgaacgggaccgaagggtagaaacgtacgaaagggtaacgtggtacgtcgtacgtacaaccgtattcgttgttcttaccg

SEQ ID NO: 193850 - DNA, 566 bp, Homo sapiens
  misc_feature: GYAE6OF01AE2OM.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagccgtggtaccggcaagaaacctggccaggcctcccagtcctcctcatctatgatgcatccaggtacgggccgcgtggccactccccgaagacctaggttcaggtcggcaggtgggtctagggacagtaccttcacgctcaccatcagcagacgtcggaccgtgaagtactttgctagtcttattacgtgtcagtcgtagtattaggtaactaccgacccgtaggtaccgttcggaaccgaacgggaccgaaaggtacggaaagtaccgaaaggacgtggtacggctacgaccacctatccgttgttcctac

SEQ ID NO: 193851 - DNA, 669 bp, Homo sapiens
  misc_feature: GYAE6OF01DW8M4.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagacaccctgtctttgtctccaggagacagacgccaccctctcctgcagggccagtcagagtatcgagagcgactacgtagccgtggtaccggacaacgaaacctggaccaggcctcccgacgtcctcctcatctatgatgctagtccgaggtacgggccgcgtcggcacgtcccgagacgtacggttcaggtggcgtaggtgggtcgtgggactaggtacttaccgacggtcctaccgaccgtactaccgacgtaccgaacgtaccggtccggtaacccgttaaggtaacgttacgttttcggacgtacgttacgttatttaccgttgtaccagtacgtaggttagttacggttaactaccgtaccgttaccgggtaccggttaccgggaaccggtaacgggaaccgtaaacgggtaggtaaacggtaaccgtaaaggacggttaggtacggtaccgtacgtaccgaacctagttacttcgttccgttaccg

SEQ ID NO: 193852 - DNA, 580 bp, Homo sapiens
  misc_feature: GYAE6OF01EX05I.36.46.E02.1.454.CMB.1.raw
  modified_base (330)..(330): a, c, t, g, unknown or other
  misc_feature (330)..(330): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcaagaaacctggccaggcctcccagtcctcctcactctatgtatcgcatccgaggtacgggccncgtggcactcccagacaggttcagtggcaggtggtctgggactaggacttcgacgtctaccaccgtatcgagcagactcggaaccctagtaacgtattttgctaagttctattactgtacagtctagttagtaggtaactacgtaccgtcggtacgttaccggacgaacgggaaccgtaaggtaacggaaagtaacgaaaaggtacgtagggtacggacgttacgaccgtacctatccgttgtccttacg

SEQ ID NO: 193853 - DNA, 554 bp, Homo sapiens
  misc_feature: GYAE6OF01BGEU2.36.46.E02.1.454.CMB.1.raw
  modified_base (325)..(325): a, c, t, g, unknown or other
  misc_feature (325)..(325): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggcctcccagtcctcctcatctatgatgcatccaggtacgggccncgtggcactcccagacaggttcagtggcgagtgggtctgggacagacttcacgctcaccatcagcagactcggaccctgtaagtatttgctagttctattactgtcagctagtataggtaactaccgaccgttacggacgttcggaccgtaacgggaccgtaaagggtaaggtaaacgtacgaaaggtacgtggtacggtactacggaccacgtagtctgttcttaccg

SEQ ID NO: 193854 - DNA, 535 bp, Homo sapiens
  misc_feature: GYAE6OF01DCJGP.36.46.E02.1.454.CMB.1.raw
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
tcagtacgctgtctcacgaccggtgctcgatttagactcatctacagggaaagggggaagaagagctgctcagttaggacccagagggaaccatggaaacccagcgcagcttctcttcctcctgctactctggctcccagacaccaccggagaggttgtgttgacgcagtttccagacaccctgtctttgtctccaggagacagagcccaccctctcctgcagggccagtcagagtatcagaagcgactacgtagcctggtaccgcagaaacctggccaggctcccagtctcctcatctatgatgcatccagtacgggccgctggcactcccagacagttcgagtggcaggtgggtcngggacagtacttcgacgctcaccatcngacagacgtacgaccctagaagtactttgctacgttactattactgtcagctagtatacggtaatacgtacctcggtacgttcgacgaaggaccgaaggtagaaacgtacgaaaggtactggtaggtcgtacgtacactatctgtcgtac

SEQ ID NO: 193855 - DNA, 767 bp, Homo sapiens
  misc_feature: GYAE6OF01CDZ3F.36.46.E02.1.454.CMB.1.raw
  modified_base (349)..(349): a, c, t, g, unknown or other
  misc_feature (349)..(349): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagaccaccaccggagaggttgtgttgacgctagtttccagaccaccctgttctttgtctccaggagacagacgccaccctctcctgcgacgggccagtcagagtatcgaagaagcgactacgtacgcctaggtaccgcaacgaaaccgtcggaccacggtcctcccgagtcctcctctatcctagtgatcgcactccgaggtacgggccngtcggctactccgaagtacgtaggttcaggtcggacgtaggtcggggtactcggggaactacggtaccttcgaaccgtcctaccaacctactacgacgacgtaacggtacgtaccggacccgtaagtaacgttacgttttcgacgttaacgttacgttaacgtttacgttacgtacgaacgttaacgtaaggtttaacggtttaacggttaaacgtttaacccgtaaccggttaaccgggttaacccgggtttcccgggaaacccgggtaaaaccggggtaaaccggtaaacgggggttaaacggtaaaaaccggttaaaacgggtaaaacgggtaaaccgggttacgggttaacggtaccgttaccgtaaacccgtaaccgttaacggttaccgtttccggttaaccctttaacccg

SEQ ID NO: 193856 - DNA, 784 bp, Homo sapiens
  misc_feature: GYAE6OF01BVPEU.36.46.E02.1.454.CMB.1.raw
  modified_base (195)..(195): a, c, t, g, unknown or other
  misc_feature (195)..(195): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctgctcccagacaccacggagaggttgtgtgacgctagttccagacacctgtctttgctcagganacagacgccaccctctcctgcgacgggccagtcaagagtatacgaagaaacgcgtaactacggtaacgccgtaggtaccggacaacggaaaccgtggacccacggcctacccgagttcctcctacaacttctaagtacggtaactcgacctaacgttacccgaagggtaccggggcccgtcgtcgggaccctactaccccggaaggtaccgtaggtttaccaaggggtcggacgtaagggttcgggtacctaggggaactaagtacccgtttcgaaccgtctaaccaacctacgtaccgaacggaccgtaacgaaccgttacggaacccgttaaggtaaacgttaggtttacgacgttaacgttaccttaattaaccgtggtaacaacgtacgttaacgttaacgttaacggttaaactacccgtaacccggttacggggtaacccggttaccgggaacccggtaaacggggtaaaaccggtaaacgggttaaacgggtaaaacgtaaacgggtaaaacggtaacggttacgggtacggtaccgtaacggtaacccaaccgttacgttacgttccgttacgttaacccg

SEQ ID NO: 193857 - DNA, 611 bp, Homo sapiens
  misc_feature: GYAE6OF01A0EVJ.36.46.E02.1.454.CMB.1.raw
  modified_base (322)..(322): a, c, t, g, unknown or other
  misc_feature (322)..(322): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtacggccgntggcatcccagacaggttcagtggcaggtgggtctgggacagacttcgacgctacacatcagcagactggaccctgaagtatttgactagtcgtattacgtcgttacagtactagttaattagggtaaactaccgtaacccgttaccgggtaacgtttaccgggaacccgtaaacggggaacccgtaaacggggtacgggtaaaacgttaccggaaaagggaaccgttagggttacgggaccgttacggtacctaacccgaacgtttccgttcggttccgtttaacccg

SEQ ID NO: 193858 - DNA, 783 bp, Homo sapiens
  misc_feature: GYAE6OF01CJ5W0.36.46.E02.1.454.CMB.1.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagngtancagaagcgactacgtagcctggtaccggacaacggaaacctggaccaggcctccagtctcctcatctatgactgacactccgaaggtacgggccgtacgtcggacctaacgtccccgaaggtaaccgtagggtttaccagggttcgggaccgtaagggttcggggtaccgttaggggaaccacggtaaccgtttacgaaccgtcgttaaccaacccgtaacgtacgaacggacctaacggaccgttacgggaaccccttaggtaaaagtttacgtttttacgaccgttaacggttaccgttaagttttaccgttagttaccgtaacgtacgtaaacggtttaagttaacgggttaaacttacccggaaaccccgttacggggttaaccggttaccgggtaaccccggtaaaacgggggtaaacccgtaaaacggggttaagggtaaaaacgtaaaccgggtaaaaagggtaaccggttaacgggttagggtaccggtaccggtaaccgtaacctaaggtttcccttaacggttcccgtttaaccc

SEQ ID NO: 193859 - DNA, 762 bp, Homo sapiens
  misc_feature: GYAE6OF01B3T9Q.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccgcaaggaaaccctggaccaggcctccagtcctcctcatctatgatgcatccaggtacgggccgtcgtggccactcccgaagtaccgtacggtttccaggttcgggacgtagggttcggggtcgtacgggaactacggtacctttcgaaccggtctaccaaccgactaccaacgtacgaacggtaccgtaccgggtaaccccgtaaggtaaacgttaacgtttttaggaccgttaacggtttacctttaacgtttaaccgttacgttacgtaacggtacgtaaggtttaacgttaacgggttaaaccgttaacccgttaccccgttaacccggggttaccggtttaacccggggacccggtaaaaccggggtaaacccggttaaacggggtaaacgggtaaaacgtaaccggtaaaacgggttaaaccggttgggtaccgggtacccgttacggtaacccgaacccgttaacgttcccgttcgtttacccgttaacccg

SEQ ID NO: 193860 - DNA, 742 bp, Homo sapiens
  misc_feature: GYAE6OF01ALH09.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgccaccctctcctgcagggccagtcagagtatcagagcgactacgtagcctggtacccggcacgaaacctggaccaggcctcccgagtcctcctcactcctatgactgctactccgaggtacgggcccgtacgtcggaccacgtacccgaaggtaccgtacggttccgaaggtcgggacgttacgggtcgggtccgtagggggaacctaaggtaccctttacggacccgtacccgttacccaacccgtacgtaccgaacggtaccgaacggtacccggttaccggtaaccccgttaagggtaaaccgtttacgttttacggaaccgttaggttacctttaacgttaccgtcggttacaacggtacttaacgttaacgtacggttaaacttacccggtaaccgttaccgggtaccgttaccgggaacccgtaaacgggtacccgtaaaggggtaacgtaaaaccgtacggaaacgggttacgtcgggtacgtaccgttacggacccttaactacgttcgttacgtccgtttacccg

SEQ ID NO: 193861 - DNA, 757 bp, Homo sapiens
  misc_feature: GYAE6OF01CQ2HB.36.46.E02.1.454.CMB.1.raw
  modified_base (252)..(252): a, c, t, g, unknown or other
  misc_feature (252)..(252): n is a, c, g, or t
  modified_base (747)..(747): a, c, t, g, unknown or other
  misc_feature (747)..(747): n is a, c, g, or t
tcagtacgctgtctcacgaccggtgctcgatttagactcatctacagggaaagggggaaagaagagctgctcagttaggacccagagggaaccatcggaaaccccagcgcagcttctcttcctcctgctactctggctcccagacaccaccggagtaggttgtgttgacgctacgtttccagacaccctgttctttcgtctccgaggagacaggacgcccaccctctcctgacgacggccagtcgagagtancgagaacgcgaactacgtacgcgtacggaccgacaacgaaaccgtcgaccgtaggcctccgtacgtcctcccgtctacttactagtcgatcgactacgtaccggtaggtaccgggtccgtcgtacggtacctacgtacccgaggtaccgtacggttacgacggtacggcgtacgggttcggtaccggagggtaaccgacgttacgttaccgaccggttaccacccgtaaccgtacgtaccgaacggaccgaacggtaaccggtcccggtaaacccgttaaggttaaacggtttcgtttacggacgtttaacgtttacgttaacgtttacttcggtaataccggtacgttaacggttaagttacgggtaaacctaccggttacccggttacgggtaaccgttacggaaccggtaaacggtaacgtaacgggtaagtaaaaccgttacggaaacggtacggtacgtacggaccgttaacgccgtaactacgtcgttntcccgttacg

SEQ ID NO: 193862 - DNA, 582 bp, Homo sapiens
  misc_feature: GYAE6OF01EY209.36.46.E02.1.454.CMB.1.raw
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctctcagacaccaccggagaggttgtgttgacgcagtttccagacaccctgtctttgtctcaggagacagacgccaccctctcctgcacgggccagtcagagtatcagagcgactacgtacgcctggtaccgcagaaaccgtggaccaggctccagtctcctcatctatgatgcatccaggtacggccgntcggcactcccagacnggttcagtggcaggtcggtctgggacngtacttcgacgtctcacatcagacgacgtacgtacggtaccctagtaacgtagttttagacgttagttacttacttacgttcgtctagtactaagttagtagtaactaccgtacgttacggaccgttacggaccgaacgggtaccgaagggttaggtaaacgtagaaacggtacgtacgtaggacgtacgactaaccgtacgttccgtcgttacg

SEQ ID NO: 193863 - DNA, 648 bp, Homo sapiens
  misc_feature: GYAE6OF01CW13H.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctccctgccagggccagtcagagtatcagaagcgactacgtacgccgtaggtacccggacaacgaaaccgtcggacccgagggtacccttccccgaagttcctaccctcgactcctatcgatcgacacgtccgaaggtacgggccgtcgtgccactacccgagaccgtaggttcaggtggacgtagggttggtaccgtgggactacggtccttacgacgtcctaccacctacgtcgacgacacgacgtacgtaccgtagtaacgtgtttcgactacgtactacttacgtcgtacagtacgtaagttagttaggtaactaccgtaccgttcggtaccgttacggaaccgtaacgggtaccgaaggtacggaaagtaaccggaaggtaacggttcggtacggacgtcgtacctacgtattcgtcgttcgttacccg

SEQ ID NO: 193864 - DNA, 815 bp, Homo sapiens
  misc_feature: GYAE6OF01C5ZS2.36.46.E02.1.454.CMB.1.raw
  modified_base (132)..(132): a, c, t, g, unknown or other
  misc_feature (132)..(132): n is a, c, g, or t
tcagtacgctgtctcacgaccggtgctcgatttagactcatctacagggaaagggggaagaagagctgctcgagttaggacccagagggaaccatggaaaccccagcgcacgcttctcttcctcctgctacnctggctcccagaccaccgaccggagtaggttgtgttgacgctagttccagaccaccctgtctttgctaccgaggtagacgaggacgcccaccctctcctgaccgagggccctagtccaagacgttacgacgaagtaacgtacgtaaccgtacggtacgaccgtaacggtaacccggaacaacggtaaacccgttcggacccgaacggtccctacccgaacggtacccctacccgtactaacgttaccgttagttacgggttaccaccgtaccgtaccggtaggtaaccggccctaacgtcggacctaccgaccccgaaggtacgtacggttacgaggtacgggtacgtagggttcggtacgtacgggacctacggtacctttaccgaacttcctaaccaccgtagttaccgaacgacgtaacgtaccgtacggacggtaccgtaaggtaacggttacgtttcggtaccgttagttacttaccggttacttaaccgtaagttaccgttacgttaccggttaaccttcgttacgtttacgtaaccgtttaccgtttaccgggaaccggtaaccgggtacctaacggaccggtaaggaacggttaacgaaacccgttaaaacggtccggttaacggtacggtacccgtacgtaacccgtacgttaccttccggttcgtttaccccg

SEQ ID NO: 193865 - DNA, 782 bp, Homo sapiens
  misc_feature: GYAE6OF01C0J3A.36.46.E02.1.454.CMB.1.raw
  modified_base (153)..(153): a, c, t, g, unknown or other
  misc_feature (153)..(153): n is a, c, g, or t
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
tcagtacgctgtctcacgaccggtgctcgatttagactcatctacagggaaagggggaagaagagctgctcagttaggacccagagggaaccatcggaaaccccagcgcagcttctcttcctcctgctactctggctacccagacaccacggngtaggttgtgttgacgctagtttccagacacccttgttctttgtcctaccgaggagacncgacgccctacctcgtcctgcgacggccagtcagagtancgaagaacgcgaacgtacgtacgccgtacggtaccgganaacggaaaccgtcggacctaacggcctacccgtacgttccctcctactacttcttagtaggacttggaccctacgtccggtaaggggttacggcccgtcgtacggacctaaccgtaccgagttaccgtaggttcgaacgggtcggacgtagggttcgggtcgttaggggacctacgtacgttacccgacgtccctacacgacgtccgaacgaccgtacgtacgggtaccgtaccgttagtaacgtttacggtttcgacctttaacggtacctttagtttaccgtagtacgtaatcggttaaacggtttaagttaaccgttaaccgttaccgtaaccgggttccgttaaccgggtccgtaaaccgggaaacgggtttaaccgaaaggggttaaacaaaaccgggtttaaaaggtaacccgggtaaggttgggtacccggtaccggtaactacccgggtaactttccgttacgttacggtttccttaaacccgg

SEQ ID NO: 193866 - DNA, 562 bp, Homo sapiens
  misc_feature: GYAE6OF01BJUGW.36.46.E02.1.454.CMB.1.raw
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaaccctggccaggcctcccagtcctcctcatctagtgatgcatccgaggttacgggcccgcgtggccactcccgagactaggttcaggtggcaggtgggtctgggactagacttcacgctaccacancagnacgactcggtaccctgaagtatttgctagtctattactgtactagctagtataggtaactaccgtaccgttacggtaccgttcggaccgaacgggtacctaacgggtagaaagtacgaaggtacgtggtacgtacgtcgtaccactatccgttgtcttacg

SEQ ID NO: 193867 - DNA, 688 bp, Homo sapiens
  misc_feature: GYAE6OF01ENPW5.36.46.E02.1.454.CMB.1.raw
  modified_base (193)..(193): a, c, t, g, unknown or other
  misc_feature (193)..(193): n is a, c, g, or t
  modified_base (345)..(345): a, c, t, g, unknown or other
  misc_feature (345)..(345): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagaccaccaccggagaggttgtgttgacgcagttccagacaccctgtcttgtcncaggagacagacgccaccctctcctgcgacgggccagtacagagtatcgagagcgactacgtagcctaggacccggacaaggaacctcggaccgacggcctcccagtcctcctacatctatgagtcgactacgtaccgagggtacggcccgngtcggacacctcccgaagaccgtacggtcgaggtcggacgtacgggttcgggccgtagggactaacggtccgttaccgacgtcctaccgaccgtagtccgacgtacgaacggtaccgtacgacccgtagtaacgtttacgtttcgaccgttaacgtaccgtttataccgttagtaccgtaagtcgtaaggttacgtacggtaacctaccgtaccgtacgggtaccggtaccggaacggtaaacggaccggtaaaggtaacggtaaacgttaacggaaaccggttaacggcgggttaacgagttacccggaacctacgtaacgttccgtttagtcccgttaccc

SEQ ID NO: 193868 - DNA, 682 bp, Homo sapiens
  misc_feature: GYAE6OF01AQOP2.36.46.E02.1.454.CMB.1.raw
  modified_base (442)..(442): a, c, t, g, unknown or other
  misc_feature (442)..(442): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgctccaggagacagagccacctctcctgcagggcagtcagagtatcaagagcgactacgtagccgtggtaccggcagaaacctcggccaggcctccagtctcctcattctatgatcgactactccaggtacgggccgtcgtggcctacgtccccgaagtaccgtaggtttccgacgggttcggaccgtaacgggttcgggtacggttacggggacctaacggtacctttccgaccggtcctaccgaaccgtntaccgagacctaacggaccgttaccgggtaccctaagggtaaacgtttacgttttcggacttagtaccttaagttaccgtgtcgaagtcgaagttacttacggttaacctaccgtaccgtacgggtacccgttaccggaaccgtaaccggggtaactaaacgggtaaccggtaaacgtacgaaaacggtacggtacgtacggtacttaacgtaccacgttaatccgttgttccttaaccg

SEQ ID NO: 193869 - DNA, 697 bp, Homo sapiens
  misc_feature: GYAE6OF01CP980.36.46.E02.1.454.CMB.1.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagaccaccaccggagaggttgtgttgacgctagtttccagacaccctgttctttgtctccgagganacagacgcccaccctctcctgcgacgggccagtcagagtancgaagaacgcgaacgtacgtacgcgtcggtaccggacaacggaaaccgtcggaccgtacggcctcccacgttcctaccgtctataccgttatgagtcgcactccgaaggtcggcgcgtacgcaccgtacccgagtaccgtacggtacgtacggtggtacgtagggtacgggtcggtagggactacgtaccgttacgacgtcctaccacactcgacgacgtagtaccgtacggaccctaggtaacgttacgtttacgtcgtaagttacctttagttaccgtagtactagtacgttaagtaacttacggtaacctaccgtaccggttaccgggtaccgtaccgggaaccggtaaacgggtaacggtaagggttaaacgaaacgtaaacgtaaacgggaacgttcggtacggtacttccgaacctaccgttattaccgttgttaccgttaaccg

SEQ ID NO: 193870 - DNA, 728 bp, Homo sapiens
  misc_feature: GYAE6OF01AP43X.36.46.E02.1.454.CMB.1.raw
  modified_base (273)..(273): a, c, t, g, unknown or other
  misc_feature (273)..(273): n is a, c, g, or t
  modified_base (338)..(338): a, c, t, g, unknown or other
  misc_feature (338)..(338): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtagttgacgctagtttccagacaccctgtctttcgtctccaggagacagacgccaccctctcctgcacgggccagtcagagtatcgagaagcgactacgagcctggtacccggnaacgaaaccgtggaccaggcctcccagtcctcctcatcctatgatgcatcctaggtacgggccgngtcggacactacccgagtaccgtaggttcaggtacggccgtaaggtcgggtacgtacggggtactacggtacccgtttaccgaccggtccgtaaccgtaacccgtacgttacccgaacggtacccgtaacggtacccggttacccgggtaaccccgttagggtaaacgttaacgtttttacggaccgttaagtttaccgtttaacttaccgttacggtactacggtaccgttaaggttaacttacggttaaacgtaccgttaacccggttcggttaacccggttaccggaacccggaacgggtaccgtaaagggtaacggtaaagtaccggaaaggtacgtaggtacgtacggtacgtaccgtaacgtacgttccgtcgttccgttaccg

SEQ ID NO: 193871 - DNA, 573 bp, Homo sapiens
  misc_feature: GYAE6OF01A46E3.36.46.E02.1.454.CMB.1.raw
  modified_base (305)..(305): a, c, t, g, unknown or other
  misc_feature (305)..(305): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgcccaccctctcctgcagggccagtcagagtatcagaagcgactacgtagcctggtaccggcagaaacctggccaggctcccagtcctcctcatctangatgcatccaggtacgggccgctgggccactcccagactaggttcaggtcggctaggtgggtctagggacaggcttcgaccgctccaccatcacgcacgacgtcggaccctagaacgtatttcgctagttctattactgtcagtctagtactaggtaactacgtacctcggtacggtccggaccgtaaacgggacgtaacgggtaggaaacgtacggtaaaggtacgtggtacgggtctacgaccactattcgtcgttccgtttaccg

SEQ ID NO: 193872 - DNA, 692 bp, Homo sapiens
  misc_feature: GYAE6OF01EBPKN.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacacctgtctttgtctcaggagacagacgccaccctctcctgcagggccagtcagagtatcgagaacgcgtactacgtagccgtacggtaccggacaacgaaccgtcggaccgacggcctacccgagtcctcctactactcgtatgactcgctacgtccaacgggtcgggccgtcgtggacctactacccgagaccgtaggttaccgaggtcggacggtaggtgggtcgtacggggaactaacggtacgtttaccgaaccggtcctaccgtaacccgacgtaccacggtactaacggtaccgtccggaaccgttaggaaacgttacttttcgacgttaacgttacttacgttacgtacgtactacgactaagttagtagttaactaccgtacgtaccgggtacgttaccgggaaccgtaaacgggaccgtaacgggtaaacggtaaacgtaacgaaaggtacggttacggtacggtacgtaacgtcccgaactacgttcttccgttacttacccg

SEQ ID NO: 193873 - DNA, 814 bp, Homo sapiens
  misc_feature: GYAE6OF01BMFC8.36.46.E02.1.454.CMB.1.raw
tcagtacgctgtctcacgaccggtgctcgatttagactcatctacagggaaagggggaagaagagctgctcagttaggaccagagggaaccatcggaaaccccagcgcagcttctcttcctcctgctactctcggctacccagaccaccgaccgggagtagggttgtgttgaccgctagtttccagtaccacccttgttctttcgtcctaccgagggacgacagacgcccctacccgttctccgtggaccgtacggggccctaaggtccaaggtaacgtactaccggaaggaacggccgtaacgttaccggtaacggtcccgttacggggtaacccggacgtaaacggtaaaacccgttcgggaccccgaacgggtcccttaccccgtaaggttcccttaccccttactacgttaccttaagtacgtaacgtcggtacctacgttacccggaagggttaccgggccccgtcgtacgggacccctaactaccccggaaggtaccggtacggtttaccggaggttacgggcgtaacgggttcggggtaccgtacgggggaacctacggtacctttcccggaaccgtccgttacccaaccgtacgtaccgaacggtaccgtaacggtaccgtaccggtaacccgtagttaacgttacgtttacgtaccgttacgttacctttaacgttacgtacgtacgtacgtacgtaacgttagtacgtactaccgacgttacgtcggtacgacgacggaacgtaggtaacgaacgtacgtaaggacgtcggcgtacacggtacaccgtagtctcgttcttaccg

SEQ ID NO: 193874 - DNA, 698 bp, Homo sapiens
  misc_feature: GYAE6OF01BKTAK.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgcccaccctctcctggcacgggccagtcagagtatcaagacgcgtactacgtaggcccgtacggtacccggcaacggaaacccgtggcccgaacggccctaccccgaggttaccctccccgttacaacgtccgtatcgtaatcggacctacgtacccgaggttacgggccccgtcgtggaccacgtcccgagtacggacgtttgacggtggaccgtaggtcggtacgtcgggactacgtccttaccgacgtcgtaccaaccgagtccgacgacgaacgtaccgtacggtacccgtaggtaacgttactttcggacctaacggtccttaagttctacggtacagtacgtagtaacgttaggtaaccttaccgacccggttacgtacgttaccggaaccgtaacgggtaccgaaaggtaacgaagtaaaccggtaaacggtacgttcgggacgtaccgacgtaaccgtacctacgtcgttcgtacctttcccg

SEQ ID NO: 193875 - DNA, 792 bp, Homo sapiens
  misc_feature: GYAE6OF01BWC94.36.46.E02.1.454.CMB.1.raw
  modified_base (383)..(383): a, c, t, g, unknown or other
  misc_feature (383)..(383): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttcagacacctgtctttgtctccaggagacagagccacctcctcctgcagggccagtcagatatcagaagcgactacgtacgcctggtaccggcaacggaaacctggaccacgggcctcccaacgtcctaccgtctacgtctatcgatcgacactccgtaggtacgggccgcgtcggacacgtcccgagtacgtacggttcaggtcggacgnggttcgggtcgtagggaactacggtaaccgtttccgaaccgtaccgtaccaaccgtactacgtaacgacgtaacggaaccgttacgggaacccgttaggtaaacggttacgtttttacggaccgttaacgttacctttaagtttaccggtttacgtacgtaacgtaaccggttaacggtttaaacgtacggttaaaccgttaacccttccggttaacccgggggttaaccggtttacccgggaaacccgtaaaaccggggggttaaccccgtaaaagggggtaaaccggttaaaaaccggtaaccggtaaaaaccggggttaacgttacggggtaacgggtacccggttaacggtaacccgttaacccgttaaacggtttcccgttaggtttaaccccgtttaacccgg

SEQ ID NO: 193876 - DNA, 768 bp, Homo sapiens
  misc_feature: GYAE6OF01A0V4Q.36.46.E02.1.454.CMB.1.raw
  modified_base (242)..(242): a, c, t, g, unknown or other
  misc_feature (242)..(242): n is a, c, g, or t
  modified_base (366)..(366): a, c, t, g, unknown or other
  misc_feature (366)..(366): n is a, c, g, or t
  modified_base (585)..(585): a, c, t, g, unknown or other
  misc_feature (585)..(585): n is a, c, g, or t
tcagtacgctgtctcacgaccggtgctcgatttagactcatctacagggaaagggggaaggaagagctgctcagttaggacccagagggaaccatcggaaaccccagccgcagccttctcttcctcctgctctctggctcccagaccaccgaccggagtaggttgtgttcgacgctagtttccaacgacctacccgttgttcttttcgtacctaccgaggacgacacgacgtccctaccctntccgtcgcgacgggccagtctagagttacacgagaacgcgaccgtagtacgccgtacggtaccgacgaagtaacccgtggccgacggtaccctcctagtccctccgtcacttccgtagtaccgngttcaccgtacttacccggaaggtaccgggcccgtaagccggccctaaacgtcccggacttaccggtaccggttagagggtaccggcgtggggtacggtttcccgggaggacgttaccgtacgttccgaccggtcctaaccgaacctacgtaccgacgacgaccgttacgaccggtaccgttagaacgtttacgttacgcgtaccgttactagtttacncgtacgtacgtacgttaagtacgttaacggttaactacccgttacgtaccggttacggtaccggtaacccggtacggtaacggtaaccgggtaaagtaacggttaacgtaacggttaacggttccggacgggtaccgtccggtaaacgtaccccggtatttacccgtagtttaccgttacccg

SEQ ID NO: 193877 - DNA, 789 bp, Homo sapiens
  misc_feature: GYAE6OF01CP3PW.36.46.E02.1.454.CMB.1.raw
  modified_base (248)..(248): a, c, t, g, unknown or other
  misc_feature (248)..(248): n is a, c, g, or t
tcagtacgctgtctcacgaccggtgctcgatttagactcatctacagggaaagggggaagaagagctgctcagttaggacccagagggaaccatggaaaccccagcgcagctttcctcttcctcctgctactctggctcccagaccaccaccggagaggttgtgttgacgctagttaccagaccaccctgtctttgtctcaggagacagacgccacctctcctgacgacgggccagtcgaagagtaancgaagaaacgtcggaaacctacgtaacggtccgtacgggtacccggactaacggaaaaccgtacgggacccgtaaggcctacccaacgttcctaccctctagttacctaagtcggtatccggacctaaccgtccggtaacggtaccgggaccgtccgttaggaccctacgtaacccgaaggtaccgtaacggttttacgacgggttggacgttaaggggttcgggtacggtggaaccgtataccgttcgaccgacctacgtaaccacgtacacggacgacgtaacgtcccggtaacgtaggtaaacgtttagtttcgaaccgttacgttacttaagttacgtttacgaccgtaaggtctaagggtttaaacgtaggtttaaacccgtaacgttaccggtaacccgggtaacgggtttacccgggtaaacgggaaccgtaaaaccgggtacggtaaaagggtaaacgttaaacggtaaacggtaacggttcgaccggttacgaccgtacccgtaacttaacttcgttaaggttcccttaacg

SEQ ID NO: 193878 - DNA, 860 bp, Homo sapiens
  misc_feature: GYAE6OF01B7PUZ.36.46.E02.1.454.CMB.1.raw
tcagtacgctgtctcacgaccggtgctcgatttagactcatctacaggggaaagggggaagaagagctgctcagttaggacccagagggaaccatggaaaccccagccgcagcttctcttcctcctgctactctggactcccagaccaccaccggagtaggttgtgttgacgctagtttccagacaccctgtctttgtcctccaggacacgacgacgccaccctctcctgcgtagggccagtccagagtactcgagaagcgaactacgtacgccgtggtaccgcaacgaaacccgtggaccaggccgtaccccgtagttcctcctcgattctaacgtgatacgctatacccgtaagggtacggcccgtacgtcgggaccctactacccgacgtaacgtacgggtttaccgagggtcggacccgtagggtggggtacctagggactacgtaccgttaccggacgtcctacccaacgtaacgtagtaaccgtaccgaacgtacggttacccggaaacccttaggtaaacgtttaacggttttacggtaccgttaaacggtttacctttaacgttaccggtttaaccggtacggtaaaccgtaaccgttaaaggttaaacgggttaaccgggtttaaacttaaccccggggtaacccgtttaccgggggttaaccccgggtttaccggggtaaaccccgggtaaaaccgggggtaaccgggttaaaacggggtaaaccggggttaaaaaccggttaaaccgggtaaaagggttaacccgggttagggaccggggttacgtaacccggtaacccggttaaacgttaaaccggttacccgttttaggttacccgtttaaccccgg

SEQ ID NO: 193879 - DNA, 660 bp, Homo sapiens
  misc_feature: GYAE6OF01BJJQG.36.46.E02.1.454.CMB.1.raw
  modified_base (273)..(273): a, c, t, g, unknown or other
  misc_feature (273)..(273): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtcgttgacgcagtttccagacaccctgtctttgtctcaggagacagagcccaccctctcctgcgacgggccagtcagagtatacgagagcgactacgagtccgtggtaccgganaacgaacctcggacacggcctaccgagtcctcctactacgtctaagtgactacgcacgtaccgaggtaccgggcacgtgccacgtcccaagtccgtaggtcaggtcggacagggtcggtctagggacacgtcgttacacgtctacaccgtactacgacacgacgtaccgtacggtacctaagtaacgtacgtttagacttaggtactttaacttcgttacggtacgagtacgtaagtaggttaacggtaaccgtaaccgtaacgttcgggtaaccgtacggaaccgggaacccgggtaagtaaacgggtaaaggtaaagtaaccggtaaaggtacgtacgggtacgtacgtacggtaccgtaacttacgtcgtacgtttactacccg

SEQ ID NO: 193880 - DNA, 700 bp, Homo sapiens
  misc_feature: GYAE6OF01EVW3E.36.46.E02.1.454.CMB.1.raw
  modified_base (597)..(597): a, c, t, g, unknown or other
  misc_feature (597)..(597): n is a, c, g, or t
  modified_base (611)..(611): a, c, t, g, unknown or other
  misc_feature (611)..(611): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgacaaatagaacagtctacgaaacctgacgacacggtcgtgtaattactgtgaacgaaaaacgggcgacccgcccgtagggtcggggtacttacgtctaatacgactacgtcgggaccgtacgggaacccggtccgaccgtctaccgtacgacgcctaccaaccgtaacgggccccaagttccggttacctcccccgtgggtcctaccccgttgaccctaccggacggacgcctaacccgtcggaacgaccgcgtaaccgacgggcccggtacccgttacgggcgtacggtcccgttaacgggtaccgtaaaacgggtacctttaacccttaccggaaacgtaaccgtaaggtacccggttaaccgtagggacgggacccgggttcgtaggggaccgtaaagggcccgtaactaagttaagggctaggaacngacagtacagtganacgacgtacgacgtagtacacgacgacgtacgagacacgagagtagtacgacgacgacgacacgtacgacgtaccgacgacgtacgtac

SEQ ID NO: 193881 - DNA, 801 bp, Homo sapiens
  misc_feature: GYAE6OF01D0TXJ.36.46.E02.1.454.CMB.1.raw
  modified_base (200)..(200): a, c, t, g, unknown or other
  misc_feature (200)..(200): n is a, c, g, or t
  modified_base (493)..(493): a, c, t, g, unknown or other
  misc_feature (493)..(493): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagacacctgtctttgtctcagganacagacgcccacctctcctgcgaggccagtcagagtactcgagacgcgaactacgtacgccgtacggtaccgacgacgtaaaccgtcggaccgaaggcctaccgacgttccctccttacacttactagtggtaactcgtaccaccgttaccgaacgggttcgggcccgtacggtcggtacctaaccgttacccgaagtaaccggtcggttaaccggaggttacgggacgttacggggtcgggttacggtacgggactaacggtaccttaccgaaccgttcctaaccgtaaccngttaaccaacgggtaaccgaacggttaacccggtaacgtaacccgttaagggttaaagtttccgttttacgaaccgtttaacggttacctttaaggtttaaccctaggtacgtaacgttacgttaaaggttacgttaaaccgggttaaacctaacccggtttacccgggttacgggttacccgtttacccgggggaaaacgtaaacccgggtaacgttaaacgggggttaaaagtaaacggtaaaaccgggtaaagttacggtcgtacgggcttacggacccttacgtaatcggttacctgttacccg

SEQ ID NO: 193882 - DNA, 697 bp, Homo sapiens
  misc_feature: GYAE6OF01AHWU1.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagacgcccaccctctcctgcagggccagtcagagtatcagaagcgactacgtacgccgtcggtaccggcaacgaaaccgtcggaccacggtcctcccgtagtcctcctcactctagtcatcgcatacccgaggtaccgggccgcgtcggcacgtcccgaagaccgtacggttcgagggtcggcgtacgggttcgggtcgtcgggaacgtacgtaccgttccgacgtcctacgaacctagtccgacgtacgtaacgacgtacccggacctagtaaagtttcttttcggaccttacggttaccctttagttaccgttaggtcctaacgtacgttaacggttaagttacggttaaaccttaccgaacccggttcgggttaaccggttccgggaaccggtaaaccgggtaaccgtaaagggaacgtaaaacgacgggtaaaggttaacgtggggacgtcggtacgtacccgaactattccttacggttccttaacccg

SEQ ID NO: 193883 - DNA, 807 bp, Homo sapiens
  misc_feature: GYAE6OF01A01C3.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagacctaccctgttctttgtctccaggagacagacgcccaccctctcctgcgacgggccagtcagatatcgagaacgcgaacgtacgtagccgtacgggtaccggacaacggaaacccgtggaccctacgggtcccttaccccgtacgttcccttccccgtactacgttaccttaggtactacgttaccggctaacccgttccggtaaggggtccggggccccgtgttacgggaccctaaccgtaccccgaacgggtaaccgtttacggggttacctaacggggtcgggtaccgttagggggttcggggttaccccggtagggggaaccctaccgggtttaccttaccggacccggtccttacccgaacctaccgttccgaacgaccgtaccggtaacccgttaccggaacccgttaggtaaaccggtttagttttaccggtacgttaacgtttacctttaacgttccgtaagttcgaacgtacgttaagtacgttaacggtaactacccgtacgttaccgggttacggtaccgaaccggaacgggacgttaaacgggaagtaaaccgaacggtaacgggaacgttcggacggtctacggaccctaacgttacgtcgttacgtcttacccg

SEQ ID NO: 193884 - DNA, 874 bp, Homo sapiens
  misc_feature: GYAE6OF01EYDHT.36.46.E02.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
tcagtacgctgtctcacgaccggtgctcgatttagactcatctacagggaaagggggaagaagagctgctcagttaggacccagagggaaccatggaaaccccagcgcagcttctcttcctctgctactctgcctccagacaccacggagaggttgtgttgacgcagttccacgagaccctacgttnttcttcgtcacggaggacacacgccnccctaccttccgtcgtcgccggaccgacctacgtacgaagtactacgtacgaagaccgacgtaacgtacggtacgtaccggtacggaccgtaacggtaaacgtaccggcggtaaccggtaccgtccctaaccggttccgtacccttaccggtactacgttaccgttacggacgttacgtaccgtactacccggtaacgggtaacgggtccccgggacgttcggttacggacccctaaccgtacccggaatcggttacggtgacggtcgaggtacgggttcggtacgtaggaccgtagttacctcgaacctcgtaaccgtacaccgtacgaccgtaacgtaacccggtccggtaaccggttaacggtaaggtttaaccgtttacggttaccgtaacggtttaccgtttaaccgtttacgttaacccgggtcttaaaccgggacggtttaccggtttaaagtaccggtttaaaccgtttaacccgtaacccggtttaccgggtaacccgggtttaaccgggtacccggtaaaacgggaacccgggttaaaacgggtaaaccgttaaaccggggaaaacgtaaagggttacccgggtttaaagccgggttaaccgtaccgttaaacggtaccccgttaaagttcctttcgtacgtttaaccccg

SEQ ID NO: 193885 - DNA, 699 bp, Homo sapiens
  misc_feature: GYAE6OF01COTVI.36.46.E02.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (480)..(480): a, c, t, g, unknown or other
  misc_feature (480)..(480): n is a, c, g, or t
tcagtacgctgtctcacgaccggtgctcgatttagactcatctacagggaaagggggaagaagagctgctcagttaggacccagagggaaccatcggaaaccccagcgcagcttctcttcctcctgctactctggctacccagaccaccgaccggagtacggttgtagttgacgctagtttccagacctaccctgttctttcgtccaccgagganacagacgcccacctctccagcgacggccagtcagtagtacncgaagacgacgtacgtacgtcgcgtacggaccgagaaccgtaaccgcggaccgacggtcctaccgtagtccctaccacgtattacgtgtacggtcacctaacctccgaaccggtacggaccctaacgtcgaaccctccgtacccgaacgttcccgtacggttacgacggggtcgaggtacggttcgggtacgaacggtactacggtaccttcgacctcgaaccncgtactacgacgtcacgtccgagtacacggtgtaacgagtttcgttactagttcgtttactcgcgactacgtacttaagttacctaagttccggtacggtacccgtaggtacggtacggttaccgtaccggaacggtaacggtaacggttaacgggtaacgtaacgtaaaccgaacgttcgacgggtccgtacaacgtcctaaacgttcgtcgttaccc

SEQ ID NO: 193886 - DNA, 508 bp, Homo sapiens
  misc_feature: GYAE6OF02F82EP.36.46.E02.1.454.CMB.1.raw
tcagtacgctgtctcacgaccggtgctcgatttagactcatctacagggaaaggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtaggccgctggcatcccagacaggttcagtggcagtgggtctgggacagacttcacgctcaccatcagcagactggaccctgaagattttgctagtctattactgtcagcagtatggtaatacacctcggacgttcggccaagggaccaggtaggaagtacgaaaggaactagtaggactgcaccatctgtcttac

SEQ ID NO: 193887 - DNA, 497 bp, Homo sapiens
  misc_feature: GYAE6OF02IO5T6.36.46.E02.1.454.CMB.1.raw
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
tcagtacgctgtctcacgaccggtgctcgatttagactcatctacagggaaaggggaaggaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagccctggtaccggcagaacctggccaggctcccagtctcctcatctatgatgcatccagtagggccactggcatcccagacaggttcagtgcagtggtctggacagacttcactctcaccatcagcagactggagcctgaagattttgccgtgtattactgtcaactactatggtacctctctgtaccattttcggccaggggaccagctgganatcaaacgactggtggctgcaccatntcg

SEQ ID NO: 193888 - DNA, 511 bp, Homo sapiens
  misc_feature: GYAE6OF02IQDSE.36.46.E02.1.454.CMB.1.raw
  modified_base (320)..(320): a, c, t, g, unknown or other
  misc_feature (320)..(320): n is a, c, g, or t
tcagtacgctgtctcacgaccggtgctcgatttagactcatctacagggaaaggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccnctggcatcccagacaggttcagtggcagtgggtctgggacagacttcacgctcaccatcagcagactggaccctgaagtattttgctagtctattactgtcagcagtatggtaatacacctcggacgttcggaccaagggaccaaggtaggtaaagtcgaaaggaacgtgtggctgcaccatctgtcttcg

SEQ ID NO: 193889 - DNA, 504 bp, Homo sapiens
  misc_feature: GYAE6OF02HOFOA.36.46.E02.1.454.CMB.1.raw
  modified_base (205)..(205): a, c, t, g, unknown or other
  misc_feature (205)..(205): n is a, c, g, or t
  modified_base (430)..(430): a, c, t, g, unknown or other
  misc_feature (430)..(430): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggggaaanagccaccctctcctgcagggccagtcagagtgttagcagctacttagcctggtaccaacagaaacctggccaggctcccaggctcctcatctatgatacatcctacagggccactggcatcccagccaggttcagtggcagtggtctgggacagacttcactctcaccatcagcagcctagaacctgaagtattttgactagtttattactgttcagcagcgagngtcttcggcctggaccaagtgatatacaaacgtactgtgctgcaccatctgtcttcatccttcccgctatctag

SEQ ID NO: 193890 - DNA, 683 bp, Homo sapiens
  misc_feature: GYAE6OF02JVD84.36.46.E02.1.454.CMB.1.raw
  modified_base (234)..(234): a, c, t, g, unknown or other
  misc_feature (234)..(234): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggtttgtgttgacgcagtttccagacaccctgtctttgtctccaggagacagagccaccctctcctgcagggccagtcanggatatcgaagacgcgtacgtacgtacgccgtacggtaccgagaacgtaaccgtcggaccgaggtccctaccgtagtcctacctactacttactagtcgatcgactacgtaccgtaagggtacgggccgtacgtcggacctaccgtaccgaagacgtaggttacagggtcggacgtagggtcgggtacgtacgggaactacgtactcgacgtctaccgactatacgacgacgaacgtacgtaccggtacctaggtaacgttagtttacgacttacgttacttacgttacgtacgtacgagtacgtaagttacgttaacggttaaactaccgtaccgtccggtaacggttccggaacgaacgggtaccgtaagggtaacggtaaacgtacggaaacggtacgttacggtacggtacgtacgaccgtaacgtacgttacgttacgttaccg

SEQ ID NO: 193891 - DNA, 446 bp, Homo sapiens
  misc_feature: GYAE6OF02IGN7B.36.46.E02.1.454.CMB.1.raw
  modified_base (439)..(446): a, c, t, g, unknown or other
  misc_feature (439)..(446): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgacaaaaacgggagaccccgcccaggtcgggggcttatcattacgactacgtggggccaggggaaccccggtcaccgtctcctcacgcctccaccaagggccccatccggtccttccccctggccgcccctgcctccaggacgcacctccgagacgcacagccggccctgggctgcctggtcaaggctactccagacagcgtactgagcggctggcaaggcgcatagnnnnnnnn

SEQ ID NO: 193892 - DNA, 528 bp, Homo sapiens
  misc_feature: GYAE6OF02F93GO.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacaggttcagtggcaggtgggtctgggacagacttcacgctcaccatcagcagactggaccctgaagtattttgctagtcttattactgtcagtcagtatgtaatacaccgtcggacgttcggaccaagggaccaaggtacggaaatacgaaacggtaacgtaggtaggctaggacaccgatacctagtcttacg

SEQ ID NO: 193893 - DNA, 506 bp, Homo sapiens
  misc_feature: GYAE6OF02HDFNY.36.46.E02.1.454.CMB.1.raw
  modified_base (418)..(418): a, c, t, g, unknown or other
  misc_feature (418)..(418): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggtcgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtaggccgctggcatcccagacaggttcagtggcaggtggtctgggacagacttcacgctcaccatcagcagactggaccctgaagtatttgctagtctattactntcagcagtatggtaatactacctcggtacgttcggaccgagggaccaggtagaagtcaaaggaactggtagctgcacatctagtcttc

SEQ ID NO: 193894 - DNA, 528 bp, Homo sapiens
  misc_feature: GYAE6OF02H8KJY.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacaggttcagtggcagtggtctgggacagacttcacgctcaccatcagcagactcggaccctgaagtattttgctagttactattactgtcagcagttatagtaatacaccgtcggtacgttcggccaagggaccaggtaggaaagtcgaaacggaactggtacggtacgtacgacaccgatccgttgtcttacg

SEQ ID NO: 193895 - DNA, 573 bp, Homo sapiens
  misc_feature: GYAE6OF02I3DDJ.36.46.E02.1.454.CMB.1.raw
tcagtacgctgtctcacgaccggtgctcgatttagactcatctacagggaaagggggaagaagagctgctcagttaggacccagagggaaccatcggaaaccccagcgcagcttctcttcctcctgctactctggctcccagacaccaccggagaggttgtgttgacgctagtttccagaccaccctgtctttgtcctccaggagacagacgccaccctctcctgcgagggccagtcagagtatcagacgcgactacgtacgcctggtaccggcacgaaacctggccaggcctcccagtctcctcatctatgatcgcatccgaggtacgggccgcgtggctactccccgagacgtacggttccaggtcggactagggtgggttcgtacggggactacggtaccttacgaccggtcctacacctactcacgcacgactcggacctaggaagtacttttacgctagtcttacttactgtcagctagtagtagtaatactacgtcggtaccgtcggacgaacggacaggtagaacgtacgaaacggacgtgtcgacgtcgcaccatctcgtctacg

SEQ ID NO: 193896 - DNA, 437 bp, Homo sapiens
  misc_feature: GYAE6OF02GI72E.36.46.E02.1.454.CMB.1.raw
  modified_base (324)..(324): a, c, t, g, unknown or other
  misc_feature (324)..(324): n is a, c, g, or t
  modified_base (430)..(437): a, c, t, g, unknown or other
  misc_feature (430)..(437): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgcaaaaacgggagacccgcccaggtcgggggcttatcattacgactactggggccagggaacccgggtcaccgtctcctcagcctccaccaagggcccatcggtcttcccccnggcgccctgcctccaggagcacctccgagagcacagcggccctgggctgcctggtcaaggactacttccagacagcgtactgagcgggctggcgaaggcgcatagnnnnnnnn

SEQ ID NO: 193897 - DNA, 519 bp, Homo sapiens
  misc_feature: GYAE6OF02HVGZ8.36.46.E02.1.454.CMB.1.raw
  modified_base (496)..(496): a, c, t, g, unknown or other
  misc_feature (496)..(496): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacaggttcagtgcagtgggtctgggacagacttcacgctcacatcagcagactggaccctgaagtatttgctagtctattactgtcagctagtatagtaatacaccgtcggacgttcggaccgaagggaccaaggtaggaaagtcgaaaggacgtaggtcggngtacgcaccactcttcgtcttac

SEQ ID NO: 193898 - DNA, 591 bp, Homo sapiens
  misc_feature: GYAE6OF02GW9EY.36.46.E02.1.454.CMB.1.raw
  modified_base (382)..(382): a, c, t, g, unknown or other
  misc_feature (382)..(382): n is a, c, g, or t
  modified_base (444)..(444): a, c, t, g, unknown or other
  misc_feature (444)..(444): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgagcctggtaccggcagaaacctggccaggcctcccaggctcctcatctatgatacatccaacaggccactggccgtccagacaggttcaggtgcagtgggtctgggacagtacttcaccttctcaacctntacgacgacagccgtggacgcctagaagtacttctcgacttaagtttattaccgtgtacgancgtaacgtcgttaactaggttcgtaccctccgtacctcgtacgtttccgggacgggtaccgggtacgtaaggtcggtaacgtagtaaccgtaaaacggacgtttacgggacgtaccggttacgaccgtacccgtacgttccgttacg

SEQ ID NO: 193899 - DNA, 550 bp, Homo sapiens
  misc_feature: GYAE6OF02I0ZWC.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaacctggccaggcctcccagtcctcctcactctatgatgcatccaggtacgggccgctggcatcccagaccgtaggttcaggtggcaggtgggtcgtgggacagaccttcgacgctcacctactcacgcagacgtcggacctagaacgtatttcgactagttctatttactgtcagcagtataggtaatacgtaccgtcggtacgttacggaccgaagggacagggtagaacgtacgaaacggtaacgtggtgtacgtacgacaccgtagtctgttctacc

SEQ ID NO: 193900 - DNA, 510 bp, Homo sapiens
  misc_feature: GYAE6OF02FIW4Q.36.46.E02.1.454.CMB.1.raw
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
  modified_base (500)..(500): a, c, t, g, unknown or other
  misc_feature (500)..(500): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtacgggccgctggcactcccagacaggttcagtggcagtgggtctgggacagacttcactctcaccatcagcagcctggacnccgtgaagattcgtgctagtttacttactgtccagcaggcgttacngttggcctcgctcacttcggcgaggtcgaaggtgacgatacgaaacgtacgtgtacggntcgcaccgta

SEQ ID NO: 193901 - DNA, 494 bp, Homo sapiens
  misc_feature: GYAE6OF02F6275.36.46.E02.1.454.CMB.1.raw
  modified_base (431)..(431): a, c, t, g, unknown or other
  misc_feature (431)..(431): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatcctacagggccactggcatcccagccaggttcagtggcagtgggtctgggacagacttcactctcaccatcagcagcctagaacctgaagtatttgctagtttattactgtcagcagcgagngtcttcggcctggaccaaaggtgatatacaacgactgtgctgcacatctgtctcatcctcccg

SEQ ID NO: 193902 - DNA, 755 bp, Homo sapiens
  misc_feature: GYAE6OF02HI2GK.36.46.E02.1.454.CMB.1.raw
  modified_base (695)..(695): a, c, t, g, unknown or other
  misc_feature (695)..(695): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccattcaccatctccagagacaacgccaaagaactccctgtatctgcaaaatgaacagtctgaaacctgaggacgacgccgtcgtattactagtgacaaaaacggaacggacccgacccgacggtcgggggcgttatacattaacgacgtactcgggccggaacggaacccggggtaccgaccgtaccgttcccttaccacggacccttcccaacccgaaacggggaccccgacttacgggttccgttcccccccttccgggtccggccccctcggcgtccccacgggacggaccgaccccgttacccgacggaacggacaacccgaaggcccgggccccgtacggggtcgtaccggtcccgtacgggttacgaaacgggtaaaccttacccgttttaaccccgacggaaaccggaacggtccgggttaaaccttacgggggaacggccccgggggggttacccttacggggtacccggaaaaacggggacccgggtcgtaaaccgttaaaaggggtccacgttaagagacgacgacgacgactacgacgtacgacgacgagacgacgacgacanacgtacacgagacgtacgacgacgtacgtacgagacgacgtagtacgacgtagtagtacg

SEQ ID NO: 193903 - DNA, 532 bp, Homo sapiens
  misc_feature: GYAE6OF02GZYP1.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccaggtacgggccgctggcactcccagacaggttcaggtggcaggtgggtctgggacagcttcacgctcacatcagcagactcggaccctagaagtagttttgctagttacttattacgtgtcagtcagttataggtaactacaccgttcggaccgttcggaccgacgggacgaaggtagaacgtacgaaggaactggcgacgtgcaccgtatctgtcttacg

SEQ ID NO: 193904 - DNA, 503 bp, Homo sapiens
  misc_feature: GYAE6OF02FMI41.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagatactactggagaaatagtgatgacgcagtctccagccaccctgtctgtgtctccaggggaaagagccaccctctcttgtagggccagtcacagtattagcactaatttaggctggttccagcagaaacctggccaggctcccaggctcctcatctacagtgcatccaccgagggccactggtcgtcccagccaggttcagtggcaggtggtctgggacagtagttcacgctcaccatcagcagcctgcggtctagaagtatttgctaattgtattactgtctgctattataatatcgtctcgtgcgtcggcgaaggacgaggtagaagtacaacgacgtgtgcgtgacaccatctgtctac

SEQ ID NO: 193905 - DNA, 523 bp, Homo sapiens
  misc_feature: GYAE6OF02ISQFK.36.46.E02.1.454.CMB.1.raw
  modified_base (322)..(322): a, c, t, g, unknown or other
  misc_feature (322)..(322): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtacgggccnctggcatcccagacaggttcagtggcaggtgggtctgggacagtacttcacgcctacaccatcagcagactggacctgaagtatttgctagtctattactgtcagtcagtataggtaatacgacctcggtacgtcggaccgaagggaccgaggtaggaaagtacgaaaggtactaggtgacgtacgcaccatctcgtctac

SEQ ID NO: 193906 - DNA, 657 bp, Homo sapiens
  misc_feature: GYAE6OF02G16HN.36.46.E02.1.454.CMB.1.raw
  modified_base (325)..(325): a, c, t, g, unknown or other
  misc_feature (325)..(325): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccgcaagaaacctggaccaggctcccagtcctcctcatctatgatgcatccaggtacgggccnctggcctactcccagacaggttcaggtggctaggtcggtcgtagggacagtaccttcgacgtctacgaccatcgagtacacgacctacggtaaccctaggtaacgtacgttttgacgttaacgttaccgttaagtttacttcgttacgtaacgtacgtaaggttaagttacggttaaacttaccgtaacccgttaccgggtaaccggtttaccggaacccggtaacgggaaccggtaacgggtaacgggtaaacgtaaccggaaaacggtaaacggttacggttacgggacgtacggaccgtaacctacgttacgttacgttacgttaaccg

SEQ ID NO: 193907 - DNA, 645 bp, Homo sapiens
  misc_feature: GYAE6OF02I4MM9.36.46.E02.1.454.CMB.1.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgaactacgtancctggtaccggcaagaaacctggccaggctcccagtctcctcatctangatgcatcagtaggccntggcatccagacaggttccagtggctaggtggtcgtgggaacagtaccttcacggtctacaccgtactacgagaccgaacgacgtacggtaacccgtacgggtaaacgttacgttttacggaccttacggtttaccttaaacttccgttacgttacaacggtactaaggttaagttacggttaaactacccgtaacgttacccgggtaacgtttaccggacccggtaaacgggtaaccgaacggttaacggaaacgtaaccgaaaacggtacggtaacggtacggtacgacggtaccgaaccgtataccgttacgtcttaaccg

SEQ ID NO: 193908 - DNA, 691 bp, Homo sapiens
  misc_feature: GYAE6OF02HFWN1.36.46.E02.1.454.CMB.1.raw
  modified_base (201)..(201): a, c, t, g, unknown or other
  misc_feature (201)..(201): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccagganacagagccaccctctcctgcagggccagtcagagtatcagagcgactacgtagcctggtaccggcagaaacctggccaggctcccagtctcctcatctatgatgcatccagtacggccgctggcagtcccagacagttcagtggctaggtgggtcgtggggacagtaccttcgaccgtctccgaacctagtccgaagtccaacggtaccgtacggaacccctaggaaacgttacgttttcggacctaaggtttaccttaacgttttaccgttacgtacgtacgtaccgtaaggttaattacgggtaaacttaccggtaacccgttacgggtaaccggtttacccgggaacccgtaaaccggggtaacccgtaaacggggttaacggtaaaaccggttaaccggtaaaaaggggtaaccggttagggtaccgggttaccggttacggtaccctaaccgttaacgtttaccgttacggttacctttaacccg

SEQ ID NO: 193909 - DNA, 569 bp, Homo sapiens
  misc_feature: GYAE6OF02F6DGN.36.46.E02.1.454.CMB.1.raw
  modified_base (323)..(323): a, c, t, g, unknown or other
  misc_feature (323)..(323): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggcctcccagtctcctcatctatgatgcatccaggtagggccngtggcacgtcccggactaggttcagtggctaggtgggtcgtgggacagtacttcacgctcaccatcagcagacgtacgggaccctagaacgttatttcgactagttcttaattactgtacagactagttataggttaactaccgtaccgtcggtaccgttaccgacggaacgggaccgaaggtacggaaagtaccgaaaggtacgtaggtcggactggactaccacgttacgtcgttcgtctaccg

SEQ ID NO: 193910 - DNA, 781 bp, Homo sapiens
  misc_feature: GYAE6OF02I8NEN.36.46.E02.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctcgtcctgcagggccagtccagagtancagaacncgactacgtacgccgtggtaccggcagaaaccgtggccaggcctcccagtcctcctcagtctatgatcgcatcccaggtacgggccgtcgtcggacctactcccgagactaggttacaggtcggcagggtgggtctcgggacagtaccttcgacgtcgtaccaccgtactaccaggaccgacgtacgtccgggtaacccgtacggtaaacgtacgtttttacggaccgttacggttacctttaacgtttaccgttacggttaccgtaacggtaaccgttaacggttaacgtttaacggggtttaaaccgttaacccggtaacccggtttaacccggggttaacccggtttacccggggtaaccccggtaaaacggggttaacccggtaaacgggttaaccgggtaaaacggttaaacccgggttaaaaccggtaaaaccgggtttaacggttaacccggggttaacggtaacccggttaacccgtaacccggttaaaccgtttacccggtttacggtttacccttttaacccgg

SEQ ID NO: 193911 - DNA, 646 bp, Homo sapiens
  misc_feature: GYAE6OF02IZV61.36.46.E02.1.454.CMB.1.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagatatcactggagaaatagtgatgacgcagtctccagcccaccctatctgtgtcctaccagganaaagagccacctctcctgtacgggccagtcagagtgttagcacgctaacttagcctggtaccagcaagaacctggcccaggttcccagctacatcgatcgtatggtgctactccaccacgggccaccgtggtactccccaagtccctacgtttacgnggctagggtcggtcgtaggacgaagtacgttccacgttacctccaccgtactcgaagccacgtcctacgngaaccgttcgtagtaacgttagtttcgagttacgttttacttactcgtacaaaccgtacgtaaacgtattccgggtaactccggtaccttaccctacgttaaggtttcccggggacgggtaaccgggaccggtaagggttcgggaaagttaccgtaaccggtaaacggtaacgtttcgggtagggtccttacggacccggttaaccactttccgg

SEQ ID NO: 193912 - DNA, 726 bp, Homo sapiens
  misc_feature: GYAE6OF02JVURL.36.46.E02.1.454.CMB.1.raw
  modified_base (214)..(214): a, c, t, g, unknown or other
  misc_feature (214)..(214): n is a, c, g, or t
tcagtacgctgtctcacgaccggtgctcgatttagactcatctacagggaaaggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctntcctgcagggccagtcagagtatcagaagcgactacgtagcctggtaccggcagaaacctggccaggcctcccagtctcctcatctatcgatcgctatccaggtacgggcccgcgttgggcctacttccccgaagtaccgacggtttccaaggttcgggcctaaggggttcggggtacgttaggggggaacctaagggtacccttttaccggaaccggcccgtttaccaacccgaacgttaccgaacggtaccgaacggtaaccgtaccgggtaaacccgttacggtaaacggttaacgtttttacggaccgttaacggtttacccgttaaagtttaccgttacgttacgtacgtaccgttaagttaacgttacgggtaaacttaaccgtaccgttacggtaccggttaccggaccggtaacgggtaccgtaagggtacggtaaacgtacggtaaacgtaacgtacggtacggtacgtacgtaccgacctaacgtcgttacgtccgttaccg

SEQ ID NO: 193913 - DNA, 571 bp, Homo sapiens
  misc_feature: GYAE6OF02GQT61.36.46.E02.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
tcagtacgctgtctcacgaccggtgctcgatttagactcatctacaggaaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccgcagaacctggccaggctcccagtctcctcatctatgatgcatccagtagggccngtcggactatcccagacgaggttcagtgctaggtcggtctgggacngtacttcacgctcacatcagcagactcggacctgaagtatttgctagtctattactntcgagtctaagtagtggtaataccgtaccttacggtaccgttaccggtaccgaacgggtaaccgagggttaacggtaaacgtaacgaaaaccggtaacgtggtacggtaccgtagtcctaaccgtacgttacgttacgttacgttaccg

SEQ ID NO: 193914 - DNA, 642 bp, Homo sapiens
  misc_feature: GYAE6OF02HNI18.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcaacgaaacctggaccaggctcccagtcctcctcatctatgatgactactcgaggtacgggccgtcgtggccactcccgaagacgtacggttcaggtcggacgtaggtgggtacgtggggacaaggtaccttcgacgtcctaccgacctatcgacgcgaacgacctcggaaccctagaacgttagtttcgactacgttacttactttaactgtaccagtacctaggttagtaggtaactaccgtaccgttcgggtaaccggttccgaaaccggaacgggtaccgtaaagggtacggtaaacgtaacggtaaacggtaacgtaagggtacggtaccggtcgtaccgaacccgtacgttaccgttacgttccttaccg

SEQ ID NO: 193915 - DNA, 648 bp, Homo sapiens
  misc_feature: GYAE6OF02HT3PY.36.46.E02.1.454.CMB.1.raw
  modified_base (266)..(266): a, c, t, g, unknown or other
  misc_feature (266)..(266): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccacctctcctgcagggccagtcagagtatcagaagcgactacgtagcctggtaccggnacgaaacctggccaggctcccagtctcctcatctatgatgcatccgaggtacgggccgcgtggcctactcccgaagtacaggtttccgaaggtcggacgaggtgggtcgtaggggactaggtacttcgacgtctacacctactcacgcgagacgtacggacctagaacgtagttttgacgtacgttacttaacgttacgttgtacgaagtacgtaagttaacgttaggttaactaaccgtaacccgttacggtaccggttacggaacccgtaacgggtaaccgtaacgggtaagggtaaacgtaacggtaaaacggtaacgttaacggttacggtaccgtacgaccgtaaccgtaacgttaccgttacgttacctttaaccg

SEQ ID NO: 193916 - DNA, 653 bp, Homo sapiens
  misc_feature: GYAE6OF02IAR4K.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctccagacaccaccggagtaggttgtgttgacgctagtttccagacaccctgtctttgacctccgaggagacagacgcctaccctctcctgacagggccagtcagacgtatcaggaacgcgaactacggtagcctggtaccggcaacgaaactcggccacggcctaccgacgtctcctcatcgtaatgatcgacactccaggtacggccgcgtcggccactacccgaagtacgtacggttcaacggttcggcgtaggttcgggtcgtaggggacaacgtacttcgaccttcgtccacgattcgagccgaagtctcggaactccgtagaagttgttttccggctttacgttagttactacgtactaacctaagttacttaggttaccctcgttacgttacgttaactttccgggttttaagacccgaacgggggtaaccaggttaccgttaggaacgtaacttaccggaaaacggttactgggttcggaacgttcgaaccgttaccgtacttccgttcgg

SEQ ID NO: 193917 - DNA, 543 bp, Homo sapiens
  misc_feature: GYAE6OF02INW14.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtaggccgctggcatcccagacaggttcagtggcagtgggtctgggacagacttcacgtctcaccatcagcagactggaccctgaagtatttcgctagtcttattactgtcagctagtagtagtaatacaccgtcgtacgttacggaccgaacgggaccgtaaggtaggaaacgtaacgaaacggtaacgtaggtacggtactgaccaccgtactacgttacgtacttacg

SEQ ID NO: 193918 - DNA, 777 bp, Homo sapiens
  misc_feature: GYAE6OF02HLMWN.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcaagaaacctggccaggcctcccagtcctcctcatctaatgatgcactccaggtacgggccgcgtacggcacgtcccgaacggtacgggttcaaggtcgggacgtacgggttggggtcgtacggggaacctaacggtacctttacgaccggtacctacccgaaccgtacttacgaccgacgtaaccggtaacggtacccgggtaaccccgttaggtaaaccggttaagtttttccgggaaccgtaaccgtttaacgttttaaccgtttaccgttacggttaccgtaacgtaccgttaaaggttaacgttaacgggttaaaccgtttacccgtaacccggtttcggggtaaaccccggttttacccggggaaccggtaaaacccgggggtaacctaaacgggggttacggaaaacgttaaccgggtaaaaccgggttaacggttacgggtacgttaacggaccgtaccgtaacccggtattaccggtttcgttacccttacgttaacccccg

SEQ ID NO: 193919 - DNA, 684 bp, Homo sapiens
  misc_feature: GYAE6OF02G0RWH.36.46.E02.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (326)..(326): a, c, t, g, unknown or other
  misc_feature (326)..(326): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagacaccctgtcttgtctccagganacagagccaccctctcctgcagggccagtcagagtatcagaagcgactacgtagcctggtaccggnagaaacctggaccaggcctccagtctcctcatcatgactgacatccgaggtacgggccncgtggcactcccgagacgaggttcaggtggcaggttgggtctaggggactagtaccgttcacggtctacgtaccataccgagaccgtaacgaccgtacggaaacccgtaggtaaacgttacgttttacgacgttaacggttaccttaacgttaccgttagtaccgtaaagtcctaaaggttaacgttacggtaaaaccgttaacccgtacccggttaccgggtaaccgttccggtaaaccggtaaaccggggtaacccgtaaggggttaacgtaaaacggtccggtaaaaaggtaccggttaacggttacggacgttacggaccctaaccgtacgtaccgttacgtaccgtttacccg

SEQ ID NO: 193920 - DNA, 690 bp, Homo sapiens
  misc_feature: GYAE6OF02IVADO.36.46.E02.1.454.CMB.1.raw
  modified_base (152)..(152): a, c, t, g, unknown or other
  misc_feature (152)..(152): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggngaggttgtgttgacgcagtttccagacaccctgtctttgtctccaggagacagagccaccctctcctgcagggccagtcagagtatcagaacgcgactacgtagcctggtaccggcagaaaccgtggaccaggcctccccgagtcctcctcatctatgatgcatccgaggtacgggccgctggcatcccagacgtaggttcaggtcggacgtaggtcgggtacgtggggaactacggtacttaccgaccggtacctaccgaacccacgttaccgacggtaccaacggaaccgttccgggaaccccttaggtaaacgttagttttcgacgttacgttactttacgtttacgttacgtaccagtacgtaagttaacgtaggttaaacctaccgtacccgttaccgggttaccggttaccgggaaccgtaacggggtaacccgtaagggttaacggtaaacgttaaccggtaaaacggtaaccggttacgggtacggtacgttacggaccgtaccgaaccgttcgttacgttaccttaccg

SEQ ID NO: 193921 - DNA, 579 bp, Homo sapiens
  misc_feature: GYAE6OF02IURSJ.36.46.E02.1.454.CMB.1.raw
  modified_base (292)..(292): a, c, t, g, unknown or other
  misc_feature (292)..(292): n is a, c, g, or t
tcagtacgctgtctcacgaccggtgctcgatttagactcatctacagggaaagggggaagaagagctgctcagttaggacccagagggaaccatggaaaaccccagcgcagcttctcttcctcctgctactctggctcccagacaccaccggagaggttgtgttgacgcagtttccagacaccctgtctttgtctccaggagacagacgccaccctctcctgcagggccagtcagagtatcagaacgcgactacgtagcctggtaccggcagaaacctggccaggcctcccngtcctctcatctatgatgactactccgtaaggtacgggccgtcgtggccactcccgaagaccgtaggtcgaggtcggacgtagggtgggtcgtgggactacgtacttcgacgcctaccacatcagcacgacgtacggacctagaagtagtttacgcgtagtcttattactcgtacagctagtatagtaatacgacgtcgtacgttcggacgtaacgggtacgaaggtacgtaaacgtacgaaaacgacgtagtacggacgtacgacgacgtactcgttctcttaccg

SEQ ID NO: 193922 - DNA, 559 bp, Homo sapiens
  misc_feature: GYAE6OF02I3YQA.36.46.E02.1.454.CMB.1.raw
  modified_base (224)..(224): a, c, t, g, unknown or other
  misc_feature (224)..(224): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
  modified_base (531)..(559): a, c, t, g, unknown or other
  misc_feature (531)..(559): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgacaaaaacgggngaccccgcccgagggtcgggggcttatcattacgactacgtggggccagggaacccgggtcaccgtctcctcagcctcccacgaagggccccatccggtccttcccccgtggccgcccctgcctccgaggacgccacccgtccgagacgccacgacggccggcccgtggggctcggcccgtgggtaccgtaaacgggtaccttaccttacccgaacggaaccgacggtacggttaaccgtacggaacgggtccggggtcgtcggggaccggaaacggggtccgacgtaacgtaggacncgagcgngnnnnnnnnnnnnnnnnnnnnnnnnnnnnn

SEQ ID NO: 193923 - DNA, 640 bp, Homo sapiens
  misc_feature: GYAE6OF02GNW3I.36.46.E02.1.454.CMB.1.raw
  modified_base (325)..(325): a, c, t, g, unknown or other
  misc_feature (325)..(325): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaacctggccaggctcccagtcctcctcatctatgatcgcatccgaggtacgggccncgtggcacgtcccagacaggttcagtggctaggtggtcgtgggacacgtacttcacgtctacgaccatccacgcacgtacgtacggaccctaggtaacgtacgttttcgacgttagttaccttaatttacgtcgttacagtaccgttaagttaacgttacggttaaacttaccgtacccgttaccggggtaaccgttccgggaaaccgtaaccggggtaaccgtaaggggttacggaaaacggttaaccgaaaacgggtaaccgttagggtacggtacgtacgacccgtacctacggttctccgttacttacccg

SEQ ID NO: 193924 - DNA, 627 bp, Homo sapiens
  misc_feature: GYAE6OF02GEF0G.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaaccgtggccaggcctcccgagtcctcctcatctatgatacactaccaacgacgggcccacgtcggaccgtcccaagtaccgtaggttcacggtggacgtaggtgggtcgtagggacacggacttcactctaccacactcgagacacgtcccgtaggcgccgtagaacgtattctagacttaagtttacttacgtgtacaggtacacggttacgttacgtagttccgtccgttccgaccttcgtaccgtttcggggaccgggttacgggtaccgtaagggtcgggtaacgtaacgttaaccgaaacggtacggttggtacggtaccgttacggaccctaaccgtcgttacgttaccg

SEQ ID NO: 193925 - DNA, 802 bp, Homo sapiens
  misc_feature: GYAE6OF02FJ6W4.36.46.E02.1.454.CMB.1.raw
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagaccaccaccggagaggttgtgttgacgcagtcctacgacgacctccgtgttcttcgtcctaccgaggacgacgagacgaccctaccctcctccgtgaccggaccggaccgacgtacgaggtacgtactaggaaacgaacggaccgtaaccgtaaccggtccgtaccggttaccggggaacccggacggtaaaacctaaccggtccggaccggaccggtcccctaccgacgttcccttcccacttacgttactacggtgttaacgcgtactacgtaccggtaaggggtcccgggcctggtacgcgtaacctaccggaagtacggtacggttacgngggtcggacgtagggtcggtacggaggtacacggttaccnccgactaccgaccacgtacgcgacgtacgacgtaccgtcggtacctaagggtacgtttgttacgacgttacgtttaaccttacgttacgttacgtacgtacggaacgtttaaggttacgttaaacggtaacttacccgggttacggtaccggttacccgggttaccggaaaacccgggttacgggtaacggttaacggtaaacggtaaccgtaaaggaaacccggtacggttccgggtacctacggtccgtaaacccgttaccggtccgttttacgacccgtttacg

SEQ ID NO: 193926 - DNA, 650 bp, Homo sapiens
  misc_feature: GYAE6OF02FFY3Q.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacgtaggttccaggtcggacgaggttcgggtctggggaacagtacctttacgacgtcctacaccgtatcagccaggacttcggaccctgaacgtattttcgctagtacttagttactgtctaggactagttatagggttaaactaccgaacccgttcgggtaaccgtttccgggaacccgaaacgggggtaaccccgtaaaggggtacgggaaaacgttaaccgggaaaacgggtaaaccggttcgggtaacgggtacccgttacgggtacccgtaaacccgtaagttacccggttaggttacccgttttaaccccg

SEQ ID NO: 193927 - DNA, 550 bp, Homo sapiens
  misc_feature: GYAE6OF02G9AR6.36.46.E02.1.454.CMB.1.raw
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (521)..(550): a, c, t, g, unknown or other
  misc_feature (521)..(550): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgacaaaaagggcgacccgccagggtcgggggcttatcattacgactacgtcggggaccgaggggaaccccggtcaccgtctcctcacgcctccaccgaacgggcccagtccggtccttccccctgggcccgcccgtcgcctccgaggacgccacccgtccgacgtacgccaacgacggcccggtcccgtggggctcggcccgttgggtaccgaaacgggtaccttaccttaccgacgaaccgacggaccgttacgtacggacggtccggggtcgtcgggaccggaacggccggacgtaagtagngagngnnnnnnnnnnnnnnnnnnnnnnnnnnnnnn

SEQ ID NO: 193928 - DNA, 657 bp, Homo sapiens
  misc_feature: GYAE6OF02G02US.36.46.E02.1.454.CMB.1.raw
  modified_base (408)..(408): a, c, t, g, unknown or other
  misc_feature (408)..(408): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaacgcgactacgtacgccgtggtaccggcaagaaacctggaccaggcctcccagtcctcctcatctatgatgcatccgaggtacgggccgcgtggccactcccgaagactaggttcaggtggacctagggtggtacgtgggacacgtacttacgacgcctaccaccntacgacgcacgacgtcgaccgtagtaagtacgttttcgacgttacgttacttacttacgtcgttacgtacgacgttaagttacgttaggttaaaccttaccgtaacccgttaccgggtaccggttaccgggtaacccggtaaaccggggtaaccgtaagggttaacggaaacgttaacggaaaacggtaacggttacggtacggtacgtacggaacctaccgtacgtttccgttacgttccgttacccg

SEQ ID NO: 193929 - DNA, 673 bp, Homo sapiens
  misc_feature: GYAE6OF02GAGZN.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagaccaccaccggagaggttgtgttgacgcagtttccagacaccctgtctttgtctccaggagacagagccaccctctcctgcgacgggccagtcagagtatcagaagcgacgtacgtacgcctacggtaccggacaacgaaaccgtcggaccacggcctcccgtacgtcctcctacactctagtgatcgctactccgtaggtacgggccgtcgtcggtaccactacccgacgaaccgtaggttacgaggtcggacgtagggttcgggtcgtagggacagtaccttcgaccgtcctaccaccacgtaccgagacaacgacgtaccggaacccgttaggtaaacgttcgtttagaccgttaacgttcttaagttcgtagttacagtacgtagttagttaccggtaactacctacccggtaggttaaccgtacgggaaccgtaacgggaccgttaaggtaacggtaaacgtaaccggtaaaggtacgtggtacggtacgtaccgacgtaaccgttacgtcgtacggtttcctaccg

SEQ ID NO: 193930 - DNA, 620 bp, Homo sapiens
  misc_feature: GYAE6OF02JGIUE.36.46.E02.1.454.CMB.1.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaacgcgactacgtagcctggtaccggnagaaacctggccaggctcccagtcctcctnatctatgatgcatccagtaggccngtcggcactccgagtaccgaggttcagtggcgtaggtcggtcgtgggacacgtacttcgaacgtctacgaccactcgacgcgaacgtacgtacggaaccctggtaagttacgttttcgacgtaagttacttaacgttactgtacagtctaaggcgttacgaccgtaacgttcgggtcccgttaccggggtaccgtttcgggaccgggtaaccgggtaccgtaagggtcggtaacggtacgtaacgaaaccggtacgttggtacggaccgttacggaccgtaaccgtacgtacgttccg

SEQ ID NO: 193931 - DNA, 818 bp, Homo sapiens
  misc_feature: GYAE6OF02G3KFW.36.46.E02.1.454.CMB.1.raw
  modified_base (202)..(202): a, c, t, g, unknown or other
  misc_feature (202)..(202): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtcctccagganacagacgccaccctctcctgccgagggccagtcacgagtactcagacgcgtactacgtacgcctggtaccggacagaaaccgtggccaggcctacccagtcctcctcactctatgatgctactaccgaggtacggggcccgtcgtcggctactccccgaagtaccgtaagggtttaccagggtacgggacgtaacggggttggggtaccgtagggggaacctaacggtaccctttacccgaccggtcccttaacccgaacccgtacgttaccgaacggaccgtaacggaacccggttccgggtaaacccttaacgggaaacgttttactttttacgggaccgtttaacgtttaccgtttaaacgtttaccggttacgtaccgtaacggtacgttaaaggtttaacgttaacggttaaaccgttaacccgtaacccggttaaccgggttaacccgggtttacccgggaaaccgggttaaacccgggggtaacccgttaacgggggtaaacggttaaaaccgtaacgggtaaaaacgggttaaccggttaaccgggttaaccggtaaccggttaccggtacccgaacctaacgtttcgttaccggtttccttaacccg

SEQ ID NO: 193932 - DNA, 725 bp, Homo sapiens
  misc_feature: GYAE6OF02G3C30.36.46.E02.1.454.CMB.1.raw
  modified_base (350)..(350): a, c, t, g, unknown or other
  misc_feature (350)..(350): n is a, c, g, or t
tcagtacgctgtctcacgaccggtgctcgatttagactcatctacaggggaaagggggaagaagagctgctcagttaggacccagagggaaccatggaaaccccagcgcagcttctcttcctcctgctactctggctcccagacaccaccggagtaggttttgttgacgctagtttccagacaccctgtctttgtctccaggagacagacgccaccctctcctgcagggccagtcaggagtactcgaagaacgcgactacggacgtccgtaggtaccggcaagaaaccgtggccgaggcctcccagtcctcctcatctatgactcgactagaccgtaggtaccggggccngttcgggacctaccgtacccgaggtaccgtaggttacaggttcggcgtagggttgggtcggtgggacgtacgtacgtttaccgacgtccttacgaaccctagtaccaggtaccgaacggtaccgtacgggtaacccgtaggtaaccgttagttttcgaccgttacgttacctttacgtttacgttacgtccgtacgtacgttaacggttaggttaacggttaaccgtaacccgtaccggttccggttaccggttaccgggaaccgggtaaacgggaaccgttagggtaaccggtaaggtaaccggtaaacgggtaacgttgggtaacgtaccgtacggtacctaacgtgttaccgttcgttaccgtcgttacccg

SEQ ID NO: 193933 - DNA, 789 bp, Homo sapiens
  misc_feature: GYAE6OF02IWZWY.36.46.E02.1.454.CMB.1.raw
  modified_base (393)..(393): a, c, t, g, unknown or other
  misc_feature (393)..(393): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctcaggagacagacgcccaccctctacctgccgacgggcctaaggtcacgagtactacaagacgcgacgtacgtaacgccgtacggtaccggactaacgtaaaccgtgggaccaagggccctacccgagtccgtaccctacgtaacttactaacgtggaacttaccggactaaccgttaccgagggttaccggggacccgngtccgggacaacccgttcccgaagtaccgtagggtacccgtaggtccgggtacttaaggggttaccgggtgtacgggaacgtaaaccgtccgtttaaaccggccgtacccgttacgaaaccctcgtaccaggaacccgtaagtcccggtaccgggtaacccgtaaggtaaacggttctttaccgacgttacggtttacttaaacgtttcacgttactacgtacgttaacggttactagtaaacgccttaacccggttacgggttaccggttaccggaaccgggtacggaaaccggtacgggtttaaacgtaaacgtaaccggggtaaacgtaacgggttagtaaccggtacgtacgttaaccgaacccgtaggttaacgtcccggttattacccgg

SEQ ID NO: 193934 - DNA, 712 bp, Homo sapiens
  misc_feature: GYAE6OF02GFODY.36.46.E02.1.454.CMB.1.raw
  modified_base (471)..(471): a, c, t, g, unknown or other
  misc_feature (471)..(471): n is a, c, g, or t
tcagtacgctgtctcacgaccggtgctcgatttagactcatctacaggggaaagggggaggaactgctcagttaggacccagacggaaccatggaacgccccagcgcagcttctcttcctcctgctactctggctcccagatatcactggagaaatgtgatgacgcagtctccagccaccctatcgtgtgtctccaggagaaagacgcccaccctctccgtgtacgggcctagtcaggagttgttagcaagctaacttcgcctaggtaaccagacaacggtaaacctcggacccgtaaccgggttcccagggtcctacgtactcctaattccgttagtgggtcgacctacgtaccccgaccggtacgggaccctacggttcggtacctaccccgaacgtcccttaaccgtttaggcggtacgtacgggttcgggtcgtagggactaggtacgttccacgttctccaacctntccgaacgccgtacgtcctcgactacgttacggtaacgtacggtttagtttacgtacttttaaggtttttaccttacgtacgttaaccaaacgttaacgttaacctaagtttcggaccgttcggtacccttacgttacgttaccgggttgggacccgggtaaggtaccgtagggtaggaacgtaccgtaaacgaacgttacgtcggtacgtctaccggttacacccgtttgtcctttacgg

SEQ ID NO: 193935 - DNA, 704 bp, Homo sapiens
  misc_feature: GYAE6OF02I73VC.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagaccacctgtctttgtctccaggagacagagcccaccctctcctgcagggccagtcagatatcgagaagcgactacgtacgccgtggtaccggcacgtaaaccgtcggccagggcctccccgagttcctcccgtctattacctagtgtagtcgtcactccggaaggttaccggggcctacgtcgggccacgtacccgaagacgtaggttacaggtggacgtaggtgggtacgtgggactagtacgttcaccggtctaccaccactacgagacacgacgtaccgacccgtagtaacggttacgtttacgacttacgttaccgttacgttacgttacgtaccgtacgacttaacgttagttaaccggttaacttaaccgtaacccggttaccggggttaaccggttcccgggaaaccgtaacgggtaacccggtaacgggttaacggtaaacgtaacgggtaaaacggtacgggtacgttacgggacttacggaccgtaaccgtacggttaccgttacgttaccttaccg

SEQ ID NO: 193936 - DNA, 736 bp, Homo sapiens
  misc_feature: GYAE6OF02HYHGQ.36.46.E02.1.454.CMB.1.raw
  modified_base (224)..(224): a, c, t, g, unknown or other
  misc_feature (224)..(224): n is a, c, g, or t
  modified_base (376)..(376): a, c, t, g, unknown or other
  misc_feature (376)..(376): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctccagacaccaccggagaggttgtgttgacgctagtttccagaccacccttgtctttgtctaccgaggagacagacgcccacctctccngcgaggccagtcagatactcaaggaagccgtactacggcgtaccgtacggtaccgacgaacgaaaccgtggaccgacggcctacccgacgtccttaccgctaacgttcctaagtcgtacgttagcctacgtaccgacgggtaccgggcccgngtacggacctacgtaccccgaggtaaccgtacggttacgtacggtggaccgtagggttcgggttacgtaacgggtacgacgtacccttacgaccgtactacccgacgtactaccggacgtacgaacgtccgtaaccggtaccgtaacggtaaggttacgttcggtaacgttagttaccgttaacgtttacgtacgtacgacgtaagtacgttaacggttacgtaaaccgtacctaacggttaccgggttacgaccggtaaccgggaacggtacggaacggttaacggtaacgaacggtaaacggtggtaccggtaggtaccgtaccggacctagtaccgttacttccggttacttacccg

SEQ ID NO: 193937 - DNA, 593 bp, Homo sapiens
  misc_feature: GYAE6OF02HKYSQ.36.46.E02.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
  modified_base (591)..(591): a, c, t, g, unknown or other
  misc_feature (591)..(591): n is a, c, g, or t
tcagtacgctgtctcacgaccggtgctcgatttagactcatctacagggaagggcttggagtgggtctcaggtatcagttacaatagtggtagcgtgggctatgcagactccgtgaagggccgattcaccatctccagagacaattccaagaacacgctgtatgtgcaaatgaacagcctgagagcgaggacacggntgtgtattacgtgtgcgagagacgcctcncgcttcctagtcggttacggggtattacggccagtaacgtcggacgtcgtggggacgaaacgggaccacggtcgaaccggtctccgtacacggtcctaccaaccgtaacgggcctaacgtccggttccttccccgtggtacccaccccgtttccaaccgaagccgacctaaccgttcgggtcggggacaccgagccggtccgtacggctcgcgtaggtacgaacggtactacgttacgacgtacacgtcgtaactcgggacgcggacgtcggaacggacggctaaaccgagtacgnacgacgntacgcatcgcgcancgcgcgtcgngacgcacgacacacgagacgtacgacgacgacgtaganac

SEQ ID NO: 193938 - DNA, 1189 bp, Homo sapiens
  misc_feature: GYAE6OF02I6X1A.36.46.E02.1.454.CMB.1.raw
  modified_base (470)..(470): a, c, t, g, unknown or other
  misc_feature (470)..(470): n is a, c, g, or t
tcagtacgctgtctcacgaccggtgctcgatttagactcatctacagggaaaggggaagaagagctgctcagttaggacccagagggaaccatggaaaccccagcgcagcttctcttcctcctgctactctggctcccagacaccaccggagaggttgtgttgacgctagtttccagaccacctgtcttgtctccaggagacagacgacccaccctctccgtgccgagggtcccagtaccaggagtataccaagaacggacctaacgtaccgtacgcctgggtacccgcgtaaacgaaccgtacggacccaggccttccccgacgttccgtccctacgtattacgtactagactgacacgtcgaacggtacgggcccgcgttaggccactccgaacggtactacggttaccgaacggtggacctggggtacggttccggagggaactagtaaccgttccacgtcctaacncctaagtaccacgacacggtaacccgtacggtaccgtaaggtaaacccgttagtttacgtaccgttaacggttacccgttttaaacgtttaaccgttacgtttacccgaaacgggttaaacccggtttaacgggtttaaaccgtaaaacgggggtttttaaaaccctttaaacccccggggttttaaaacccggggtttttaaacccccccggggggggttttaaaaacccgggttttttaaaccccccccgggggggtttaaaaaaacccgggggggagaaaaaacccccccccccgggggggttttaaaaaaaaaacggggggggggttttttaaaaaaaaccccggggggggttttaaaaaaaaaaaaaacccccccggggtttttaaaaaccccccgggggggggtttaaaaaaaaaaaaaaaaccccggggggggttttttaaaccccccggggggggggttttttaaaaaaaccccccggggggttttttaaaccccggggggggtttttaaaaaaccccccgggggtttttttaaaaaaccccccggggggaaaaacccccccccggggggttttttaaaaaaccccccccgggtttaaaaaacccccggtttttttaaaccccccccggggggggttttttttttaaaaaaccccggggttttttacccccccccccggggggtttttttttaaaaaaacccccccccggg

SEQ ID NO: 193939 - DNA, 638 bp, Homo sapiens
  misc_feature: GYAE6OF02HX8YF.36.46.E02.1.454.CMB.1.raw
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
  modified_base (466)..(466): a, c, t, g, unknown or other
  misc_feature (466)..(466): n is a, c, g, or t
  modified_base (509)..(509): a, c, t, g, unknown or other
  misc_feature (509)..(509): n is a, c, g, or t
  modified_base (595)..(595): a, c, t, g, unknown or other
  misc_feature (595)..(595): n is a, c, g, or t
tcagtacgctgtctcacgaccggtgctcgatttagactcatctacagggaaaagggggaagaagagctgctcagttaggacccagagggaaccatggaaaccccagcgcagcttctcttcctcctgctactctgctcccagacaccaccggagaggttgtgttgacgctagtttccagacaccctgttctttgtctccaggagacagacncccacctctcctagcgaggcagtacagagtatcaagaacgcgtaactacgtagccgtacgggtaccgganaacgtaaaaccgtggaccgtacggacctacccgacgttctacctacgtaactctaatacgactagctaactccgacggtacggccgtcgtacggtacaccgtacccgaanacggtaacgttccgaagggtggacgacgggtttgggtcgtaggacgtaacgtacgtccgtacgactaccaccgtanacgaacggactaacgtacgtacggtacctagtaagttcgttanaacgtagtttctaaattcgtagtaccagtacgaagttaacgtagtaaactaccgaacgtcggtacgtcgaaccggagacgaagtanaacgtaagacgaatgtacgagtgactaactgttcgcttatacc

SEQ ID NO: 193940 - DNA, 772 bp, Homo sapiens
  misc_feature: GYAE6OF02HXP4X.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagacctaccctgttctttgtctccgaggagacagacgcccaccctctcctgcgagggccagtcagagtatcgaagaagcgacgtacgacgtccgtcggtaccggcgaacgaaaccgtcggaccgacggcctacccgagttcctaccgtactactacctatgactggacctactccggaaggtacgggcccgtacgtcggtaccaccgtacccgaaggtacgtacggttcgaaggtcggtacggtacgggttcggggtacgtacggggtactaacggtaccgttaccgacccgtcctaaccgtaaccgtagtaccgaacgcgtaacggacccgttacggtaacccgtaaggttaacgttacgttttacgacgttaacgtttacttaacgtttacttaggtaccacgttaacgtaaggtttaacggtacggttaaaccttacccggtacccggttacgggttacccgggttacggaaacccggtaaacggggtaacggtaacgggttaaggtaaaccgtaaacgggtaaacggttaacggtcgggtacggtaccgtaccggtaaccgtaaccgtacggttccgttacgttacctaccg

SEQ ID NO: 193941 - DNA, 931 bp, Homo sapiens
  misc_feature: GYAE6OF02H1OXJ.36.46.E02.1.454.CMB.1.raw
  modified_base (181)..(181): a, c, t, g, unknown or other
  misc_feature (181)..(181): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctccagaccaccaccggagaggttgtgttgacgctagtttccagacncccttgttctttgtcctccgaggacgacagacgtccaccctcgtcctcgcgacgggccacgtcaggagttatcgaacgagccgtaactacggtacgtccgtacgggtaccggacaaccgtaaaccgtcgggaccgacggccccttaccgaccgttcccttacccgttacacgttacctacgttacggtacgttacggaccgtaaccgtccgggttaaacggggttaccgggggccggttaacccggcggtaccctaccgttaccccgaaaggtccggtaaacgggttccggttaacgggtacggtacggttcggggtttacgggttcggttaacggggaactacgggtaaccttccgggaccgttaccctaccggtaacctacgtaccggaactaccgtacggtaacccggttccggtaaccgttaaggtaaacgttttaccggttttgtaacccggttacttttaacgttttaagttaacccgggttgttaaaccgcgttaacggttaacgttaacgggttacgtttaaaacgttaccccggttaaccgggtttaacccgggttaaacccgggtttaaacccgggaaccggggttaaaaagggtacccgggttaaaacgggggttaaaccgttaaaacgggtaaaccggggttaaacggtttaaccggggttacgggtacccggttaacggttaacccggtaacctacgggttaaaccctttacggtttccggtttacttaacccccgg

SEQ ID NO: 193942 - DNA, 454 bp, Homo sapiens
  misc_feature: GYAE6OF02F8DD5.36.46.E02.1.454.CMB.1.raw
  modified_base (409)..(409): a, c, t, g, unknown or other
  misc_feature (409)..(409): n is a, c, g, or t
  modified_base (433)..(434): a, c, t, g, unknown or other
  misc_feature (433)..(434): n is a, c, g, or t
  modified_base (436)..(454): a, c, t, g, unknown or other
  misc_feature (436)..(454): n is a, c, g, or t
tcagtacgctgtctcacgaccggtgctcgatttagactcatctacagggaagggcttggagtgggtctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgcaaaaacgggagacccgcccaggtcgggggcttatcattacgactactgggccagggaaccctggtcaccgtctcctcagcctccaccagggcccatcggtccttccccctggccaccctcctccaagcgccacctcgtgggggcacgagccggccctgggctgccctggtcaaggtctacttccagacagcgtacngagcgggctggcaggcgcagtagnnannnnnnnnnnnnnnnnnnn

SEQ ID NO: 193943 - DNA, 616 bp, Homo sapiens
  misc_feature: GYAE6OF02F29PM.36.46.E02.1.454.CMB.1.raw
  modified_base (325)..(325): a, c, t, g, unknown or other
  misc_feature (325)..(325): n is a, c, g, or t
  modified_base (422)..(422): a, c, t, g, unknown or other
  misc_feature (422)..(422): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccggcagaaacctggccaggcctcccagtctcctcatctatgatgcactccgagtacgggccncgtggcatcccagacgaggttcagtggctaggtggtcgtgggacagtccttcgaccgtctacaccgatcgagcgagacgtcggtacctagtaacgtnttttcgcttaggtacttattacgtgtacgagtactagttaagtaggttaaactaccgtaccgtttacgggacgtttaccgggaaccgtaacgggtaacccgtaagggtacggaaacgttaaccggaaaaggttaaccgttacgggtaccggtacgtacgaaccctaccgtacttaccgttacgttaccttaccg

SEQ ID NO: 193944 - DNA, 703 bp, Homo sapiens
  misc_feature: GYAE6OF02HXTV8.36.46.E02.1.454.CMB.1.raw
  modified_base (313)..(313): a, c, t, g, unknown or other
  misc_feature (313)..(313): n is a, c, g, or t
  modified_base (682)..(682): a, c, t, g, unknown or other
  misc_feature (682)..(682): n is a, c, g, or t
tcagtacgctgtctcacgaccggtgctcgatttagactcatctacagggaaagggggaagaagagctgctcagttaggacccagagggaaccatggaaaccccagcgcagcttctcttcctcctgctactctggctcccagacaccaccggagaggttgtgttgacgctagtttccagaccaccctgttctttgtcctccaggagacagacgcccaccctctcctgcgagggccagtcagagtatcgagagacgactacgtagccgtggtaccggcaacgaaacctggaccaggtcctaccccgagtcctccncactctatgtatgctagtccgagggttacgggccgtcgtggcctacgtacccgaagtacgtacggttcgaggtcgacgtaggtcgggtcgagggacacggtacttccgacgtcaccgaacctacgtccgaacgacgaacggtcccgtacggggtaacccttaggtaaagtttcttttacggaccgttaagttcctttaaacgttccgttagtaccgtagtacgtaagttacgtaacgttaaccgtaacgtacccggttacgggttaaccgggtaccggaaccggtaacgggtaacccggtaagggtaacggtaaacggtaaacgtaaagggtaacttacgggtacggacgttacggaccgtaacccgtnttaccgttcggttacctaccg

SEQ ID NO: 193945 - DNA, 740 bp, Homo sapiens
  misc_feature: GYAE6OF02JXW5Z.36.46.E02.1.454.CMB.1.raw
  modified_base (155)..(155): a, c, t, g, unknown or other
  misc_feature (155)..(155): n is a, c, g, or t
  modified_base (224)..(224): a, c, t, g, unknown or other
  misc_feature (224)..(224): n is a, c, g, or t
  modified_base (317)..(317): a, c, t, g, unknown or other
  misc_feature (317)..(317): n is a, c, g, or t
  modified_base (426)..(426): a, c, t, g, unknown or other
  misc_feature (426)..(426): n is a, c, g, or t
  modified_base (471)..(471): a, c, t, g, unknown or other
  misc_feature (471)..(471): n is a, c, g, or t
  modified_base (482)..(482): a, c, t, g, unknown or other
  misc_feature (482)..(482): n is a, c, g, or t
tcagtacgctgtctcacgaccggtgctcgatttagactcatctacagggaaagggggaagaagagctgctcagttaggacccagagggaaccatggaaaccccagcgcgacgcttctcttcctcctgctactctggctcccagaccaccaccggngagggtttgtgttgacgctagtttcccagacctaccctggttctttcgcctccgaaggagaccaacgcncccgtaacccctctccgtgccgagggccctaagtcacgtagtctcgaacgaaggcgacttacgtagccgtacggtaccgacgaacggtaaccncgggtccacgcgtcccgagtctacccgtctaactctagtactgtccgcttactccgtaagggtaccgggccctggtcggtaccaactcccgtaacggagtacggttacnggggtacgctaggtttcgggacgtggaaccctagtccgtaacccngtacccgttanaacccgacgtacaccggactacggtaaccgccgggtaaccgttaggttaacgttcggttttaacgcgttaacgtttaccttaacgttcgttacgtacctacgggacttaaacggtaccgttaggtaacgttaaccgtaccgggtaccgttaccgggacccggttacggaaccggtacggtacggtaacggtaaccgtaaggaaacccggtatacgggtacgtcgttacgcgtaaccgacgttaccgtgtaccttacgg

SEQ ID NO: 193946 - DNA, 699 bp, Homo sapiens
  misc_feature: GYAE6OF02I0BH3.36.46.E02.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (280)..(280): a, c, t, g, unknown or other
  misc_feature (280)..(280): n is a, c, g, or t
tcagtacgctgtctcacgaccggtgctcgatttagactcatctacagggaaagggggaagaagagctgctcagttaggacccagaggaaccatggaaaccccagcgcagcttctcttcctcctgctactctgctcccagacaccaccggagtaggttgtgttgacgcagtttccagacaccctgtcttgtactccagganacagtacgccaacctntcctgaccagggccagtcagacgtatcaaggaagccgaactacgtagtcctacgggtaccgganaaccggtaaaactcggtaccacggctaccccgagtctcctacaacttcctaatcgtaagttcgacctataccgtacggtaacgggcccgtacgtcggctaactcccgaagaacgacggtttccaagggtccggtactagggtcgggttaacgtcgggactaacgggtacctttacgaacggtcctaccgtaccgacgtacgagtacgtacgacgtacggtaccctagtaagtacttttcgacgtaacgtacttaacttaacgttcgtactacgtacgacgttaagttacgtaacgtaaccgtaccgtaacggtacgttaccggtaccgaaaccgggtaccgtaagggtaacgaaacggtaacgaaaacggtagtaaccgtggtaccgttacgacgtaccacgtacgttgtaccttaccg

SEQ ID NO: 193947 - DNA, 980 bp, Homo sapiens
  misc_feature: GYAE6OF02FN97E.36.46.E02.1.454.CMB.1.raw
tcagtacgctgtctcacgaccggtgctcgatttagactcatctacagggaaagggggaagaagagctgctcagttaggacccagagggaaccatggaaaccccagcgcagcttctcttcctcctgctactctgctcccagacaccgacggagaggttgtgttgacgctacgtttccagacctaccctgtctttgtcctccgaggtacacagacgcccaccctctcctgccgagggccagtccagtagtactacgaagaacgcgaacgtacgtacggccgtagggtacccgacgaacgtaaaccgtggacccgtagggtcccctaccccgtacgttccctcccttacgaccttaccttaaggtacgtaacgttcggtacctaaccggttaccggaacgggtaccggggaccccgttcggttccggggaaccctaacccggtttaccccgaaacgggtaacccggttaacggggtttacccggtaaggggttaccgggtaccgggtaacggggtttcggggttaccgggtaaggggtaacccgtaaagtttacccgttaacccgaccggtacccttaccgtaaaccgtaccgttacggaacccggtaaccgtaaccggggtacccggttaccggtaaacccgttaaggttaaaccgggtttcggttttaccggaaccggtttaaacgttttaaccctttaacggttaaccgttaacggtaccggaaacggttaacgtttacggggttaaacgtttaccggtttaaaacgtacccccggttaccggggttaacccgggtttaacccggggttacccgaaacccgggggtttaaaccggggaaacgggttaaacggggtaaccggtaaaaccgggttaaaccgggtaacggggttaacggttttaacccggagggtttaccccaacggggaccccgttaaacggtttacccggttacccggttttaacgttccccgttaaccgg

SEQ ID NO: 193948 - DNA, 505 bp, Homo sapiens
  misc_feature: GYAE6OF01B817W.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagccctaaactcctgatctatgctgcatccactttgcaaagtgggtctcagcaaacttcattggccgtggatctggacagatttcactctcaccatcagcagtttgcaactgacgattttgactaacttactactgtcaacaggcttacgtgtccctctgaccgttcggaccaagggaccaaggtaggaaacgtacaaacgaactgtggactcggtacaccatcctgtcgttacc

SEQ ID NO: 193949 - DNA, 568 bp, Homo sapiens
  misc_feature: GYAE6OF01CEYAE.21.32.C10.1.454.CMB.1.raw
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagtcgtcgctcgcacgaccggtgctcgatttagtatagacatcaacacacaaagggggagtctcagtcaggacacagcatggacatgagggtccccgctcagctccgtggggctcctgctactctggctccggaggtgccagatgtgacatccagatcgacccagtcctccatccctccctgtctgcatccataggagacagagtcaccatcacttggtcgggacaagccagagctattaaccaacttatttgaattggtatactaagtttaaaccgagggaaacgacccctaaactcctgatctatgctgcactcctactttgactaaaggtgggtctacgagacctaaactttcaagtttcggccggtggactcgtagggacaggtactttcacttctacacctatcagtctagtttcactaacctgactatttcgactaacttactactntacaacgngtacttacggtcgttccctcgtcgtacgttccgacgtaacgggaccgtaaggtagaaactaccgaaacgtaacgtggtacgcgtcgaccaactattctgtcttac

SEQ ID NO: 193950 - DNA, 606 bp, Homo sapiens
  misc_feature: GYAE6OF01CG7OK.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctccctgtctgcatccataggagacagagtcaccatcacttggcgggcaagccagagcattaccaactattgaattggtatactagtttaaaaccagggaaacgacccctaaaactcctagatactatcgctgcactcctactttcgactaaaggtgggtctcaagactaaaacttcaagttcggacccgtggacttcgtagggactaaggtactttacacctctaccacctatctagctagtttcgaccaaacgtgaacgtacttttcgacctaaactttactacttagtaccaacgtacggtcgttaccggtcgttaccccttgtcggtaccgtttcggaaccgtaagggaccgaaacgggtaggaaaacgtcccgaaaaggtacgttggtcggaccttacggaccctaacacgtttctcggttctttaccc

SEQ ID NO: 193951 - DNA, 584 bp, Homo sapiens
  misc_feature: GYAE6OF01A7OZM.21.32.C10.1.454.CMB.1.raw
  modified_base (440)..(440): a, c, t, g, unknown or other
  misc_feature (440)..(440): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatcgacccagtcctccatccctccctgtctgcatccagtaggagacagagtccacatcacttggcggacaagccagagcattaccaacttatttgaattggtatctagtttaaaccagggaaacgcccctaaactcctagattcgtaatcgtactgacatccctatttgacgtaaaggttcgggtctcgagactaaacttcagttggccgtggactcgtagggacagtattcactctacacatcagctagtttcacaactagacgtatttgactaacttactactntacaacgaggtaccttacgggtctacccgttctacggtacgttccggaccgtaaacggggtaccctaaagggtacggaaacgtaccgtaaaaccgaacgttggtaggacctacgacctaccgtaccttcgttcgttcttacccg

SEQ ID NO: 193952 - DNA, 510 bp, Homo sapiens
  misc_feature: GYAE6OF01ER00X.21.32.C10.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcggcaagccagagcattaccaactatttgaattggtatcagtttaaaccagggaaancccctaaactcctgatctatgctgcatccactttgcaaagtgggtctcagcaaacttcattggccgtggatctgggacagatttcactctcaccatcagctagtttgcaacctgacgtattttgctaacttactactgtacaacagcttaacggtgttcccctcttcgacgttacggccgtaaagggaccaaaggtaggaaagtccaaaacgaactgtaggctagcacatctgtcttac

SEQ ID NO: 193953 - DNA, 604 bp, Homo sapiens
  misc_feature: GYAE6OF01A5HJT.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactcctgatctatgctgcatccactttgacaaagtgggtctcagacaaacttcattggccgtggatcgtgggacagtatttcactctcaccatcagtctagtttcgcaacctgacgtattttcgactaactttactacttgtacaacgtaggtaccgtttacggtcgttccccttacgttcggtaccggtttaccgggacccgtaaacggggaacccgtaaagggttaacgggtaaaaactaccggaaaaaccggtaacggttcgggttacgggaccgttacggacccgtaaccccgtaagttcccgttggttccctttaacccg

SEQ ID NO: 193954 - DNA, 589 bp, Homo sapiens
  misc_feature: GYAE6OF01AMC4T.21.32.C10.1.454.CMB.1.raw
  modified_base (273)..(273): a, c, t, g, unknown or other
  misc_feature (273)..(273): n is a, c, g, or t
  modified_base (497)..(497): a, c, t, g, unknown or other
  misc_feature (497)..(497): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacncccctaaactcctgatctatgctgcatcctactttgacgtaaaggtcggggttacctcgaacgtacctaaaactttcaagtttcgggcccggttagggaacttcgtagggaactaggtactttcaaccttcctacgacctatcagtctagtttcgacctaacgtgaccgtattttcgactaactttactacgtcgtacaacgtcgtacttacggtcttcccgtntcggtaccgttcggaccgaacgggtacctaagggtacgaaactaccgaaacgacgtggtacgcgtacgtaccaccattccgttgtcttaccg

SEQ ID NO: 193955 - DNA, 535 bp, Homo sapiens
  misc_feature: GYAE6OF01BXYSK.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctgcatccataggagacagagtcaccatcacttgtcgggcaagccagagcattaccaactatttgaattggtatcagtttaaaccagggaacgcccctaaactcctgatctatgctgcatccactttgcaaagtgggtctcagacaaacttcattggccgtggatcgtgggacagtatttcactctacaccactcagctagtttcgctaactgacgtattttcgactaacttactactgtaccaacgacggtcttacggtcgttcccgtctcggtacgttcggacccgaaggggtacccaagggtaggaaacgtccgaaaacgacgtggtagtcgtacgcacctatctcgtcttacc

SEQ ID NO: 193956 - DNA, 549 bp, Homo sapiens
  misc_feature: GYAE6OF01AN1Q6.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactcctgatctatgctgcatccactttgcaaagtgggtctcagcaaacttcattggccgtggatctggacagatttcactctcacatcagctagtttgactaacctgacgtattttgctaacttactactgtactaacacggtactttacggtcgttccctcgttagtaccggttccggacccgtaaaggggtaccaaagggttaggaaaacttccgaaaaccgtaacgtaggttacggcctacgccgtaacccatccttgttctttacc

SEQ ID NO: 193957 - DNA, 517 bp, Homo sapiens
  misc_feature: GYAE6OF01DZL0Q.21.32.C10.1.454.CMB.1.raw
  modified_base (277)..(277): a, c, t, g, unknown or other
  misc_feature (277)..(277): n is a, c, g, or t
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttggcgggcaagccagagcattaccaacttatttgaattggtatactaagtttaaaccagggaaacncccctaaactcctgatctatgctgcacttccactttgactaaaggtgggtctcagactaaacttcattcggcgtaggatcgtggactagtatttcactctcaccatcagctagtttgactaactgtacgtatttcgactaacttactactagtacaacgngtaccgttacggtcttcctcgtcgtaccggtcgacgaagacgagtagaatacaaacgntgnggtcngcacntctgtctac

SEQ ID NO: 193958 - DNA, 598 bp, Homo sapiens
  misc_feature: GYAE6OF01BDR3K.21.32.C10.1.454.CMB.1.raw
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (588)..(588): a, c, t, g, unknown or other
  misc_feature (588)..(588): n is a, c, g, or t
tcagtcgtcgctcgcacgaccggtgctcgatttagtatagacatcaacacacaaaggggagtctcagtcaggacacagcatggacatggagggtccccgctcagctcctggggctcctgctactctggctccggaggtcgccagatgtagacactccagactcgaccctactcctcctactccctcctgtctcgactactacagtagacgacacgtactccactactacgtacgtcggacgacacgtacagtactactactaactattagtatatagtactacgtaacgtaaacgacgtaacctacctatctacgtcttactgtctctactaccttacgtacgttagtacggtacgtacgggtcgtactacgtaactacgtacgtacgtggtacgtcgtagtacgtcgtacgtacttacttccgtactacctactacctagtaccgtgtactacgttacgtactacgtagttactacgttactactacttacncgtacncgacgttacggtctacgtccgtacttcggactacggtacgtaaccgagtacgtagtagactacgngttacgntcgacncctatctacgntctcgtctcc

SEQ ID NO: 193959 - DNA, 508 bp, Homo sapiens
  misc_feature: GYAE6OF01AYAQD.21.32.C10.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactcctgatctatgctgcatccatttgcaaagtgggtctcagcaaacttcattggccgtggactctgggacagatttcactctcaccatcagcagtttcgctaacctgacgtattttgctaacttactactntacaactagcttacggtcgttccctcttgaccgttcggccgaagggacctaagggtagaaagtcaaacgaactgtgactcgacacatctgtcttacg

SEQ ID NO: 193960 - DNA, 616 bp, Homo sapiens
  misc_feature: GYAE6OF01EU4F7.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctgcatccataggagacagagtcaccatcacttgtcggcaagccagagcattaccaactatttgaattggtatcaagtttaaaccgagggaaacgccccctaaactcctagatctatgctgcactccactttgactaaaggtgggtctcagacaaacttcagttggccgtgactcgtagggactagtattcactctacacctatcacgtctagtttcgactaaccgtgaacgttattttcgacctaaactttacctaacttcgtacaacgtacggttacctttaaccgggtccttacccgttcgttacggacccggtttcgggaaccccgtaaacggggtaaccctaaaggggtaacggtaaaacgttaccgaaaaacggtaacgttgggtacggtccgtacggtaccaaccggttatttccgttgttccgtttaccc

SEQ ID NO: 193961 - DNA, 515 bp, Homo sapiens
  misc_feature: GYAE6OF01BH2PQ.21.32.C10.1.454.CMB.1.raw
  modified_base (446)..(446): a, c, t, g, unknown or other
  misc_feature (446)..(446): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagccccctaaactcctgatctatgctgcatccactttgacaaagtggggtctcagcaaacttcattggccgtggatcgtgggacaggtatttcactctcaccatcagctagtttcgactaacctgacgtattttgactaacttactactgtacaacaggtcttacggtcgtccctntgacgttcggccgaagggaccaaggtaggaaatcgaaacgactggtcggctacgcacctatctgtctac

SEQ ID NO: 193962 - DNA, 687 bp, Homo sapiens
  misc_feature: GYAE6OF01A0J9Y.21.32.C10.1.454.CMB.1.raw
tcagtcgtcgctcgcacgaccggtgctcgatttagtatagacatcaacacacaaagggggagtctcagtcaggacacagcatggacatgagggtccccgctcagctcctggggctcctgctactctggctccgaggtgccagatgtgacatccagatgacccagtctccatccctcctgtctgcatccataggagacagagtccaccatcacttggtcggcaagccagagctattaccaatatttagaattggtatctaagttaaaccgagggaaacacccctaaactcctagactctatcgctgacctactcctacgtttgacgtaaagggttcgggtacttacgaagtacctaaacgttcgtaacgttcggtaccggttaggtaacgttcggtacggggaactaacggttacttttaccgaacctttccgtacctaaccctactactaacggtacgttacgtttacgacccgtaaaccgttagtaaccgtttaagttttaccgtaacccttaaacgtttacctaaccgttacgtaaccgtaacgtaccgggtaccgtttaccgggtaccttccccgttacgttacggtaccggttacggaaccggtaacgggaccgtaagggtaacgaaacgtacgtaaacgtacgtgtacggtacctacgacctacctattcgttcgtctaccg

SEQ ID NO: 193963 - DNA, 697 bp, Homo sapiens
  misc_feature: GYAE6OF01AX0IS.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatcgacccagtcctccactccctccctgtctcgcactccaagtaggagacagacgtaccacctatccgtacgttggtccgggacaacggccagacgtactaacttaacctaactttatttagtaagttaggtaactacgttaaacgttaaaccgaacggtaaccgtacccctaaactccctagtactctagtcgtctcgacctactacctacgtttacgacgtaacggttcgggtactacgaacgtaactaacttacgtacggttcgggtcggtaggtacgtcggtacgggtactagttaccttacctaccttactaccaccgtatccgagtacgttagttccgacctaaccgtagttacgttagtttccgaaccttaacttacctacgttacgtaccgtaacgtcgttaccgttacggtcccgttccgtacgtaccgggtaccgtaccggaaccggtaacgggacccgtaaggtaaccgtaaacgtaccgtaaacgtcggtacgtacggcctacgtacctaccgttatcctgttccctaccg

SEQ ID NO: 193964 - DNA, 555 bp, Homo sapiens
  misc_feature: GYAE6OF01BIA8M.21.32.C10.1.454.CMB.1.raw
tcagtcgtcgctcgcacgaccggtgctcgatttagtatagacatcaacacacaaagggggagtctcagtcaggacacagcatggacatgagggtccccgctcagctcctggggctcctgctactctggctccgaggtgccagatgtgacatccagatgacccagtctccatcctccctgtctgcatccataggagacagagtcacatcacttgtcgggcaagccagagcattaccaactatttgaattggtatcagtttaaaccagggaaacacccctaaactcctagatctatgctgcatcctactttgactaaagtggggtctacagactaaacttcagttcggccggtggatcgtaggggaactaggtactttacacgtcttaccacctatcagtctagtttcgacctaactgtacgtatttcgactaacttactactgtacaacgagtacttacggtcgttccctgttacgtacgttcggaccgaagggtacctaaagggtagaaacgtacgaaacgtacgtggtacgactcgaccactatctgtcttacc

SEQ ID NO: 193965 - DNA, 601 bp, Homo sapiens
  misc_feature: GYAE6OF01BLFMK.21.32.C10.1.454.CMB.1.raw
  modified_base (194)..(194): a, c, t, g, unknown or other
  misc_feature (194)..(194): n is a, c, g, or t
  modified_base (342)..(342): a, c, t, g, unknown or other
  misc_feature (342)..(342): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccatagganacagagtcaccatcacttgcgggcaagccagagcattaccaatatttgaattggtatactaagtttaaaccgagggaaacgacccctaaactcctgactctatgctgcatcctactttgactaaaggtgggtctcaacgctaaacttnagttggccgtgatcgtgggactagtacttcactctcaccatcagtctagtttcgactaaccgtgtacgtattttagaccttaacttaacttactagtacctaacgtcggtacgtttccggtacgttccccttcgtacggtacccggttacggacccgtaacggggaaccgtaaagggtacggtaaacgtaaccgtaaaacggaccgttaggtcggtacgttacgtacccaaccttattccgttcggttcctttaacccg

SEQ ID NO: 193966 - DNA, 657 bp, Homo sapiens
  misc_feature: GYAE6OF01CN0OV.21.32.C10.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctcctgtctgcatccataggagacagagtcaccatcacttggtcgggaaacccccccgnagagactaacttaaccaaacttatttagtaatttggtaacttacgtaacgtttaaaaccgaagggaaaccgtacccctaaacgttcccgtagtacttctaatcgctagctactacctacgtttgaccgtaaaggtcgggtactacgacgtaacctaaacgttcagttcggcgtaggtatcgtggactagttactttcgacctactaccaacctactacgacgctacgttcctacggaacctacgtagtaaagtttactttacgtaccttaactttaacttagtttacgtacaaacgtaagttaacgttaacttagttttacctttaccctttccgttacgtttacccggtcccggtacgggtaaccgttagtacgtatactaacgtaaactacgtggtacgtcgtacacctaccgtattcgttacg

SEQ ID NO: 193967 - DNA, 760 bp, Homo sapiens
  misc_feature: GYAE6OF01B9RFG.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctcctgtctgcatccagtaggagacagagtcaaccatcacttggcggacaagccagacgcattaccaacttatttgtaattggtatactaagtttaaaccgaagggaaaccgaccccttaaactcctagacttactaactcgacttcgacctacttccctacttttcgaacgtaaaagggttcggggtactaccgaacggtacctaaaacgtttcgtaagttcgggtaccgtcgggtacttcggtacgggaactaaggttactttccaacttcctaccgtaacctaactaccgtacggtacttacgggttttacgaccttaaaccgttggtaaccgtttacgttttacgaccttaaacctttactaaccgttacgtaaccgtaacgtacgggttaccgtttaaccggttcccgttaccccgttacgttaccggtaaccggtttcccgggaaaccgttaaaccggggtaaacccgtaaacggggtacggtaaaaaccgttacccggtaaaacgtaaccggttcgggtaaccggtaccgttaccggaacccgtaaccttaccgttaccggttccgttccgtttaaacccg

SEQ ID NO: 193968 - DNA, 775 bp, Homo sapiens
  misc_feature: GYAE6OF01DVSH8.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccggaggtgccagatgtgacatccgagatcgacccagtcctccactccctcctgtctgctatccagtaggagacagactccaccatctacgttggcgggacaacgccagacgactaacttaacctaaacttatttagtaacgtttagggttaacttaaccgttaaaacggtttaaaaccggaaaggggtaaaaccccgtaaccccctttaaaaccgtcccgttacggtaacttctaacgttcgtaccgtcgtacctacttaccgttaacgtttacggtaacggtaaacgggtttcgggtacctaaccgtaacggtaaaccttaaaacgtttccgtaaggtttccggtacccggtaggtaaccgttcggttaacgggacctaaggtttcctttaacctacgttacctacctaactaattccgacgtacgttacgtttcgaacctaacgtcgttaacgttacgtttcgaacctttaactacctagttaccgtaacgtacgtaccggttacttaccgggtacgttcccgtacgttacggttacccggtcgaaccggtaacgtaaccggtacggtaaagtaaccgtaaccggtaaagtacggttacgcgtacccggtcaaccgtacctactttacgttctaccgttaccg

SEQ ID NO: 193969 - DNA, 779 bp, Homo sapiens
  misc_feature: GYAE6OF01EV57D.21.32.C10.1.454.CMB.1.raw
tcagtcgtcgctcgcacgaccggtgctcgatttagtatagacatcaacacacaaaggggagtctcagtcaggacacagcatggacatgagggtcccgctcagctcctggggctcctgctactctggctccgaggtgccagatgtgacatccagatgacccagtctccatcctcctgtctgcactcagtaggagacagacgtaccacatccgtacgttcggaccggacaacgaccgaagtacgactaacttaaccaacttagttagtaagttggtaactacgtaaacgtttaaaccggaaacggtaaccgtaaccccttaacgtcctagtactactacgtcgtctacgactaccttacttacgttagaacgtaaacgggttcgggtacttacgacgtaacctaaacgttcgtacgttacggtaccggttaggtacgttacggtacgggactaacgtttacttacctaccttccgttaaccaaccgttagtaccgtacggttacgttacggttaccaacccgtaacggtttaccgttaacgtttaaccgtttttacggaaccctttaaccgtttaacccgtaagtttaccgaaaccgtaacggtaccgttacccggttaacggttccgtacccgtttcgtaccggtttacccgggtaccgggaccggtaaaccggggtaccgtaaaggtaaaccggttaacaaaccgggtaaaggttaacccggtggtaaccgggtccgtacgtacccaacggtttacctccggttaagttccgttaaccg

SEQ ID NO: 193970 - DNA, 820 bp, Homo sapiens
  misc_feature: GYAE6OF01EZ9HU.21.32.C10.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
tcagtcgtcgctcgcacgaccggtgctcgatttagtatagacatcaacacacaaagggggagtctcagtcaggacacagcatggaacatgagggtccccgctcagctcctggggctcctgctactctggctccggaggtgccagatgtagacatccagatcgacccagtcctccactcctccctgtctncactccagtagganacagacgtaccacctattcctacgtttcgggtaccgggacaacggccgaagacgtacctaaactttaaacccctaaactttaagttttaagtaagtttaggttaacttaaccgttaaaacggttttaaaaccggaacggggtaaaacccgtaaccccccttaaaacgttacccgtaggtaacttaccgtaagtcgtccgtacgacctaccttaccgttaacgtttaggaacggttaaacgggttcgggtaacctcgaacgtaacctaacgttacgtaacggttccggtaccggtggtaacgtggtacgggacttaacggttcctttacgtacccttactacccgaaccttacgtaaccgtacgttacgtttaacgttccgaaaccgttaccggttagttaaccgttttacgtttaccgtaaacctttaaccctttaccgttaccgttacgtaccgtaacggttaccggttaccgtttacggttcccggttacccgttccgttaacgggttaccggtacccgggaaccggaacggtaaacggtacggtaaacgtaaacgtaacggtaaacgtacggtggtacgtaccgtatacccgtactcgtacttcgtcgttaccg

SEQ ID NO: 193971 - DNA, 564 bp, Homo sapiens
  misc_feature: GYAE6OF01BO89F.21.32.C10.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccatagganacngagtcaccatcacttggcgggcaagccagagcattaccaacttatttgaattggtatctaagtttaaacgaggaaacaccctaaactcctgatctatgctgcatcctactttgactaaggtcgggtctcagactaaactcgtatggccgngtntcgtgggacagtatttccactcctacaccgtatacgagtctagttcnctaaccttggacgttatttgaacctacgttaccttagtctanaacgtcggtcttacggtccgtcctacgtcggtacgttccggaaccgaacggtaccgtaaacgggtagaaacgtacgaaacggtaggtacggtcggtacacgtcaccgtattcctgttccttaccg

SEQ ID NO: 193972 - DNA, 739 bp, Homo sapiens
  misc_feature: GYAE6OF01CA6KF.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtcctccactccctcctgtctgcatccataggagacagactcacatcacgttgacggcaacgccagacgactactaacctaatatttagaattgtatacgtaagttaaaccgaggaaaccgtacccctaactccgtagtactagttactcgactgacctattacctacgtttacgaacgtaaacgggttcgggtactacgaacgtaaccttaacgttacgtaacggttccgggtacggttacggtacgttacggaggtaactacgttactttaccacgttacctaaccgtaacctacgttaccgtaacgtcgtttacgtttaaccgaacccgttaaccgttaggttaacgtttacgtttacgaacctttaaactttaccgtaacgttaccgtaaccgtaacggttaccggttaaccgtttaccggttaccgttacccgttcggttaaccggttacccgggttaccggaaccggtaaaccgggtaccgtaaacgggtaacgtaaaacttaccgggtaaacggtacggttcggacggttacgtaccgacctaacgtcgttacgttcgttccttaaccgg

SEQ ID NO: 193973 - DNA, 659 bp, Homo sapiens
  misc_feature: GYAE6OF01EO1PR.21.32.C10.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagtatagacatcaacacacaaaaggggagtctcagtcaggacacagcatggacatgagggtcccgctcagctcctggggctcctgctactctggctccggaggtgccagatgtgacatccagatcgacccagtcctccatccctcctgtctgcatccagtagganacagagtccaccatcacgttggccgggacaagccaagacgactacttaacctaacttatttagaattggtaattactaaacgtttaaaaccgaagggaaactaccccctaaactccgtgactctatcgtctagctactactactttgacgtaaggtcgggtactcaacgtctaaacttcgaagttcggaccggttaggactcggtacgggaactagtaactttccactctaccacctatcgaagtacttagttccgacgtaaccgtgtacgttacgttttcgaaccttaaacttctaacgttcgaactaacgtcgtacgttaccggtctttcccgttcggttaacggtaccggttacccgggaacgtaaaccggggtaacctagggttaacgtaaaaccgtacgtaaaccggtcgtacggtcggtactacggtaacctacctagttactcgttcttacccg

SEQ ID NO: 193974 - DNA, 734 bp, Homo sapiens
  misc_feature: GYAE6OF01BF4JQ.21.32.C10.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagtatagacatcaacacacaaagggggagtctcagtcaggacacagcatggacatgagggtccccgctcagctcctggggctcctgctactctggctccgaggtgccagatgtgacatccagatgacccagtcctccatcctccctgtctgcatccagtaggagacagagtcaccatcacgttcgtcgggcaaggccagagactattaacccaacttatttgaattggtattacaagtttaaaccgagggaaacgacccctaaactcctgtactctatcgntcgctactcctactttacgacgtaaggtcgggtactacgacgacctaaacttctagttcggccgtggtagtcgtgggactaggtactttcgacttctaccactactcgacgtcgttaagtttcgaacctaaccgtacggtacgtttacgttttaccgaaccctttaaactttaccgttacttaccgtacgtaaaccgggtacggtttacccggtttaaccggtcccgtttaccccgttaccggttacccggttaacccggggttaccggaaaccgggtaaacccgggggtaaaccggtaaacggggttaaacgggtaaaccgttaaccgggtaaaaacggtaccggttcgggacggttacccgggtaaccctaccgtacccggttaaccttcggttttacgttcccgttttaaaccccgg

SEQ ID NO: 193975 - DNA, 632 bp, Homo sapiens
  misc_feature: GYAE6OF01E0Q18.21.32.C10.1.454.CMB.1.raw
  modified_base (242)..(242): a, c, t, g, unknown or other
  misc_feature (242)..(242): n is a, c, g, or t
  modified_base (627)..(627): a, c, t, g, unknown or other
  misc_feature (627)..(627): n is a, c, g, or t
tcagtcgtcgctcgcacgaccggtgctcgattttagtatagacatcaacacacaaaggggagtctcagtcaggacacagcatggacatgagggtccccgctcagctccctggggctcctgctactctggctccgaggtgccagatgtgacatccagatcgacccagtctccatccctccctgtctgcatccataggagacagagtccaacctatccacgtttggcgggacaacgccaagganacctacttaaccctaacttatttagtaagttcggttactacgttaagtttaaaccgaacgggtaacctacccccttaacgtcctacgtattactagtcgctacgactactcttacgttgacgtaaggtcgggtactcgaagactaacgtctacggtcgtacgtacgagtcggtacggacgtaagtctttacaccttccgtacaaccgtctacgaggtacgttagttaccgacctacgtacgtacgtttattactaccttaactacgtactcacgtaacgtcgttaccgttaccggtcgtaccttcgtcggtacgtccggaaccgtaagggtacctaaagggtactaacgtaactaacggcgtgacgtcacgctactatcgttctnttacc

SEQ ID NO: 193976 - DNA, 900 bp, Homo sapiens
  misc_feature: GYAE6OF01AP6KZ.21.32.C10.1.454.CMB.1.raw
tcagtcgtcgctcgcacgaccggtgctcgatttagtatagacatcaacacacaaaggggagtctcagtcaggacacagcatggacatgaggtccccgctcagcctccgtggggctcctgctactctggctccgaggtcgccagatgtagacatccagatcgaccctagtcctccatccccttcctcgtctgcctactccgaagtaggagaacctacggagtacccaaccgtattaccgtaccgttgggtacccgggacgaaccgaccgaaggacctacgtaacctttaaccctaacgtttaagtttaggtaagtttacgttacgtaaccgttaaacgtttaaaccggaaaccggttaaaaccgtaacccccgttaactttccgtaacggtaaccttacgttaacgtcgttaccgtacgtaccgtaaccttaccgtttacggttacgtaaccggttaagggtccgggtaactaccgaactacctaaacgtttccgtagttacggtcggtagttacggcgggttacggaactttacgtaccgtttacgtacccgtacctttaccgaaccgttactaccgtacgttacgtttaacccggttacgtaaacccggttacgtacgggtttacttaaacgggttttcccaaaccgtttaaccggttttaacctttaaccgttacggtaacccgtttaaaccgggttcgtttacccggtttaaccgggttacccggttttaacccctccggggtttaaaccgtacccgggttacggtaacccggtaaacggtaccgggttaaaccggtaaactaaaccggggtaaacgtaaacccggtttcgggtagaccccggtacgttacccgacggtttaaccctgggtttaccctttacgtcccggtttaaccc

SEQ ID NO: 193977 - DNA, 818 bp, Homo sapiens
  misc_feature: GYAE6OF01CUD5I.21.32.C10.1.454.CMB.1.raw
tcagtcgtcgctcgcacgaccggtgctcgatttagtatagacatcaacacacaaagggggagtctcagtcaggacacagcatggacatggacgggtccccgctcagctccgtggggctcctgctactcgtggctccggaggtcgccagtagtgtagactactccgaagtactccgaccctacgtcctacccgtaccttccccgtcccgtgtcgtcacctacgtaccgtaaggagggacgacgacgtacctaccaacctataccgtacggttcgggaccggaacaacgaccgagacgtactaaccttaacctaacgtttaagttaggtaagttacgttaactaacgtaaaaccggttaaaaccggaaccgggtaaacccctaaccccgtaaaccttaccgtaataacttacgtaagtccgtacgtactaacctacttaacccgttgtaaaccggtaccggtaagggtacccggttactaaccggtaacttaaaccgttaacgttacggttacggttacggggtaccggtagggtaccgttaacggggtacgttaacttaacggttaaccttcccttaccgttaccacctaacgtacgtacgtactacgttaccgttaacgaccgttacgttacgtacgttttacgtaactaaccgttacttaaccgtactacgttaaccgagttcgtcgttaccgtccctacgttccgtacgttaccggaacggtaccggaagtaacccgtaagggtaaacctaacgtaacggggaccttagggtcgttacgacgttcctaaccgtcgtaacgttcttccgtaccgtcg

SEQ ID NO: 193978 - DNA, 752 bp, Homo sapiens
  misc_feature: GYAE6OF01AWSBQ.21.32.C10.1.454.CMB.1.raw
tcagtcgtcgctcgcacgaccggtgctcgatttagtatagacatcaacacacaaagggggagtctcagtcaggacacagcatggacatgagggtccccgctcagctcctggggctcctgctactctggctccggaggtcgccagatgtagacatccagatcgaacccagtcctccactccctcctgtctcgcactacagtaggagacagactaccacctatccgtacgtttcggccgggaacaacggacctaaggacgtactaaccttaaacctaaactttaacgtttagtaagttagttaactacgttaaacgtttaaaacggacgggtaaacctacccctaaactccgtactacttacgtatcgtctacgtactacgtcctacgttagaacgtaagggtcggtaccgtacgacgtaacttaaactcgtacgtcgggtacgtagtacggtcgtaggtacgtattaccttctaccgtccactaccagtcgtaacgtctacgttacgtacctaacgtcggttaacttacgtttagaaccctttaactacgttaacttaccgaacgttaacgggccgtttaaccggtttacggcccgtttaccgaccggtttacgaacccgggttacgaaaccgttaacccggggaacgtttaaacgggaaaccgttaaacgtaaacccggttaacgtacggtttagggaccgtcccgtaaccggtaaccttaccggttaacttcgtcgttttccctaaaccgg

SEQ ID NO: 193979 - DNA, 616 bp, Homo sapiens
  misc_feature: GYAE6OF01DGV8S.21.32.C10.1.454.CMB.1.raw
tcagtcgtcgctcgcacgaccggtgctcgatttagtatagacatcaacacacaaaggggagtctcagtcaggacacagcatggacatgagggtcccgctcagctcctggggctcctgctactctggctccgaggtgccagatgtgacatccagatgacccagtctcatcctcctgtctgcatccataggagacagagtcaccatcgtacttggcgggcaagccgagagactaattaccaaacttattagtaattggtatactaagtttaaaccaggggaaacacccctaaactcctagactctatgactgctactcctactttgacaaaggtgggtactcgagtactaaacttcgaagtttcggaccgtggactacgtgggtacagtatttcactctacaacctactacgagtactagttgaacctaacgtcgtacgtactttcgacctaactttactactacggtactaacggtagttaccgttaacgggttccgtccttacgtcggttaccgtacgggtacgaacgggaccgtaaaggtacgtaaacgtaacgtaaaacggacgttgggtaccggtacttacggacctaaacctcgttacgtgtttcttacccg

SEQ ID NO: 193980 - DNA, 767 bp, Homo sapiens
  misc_feature: GYAE6OF01CJWXR.21.32.C10.1.454.CMB.1.raw
tcagtcgtcgctcgcacgaccggtgctcgatttagtatagacatcaacacacaaaggggagtctcagtcaggacacagcatggacatgaggtccccgctcagctcctggggctcctgctactctggctccgaggtgccagatgtgacatccagactgacccagtcctccatccctccctgtctgcactccgagtaggacacagacgtccaaccgtataccgtacgttggtaccggacaacggcccaaggtacgacttaacttaaacccgaatttagtttacggaagtttggtaacttaccgttaaaacggttaaaccccggaagggtaaaccccaaccccccgttaaacgtacccgttagtaacttacccgtagtccgtaccgttacgaccttaaccgttacccgttactttaaccgggaccgttaaaggggttcccgggttaactacggaaacgttaaccttaacgttcggtaacggttcgggaccggtaggtcgtacgggtagggaaaccttaggtttaccttcccgtacgtccctacgaccgtactccgtaagtccgttataccgactacgtgttacttacttcgaccttacttacgacttagaccgtagtaccggttacgttccggtacttccgtagttaccgtacggttaccggacggtaacgggtacgtaagggtaaacgtaacgtaaaccggtaagtaccgttacgggtcctaacgttacgacccgttactaccggtttccgttgttaccccgttaaccg

SEQ ID NO: 193981 - DNA, 838 bp, Homo sapiens
  misc_feature: GYAE6OF01BADY1.21.32.C10.1.454.CMB.1.raw
tcagtcgtcgctcgcacgaccggtgctcgatttagtatagacatcaacacacaaagggggagtctcagtcaggacacagcatggacatgacgggtccccgctcagctccgtggggctcctgctactctggctccggaggtcgccagatgtagacatccagactcgacccagtcctccacttccctccgtgtctcgctactccaagtaacggagacagtacgtaccactactctacgttcggtacgggctaacggccagacgtacctaacttaacctaagttatttaggtaattcggtaactacgtaaacgttaaaccggaacgggaaaccgtaaccccctaacgtcttacgtaacttctagtcgtagtcgtactacctaccttacgttacggtaacgtaagggttccgggtacctacgtaacggtaaccttaaacgtttaccgtacggtttacgggtccggttaaaggttaaccggttacgggtaccggtaaacgtaacgtttaaacgtttcccgtaaaccttcccgtaactaacctacgttaacgtacgttacgttaacgtttacgaaccgttaacgtacgtaaccgtttaacgtttcgtaaccgtttaaaccttacttacgtaacgtaaccgtaacgttacggttacccggtttaccggtttaccgtacccgttacggttaccgggtaaccgggttacccgggaaaccggtaaacggggttaaaccgtaaacggttaaaccgggtaaaacctaaaccgggtaaaggttaaccgtcgggtaacgtaccggtaacccgtacttaacggttacccgttaacttcggttcccgttaaacc

SEQ ID NO: 193982 - DNA, 487 bp, Homo sapiens
  misc_feature: GYAE6OF02HWU3H.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccaggaaagcccctaaactcctgatctatgctgcatccactttgcaaagtgggtctcagcaaacttcattggccgtggatctgggacagatttcactctcaccatcagcagtttgcaacctgacattttgctaacttactactgtcaacagcttacggtgtccctctgacgttcgccaaggaccaaggtggaaatcaaacgactgtagctgcaccatctgtctac

SEQ ID NO: 193983 - DNA, 522 bp, Homo sapiens
  misc_feature: GYAE6OF02IS052.21.32.C10.1.454.CMB.1.raw
  modified_base (270)..(270): a, c, t, g, unknown or other
  misc_feature (270)..(270): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctgcatccataggagacagagtcaccatcacttgtcggcaagccagagcattaccaactatttgaattggtatcagtttaaaccagggaaancccctaaatcctgatctatgctgcatccactttgctaaagtgggtctcagcaaacttcaattggccgtggatctgggacagtactttcactctacaccatcagcagtttncaactgacatttgactaacttacttancgtacaacaggtccttacggtcgtccctnttgaccgttcggaccgaagggaccaggtaggaaactcgaaaacgtaacgtgtcggtactacgacgaccaattcgttacgtcttacg

SEQ ID NO: 193984 - DNA, 498 bp, Homo sapiens
  misc_feature: GYAE6OF02H9RJ3.21.32.C10.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactccctgatctatgctgcatccactttgcaaagtgggtctcagcaaacttcattggccgtggatctggacngtatttcactctcaccatcagctagtttgcaacctgacgtattttgactaacttactactgtacaactagactttacgtcgtccctctgtacgttcgaccgaagggacaggtagaatcaaacgactgtgctgcaccatctgtcttac

SEQ ID NO: 193985 - DNA, 524 bp, Homo sapiens
  misc_feature: GYAE6OF02IBE4E.21.32.C10.1.454.CMB.1.raw
  modified_base (519)..(519): a, c, t, g, unknown or other
  misc_feature (519)..(519): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaaccagggaaagcccctaaaatccctagatctatgctgcatccatttgcaaagtggggtctcagcaaacttcattggccgtggatcgtggacagatttcactctcaccatcagcagtttgcaacctgacgtattttgctaaacttacctactgtacaactaggactttacgtgttccctctgtcgttcggaccaagggaccaaggtaggaaagtcgaaaacgtaacgtcgttaggccttacgcaaccaatcttacgtnttacc

SEQ ID NO: 193986 - DNA, 494 bp, Homo sapiens
  misc_feature: GYAE6OF02GQP1V.21.32.C10.1.454.CMB.1.raw
  modified_base (432)..(432): a, c, t, g, unknown or other
  misc_feature (432)..(432): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactcctgatctatgctgcatccactttgcaaagtggggtctcagcaaacttcattggccgtggatctggacagatttcactctcaccatcagcagtttgcaacctgacgtattttgctaacttactactgtcaacaggcttacggtgtccctntcgacgttcggccaagggaccaggtggaaatcaaacgactagtgctgcaccatctgtcttac

SEQ ID NO: 193987 - DNA, 582 bp, Homo sapiens
  misc_feature: GYAE6OF02I1HZP.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaactcctgatctatgctgcatccactttgcaaagtgggtctcagacaaacttcattggccgtggatcgtgggacagtattcactctacacctatcagctagtttcgctaaccgtgaccgttattttgacctaactttactactagtaccaaacgtacggtacgtttacggtcgttaccctcttacgtaccggtttccggacccgtaaagggtacccgtaaggggttacgaaaacgttcctaaaaccggaacgttcggttacggccttaggacctaaccctagttccgttacgttcctttaccg

SEQ ID NO: 193988 - DNA, 582 bp, Homo sapiens
  misc_feature: GYAE6OF02GE98N.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaactcctgatctatgctgcatccactttgactaaaggtgggtctcagcaaacttcaattcggccgtggatcgtgggacagtatttcaactctcaccatcagctagtttcgacaacctgtacgttattttcgaccttaaactttacctacttacgtacaaactagggtacctttacggttccgttcccttcgttcgttaccggttccggaccgtaaacggggtacccgtaagggttacggaaacgttaccgaaaaccggtaacgtggtacggactacggccaccgtatccgttgtcctttaccg

SEQ ID NO: 193989 - DNA, 574 bp, Homo sapiens
  misc_feature: GYAE6OF02GC40B.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaactcctgatctatgctgcatccactttgacaaagtgggtctcagctaaacttcattggccgtggatcgtgggacagtatttcactctcaccatcagcagtttcactaacctgacgtatttgactaacttactactgtaccaactacggtacctttacggtcgttccccttcgttacggtaccgtttccggaccgtaaacggggtacccaagggttacggaaaacgttaccgaaaaccggtaacgttcggtacggtaccgtacggacctaacccgtattccgttacgtccttacc

SEQ ID NO: 193990 - DNA, 543 bp, Homo sapiens
  misc_feature: GYAE6OF02IAE8U.21.32.C10.1.454.CMB.1.raw
  modified_base (193)..(193): a, c, t, g, unknown or other
  misc_feature (193)..(193): n is a, c, g, or t
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctgcatccatagganacagagtcaccatcacttgcggcaagcagagcattaccaatatttgaattgtatcaagtttaaaccagggaaancccctaaactcctagatctatgctagcatcctactttgcaaaggtgggtctnagacaaactttcattggccgttggatcgtgggacaggactttcactctaccactatcagctagtttgcctaactgaactntttcgactaacttaccgtatntacaactagtcttacggtcgttccctctagccgtttacgcccgtaaaggtacccgaaggtacggaaactacgaaaacgtacgttggacggtctcggaccaccgtacttcgtacgttcttaccg

SEQ ID NO: 193991 - DNA, 540 bp, Homo sapiens
  misc_feature: GYAE6OF02FTV1W.21.32.C10.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacncccctaaactcctgatctatgctgcatccactttgactaaagtgggtctcagacaaacttcattggccgtgatcgtgggacagatttcactctcaccatcagctagtttcgcaacctgacgtattttcgactaacttactactgtacaacaggtcttacggtctccctcgttcgaccgttcggaccgtaacgggacctaagggtaggaaacttaccgaaacggtaactggtacgtacgtcggacctaccgattcgttgtccttaccg

SEQ ID NO: 193992 - DNA, 529 bp, Homo sapiens
  misc_feature: GYAE6OF02IF15B.21.32.C10.1.454.CMB.1.raw
  modified_base (271)..(271): a, c, t, g, unknown or other
  misc_feature (271)..(271): n is a, c, g, or t
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaancccctaaactcctgatctatgctgcatccatttgcaaagtgggtctcagcaaacttcattggccgtggatcgtagggacagtatttcactctcaccatcagcagtttcnctaacctgacgtattttgactaactttactactgtacaacaggtcttacggtctcccttntcgtacgttcggaccgaacgggtaccaagggtacggtaaactacgaaaccgtacgtaggtacggactcgacacctatcttcgtcttacc

SEQ ID NO: 193993 - DNA, 620 bp, Homo sapiens
  misc_feature: GYAE6OF02JLG39.21.32.C10.1.454.CMB.1.raw
  modified_base (228)..(228): a, c, t, g, unknown or other
  misc_feature (228)..(228): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatcgacccagtctccatcctccctgtctgcatccataggagacagagtcaccatcacgttgcggcaagccagancatacactattgaattggtacttaacgtaacgtaaggacgtaaccctacgtacncgatactagatctancactactacttagacgaaggttcggtctacncgaactaacgtntagtacgtcgtacgtatcgtaggacatagttactacgtctaccaacgtactacgacgtacgttagtcgtaccacgtcgtaacgttagttacaacgtaacttacctacgtactacgtaacgtaggtaccgttacgttaccgttacctacgttacgttaccgtaccggtaaccggaacggtacccggtaaggtaacggtaaactaaccggtaacgtaacgttaacgggtacggaaccgttccgaaccgtaaccttaggttaccttaccggtttacctaaccg

SEQ ID NO: 193994 - DNA, 546 bp, Homo sapiens
  misc_feature: GYAE6OF02HV739.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactattgaattggtatcagtttaaaccagggaaagcccctaaactcctagatctatgctgcatccactttgactaaagtggggtctcgagcctaaacttcattggccgtggatcgtgggacaggtactttcactctcaccatcagtctagtttacgctaactgactatttagacctaacttactactacgtactaacgaggtaccttacggtcgtccctcgtagtaccggttcggaccgaacgggacctaagggtacggtaaagtacctaaacggtactggtacggctcgactaccatcgttgtacttcg

SEQ ID NO: 193995 - DNA, 568 bp, Homo sapiens
  misc_feature: GYAE6OF02IQP4J.21.32.C10.1.454.CMB.1.raw
  modified_base (272)..(272): a, c, t, g, unknown or other
  misc_feature (272)..(272): n is a, c, g, or t
  modified_base (394)..(394): a, c, t, g, unknown or other
  misc_feature (394)..(394): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttggtcggcaagccagagcattaccaactatttgaattggtatcagtttaaaccagggaaancccctaaaactcctgactctatgctgccatccactttgctaaaggtcggggtactcagacaaactttcacgttggccgtggatcgtgggacagtatttcactctcaccatcagtcagtttcncaacctcgacgtatttcgactaactttactactgtacaacgaggtcctttaacggtgttcccgttctcggtaccgttccggaccgaacgggacctaagggtcggtaaaacgtccgaaaacggtacttaggtcggtacctaggccctaaccgtactaccgttggtactttacccg

SEQ ID NO: 193996 - DNA, 879 bp, Homo sapiens
  misc_feature: GYAE6OF02JQW9P.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccactcccctctgtctgctactaccagtaggagacgagtactaccacctatctacgttcggcggacaacgccgagacgactaacttaacctaacttagttagtaagttaggttaactacgttaaacgttaaaccggaacgggaaaccctaaccccgttaaacctcgtacgtactacttagtcgtctcgactaacctccttacttagaacgtaagggtcggtactacgacgtaactaaccgttacgtacgttaccggggtacgtacggtacgttacgggtacgggtaacgtagtttactttacccgttaccttacccgtacccgtaacccttacgtaaccgttaccggtaaccgttttacggtttacgaaaccccgttaaaccggttaccggtaaacgtttttacgttttaaccggaaacccgttttaaacccttttaaacgtttccgttaaccggttaaaccgaaaaccggttaaccggggttttacccgtttaaacccgggtttcccgtttaaccccgtacggtttaaacccgggtttccccgggtaaacccgggtaaaccgggtaaaaccggggtaacccgttaaacgggggttaaacgtaaaaccccgttaaaaccgggaaacccgttaacgggtttcgggaacccggtttccgtaacggtaccccgtaacctttacggttacccgtttaccgttacccgtttaaccccg

SEQ ID NO: 193997 - DNA, 557 bp, Homo sapiens
  misc_feature: GYAE6OF02G4ICM.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaactcctgatctatgctgcatccactttgcaaagtgggtctcagcaaacttcattggccgtggatcgtagggactagatttcactctcaccatcagctagtttgcaacctgacgtattttgactaacttactactcgtacaacgtaggtccttacggtcgttaccctcgttacgtacggtttcggaccgaaggggaccctaagggttacgggtaaactaccggtaaaacgaacggttgtacggtacgttacgaccgaacctatcttacgtacttaccg

SEQ ID NO: 193998 - DNA, 673 bp, Homo sapiens
  misc_feature: GYAE6OF02ITJUA.21.32.C10.1.454.CMB.1.raw
  modified_base (336)..(336): a, c, t, g, unknown or other
  misc_feature (336)..(336): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgttcctgcatccataggagacagagtcacccatcaccttgtcgggcaagccagagcattaccaactattgaattggtatcagtttaaaccagggaaacgccctaaactcctgatctaatgctgcatccactttgactaaagtgggtctcagctaacttnacttggcgtggatcgtaggggactaggtactttcgactctaccgtaccactcgaagtctacggttttagcctaaaccgttgtaaaccgtactttttaggaccttaaaccttttaacctaaccgtttagtaccgtaaacgtacggttacctttaccgggtttaccgttaccccgttcgttacggttaaccggtttccgggtaacccgaaacggggttaaccccgtaagggttaacgggtaaaccttaaaccggtaaaaccggtaaaccgttcgggtaacgggtccgttacgggaccctaacccgttaagttcccggttaccgtttacccgttaacccg

SEQ ID NO: 193999 - DNA, 575 bp, Homo sapiens
  misc_feature: GYAE6OF02FSMSE.21.32.C10.1.454.CMB.1.raw
  modified_base (275)..(275): a, c, t, g, unknown or other
  misc_feature (275)..(275): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaacttatttgaattggtatcaagtttaaaccgagggaacncccctaaactcctgatctatgctgcactcctatttgactaaaggtgggtctcacgactaaacttcagttcggccgtaggactcgtagggactagtattttccacttcctacaccatcagtctagttcactaacctgacgttatttcacttaacttactactcgtaccaacgtcgtacgttacgtcgtcccttcgtacgtaccggttccggaccgtaaacgggtaccgtaagggtacggaaacgtaccgaaacggtacgtacggtacggactacggtaccacctattcttacgtccttacg

SEQ ID NO: 194000 - DNA, 578 bp, Homo sapiens
  misc_feature: GYAE6OF02IMZIW.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactattgaattggtatctagttaaaccaggaacgacccctaaactcctagatctatgactgcactcctactttgacaaagtggggtctcgagactaaacttctagttcggccgtggatcgtagggactagtatttaccacttctaccacctatccagcttaagtttcgactaacctagtacgttagtttacgacttaaccttaactacgttacgacctaagacgttacgttaccgtccgttcctcgttacgtaccggttacgaccgtaacggaccgtaaggacgtaactaaccgaaacgtacgttacgtcggacttcgaccgacctatcgttcgttactacc

SEQ ID NO: 194001 - DNA, 691 bp, Homo sapiens
  misc_feature: GYAE6OF02JQD57.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctgggctcctgctactctggctccgaggtgccagatgtgacatccagatgacccagtctccatcctccctgtctgcatccataggagacagagtcaccatcacttgtcggcaagccagagcattaccaactattgaattggtatctaagtttaaaaccgagggaaactaccccttaaatcctgaacttctatgctgctactcctactttcgacgtaaaggtcgggtctacgacgtactaaaaccttcaacgtttcgggcccggttaggtacttacggtggggtaactaggtaacttttccgacttactaccctaacctaatccgtaagtccgttaacgtttcgaaccctaacgttcgtaacttagttttcgaaccttaaacctttaacctacgttacgtaaccgtaaacgtacgggtttaccctttaaccgggttaccttccccgttaccgttacgggttaaccccggtttacggaacccggtaacggggtaacccgtagggttaacggtaaaaccgtaaccgtaaacggtacggttcggtacgaccgttacgaccgtaactacggttccttacgttccttaccg

SEQ ID NO: 194002 - DNA, 551 bp, Homo sapiens
  misc_feature: GYAE6OF02G4PCW.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactattgaattggtatcagtttaaaccagggaaacgcccctaaactcctgatctatgctgcatccactttgctaaagtggggtctcagcaaacttcattggccgtggatcgtggacagatttcactctcaccatcagctagttgactactgacgtatttgacctaacttactactgtacaacgtaggtcctttacggtcgttccctcgttacgtaccggtttccggaccgtaacggggacctaagggtacggaaactaacgaaacggtaacgttggtacggtacgtcgacaccgtacttccttaggttccttacg

SEQ ID NO: 194003 - DNA, 513 bp, Homo sapiens
  misc_feature: GYAE6OF02FYD9F.21.32.C10.1.454.CMB.1.raw
  modified_base (409)..(409): a, c, t, g, unknown or other
  misc_feature (409)..(409): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactattgaattggtatcagtttaaaccagggaaacgcccctaaactcctgatctatgctgcatccactttgcaaagtgggtctcagcaaacttcattggccgtggatcgtagggacagtatttcactctcacatcagctagttgcaacctgactatttgctaacttactactntacaacgagtacttacggtcgtccctctgaccgttcgaccgaagggaccgaggtaggaacttacaaacgaactggtaggctcgactaccgatcgtacgtcttac

SEQ ID NO: 194004 - DNA, 546 bp, Homo sapiens
  misc_feature: GYAE6OF02GT1MF.21.32.C10.1.454.CMB.1.raw
  modified_base (272)..(272): a, c, t, g, unknown or other
  misc_feature (272)..(272): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaancccctaaactcctgactctatgctgcatccactttgcaaagtgggtctcagcaaacttcattggccgtggactcgtgggacagtatttcactctcaccatcagctagtttgctaacctgacgtattttcgactaacttactacttgtacaactaggactttacggtcgttcccttcgtcgtaccggtttcggaccgtaacgggacctaagggtacgtaaacgtacgaaacgaacgttaggtacggtctacgacctacctattactcgtacttac

SEQ ID NO: 194005 - DNA, 849 bp, Homo sapiens
  misc_feature: GYAE6OF02G8P5M.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctccctgtctgcatccataggagacagagtcaccatcacttgcggcaagccagagcattaccaactatttgaattggtatcaagtttaaaccagggaacgacccctaaactcctgatctatgctgcactcctactttgacgtaaaggttcggggtctacgaacgtacctaaaactttcgtaacgtttcgggacccggttagggtaacttccggtacggggtaactaacggttactttttacccgtaaccttccgtacctaaacccgtacttaccgtaacgtaccgttacggttttaccgaccgttaaacccgttacgggtaaccgtttaacgtttttaccggaacccttttaaaacccgttttaacctttaaacccgtttaccggtttaaacctaaaacccggttttacggggttaacccggtttttaaaccccggggtttaccgtttaccccccggtttacggtttacccgggttaaccccgggttttacccgggaaaccccggttaaacgggggtaacccggtaacgggggtttaaaccgggtaaaaaccggtttaacccggaaaaaacccgggttaacccggttacggggttaccggttaacccggttaccggtaaccccgttaaaccccgttaacggttttacccggtttacggttttaccccgtttaacccg

SEQ ID NO: 194006 - DNA, 505 bp, Homo sapiens
  misc_feature: GYAE6OF02F4N6W.21.32.C10.1.454.CMB.1.raw
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaagcccctaaactcctgatctatgctgcatccactttgcaaggtgggtctcagcaaacttcattggccgtggatctgggacagtatttcactctcacatcagctagttgacaacctgacgtatttcgctaacttactactntacaacngtacttacggtcgtccctctgtacgttcggaccgtaagggaccaagggtcgaaacgtcgaaacgactgtggctgcaccatctgtcttc

SEQ ID NO: 194007 - DNA, 580 bp, Homo sapiens
  misc_feature: GYAE6OF02GQ84D.21.32.C10.1.454.CMB.1.raw
  modified_base (195)..(195): a, c, t, g, unknown or other
  misc_feature (195)..(195): n is a, c, g, or t
  modified_base (276)..(276): a, c, t, g, unknown or other
  misc_feature (276)..(276): n is a, c, g, or t
  modified_base (397)..(397): a, c, t, g, unknown or other
  misc_feature (397)..(397): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctccctgtctgcatccatagganacagagtcaccatcacttgtcggcaagccagacgcattaccaacttatttgaattggtatctagtttaaaccagggaaacncccctaaactcctgatctatgctgctactcctactttgactaaaggtcggggtactcacgactaaacttctagttcgggccgtggacttcgtagggacagtatttccacttctaccacctntacagctaagtttcgactaacctgacgttatttcgacttaacttactactcgtacgaacgtcggttacgttacggtccttccgttacgtcgtaccgtccggaccgaacggtacgtagggtaacgtaataacggaaacgtacgtaggtacgtcgtacgcctacctcgttcgttcttacgttacc

SEQ ID NO: 194008 - DNA, 532 bp, Homo sapiens
  misc_feature: GYAE6OF02JXYCE.21.32.C10.1.454.CMB.1.raw
  modified_base (270)..(270): a, c, t, g, unknown or other
  misc_feature (270)..(270): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcggcaagccagagcattaccaactattgaattggtatcagtttaaaccagggaaancccctaaactcctgatctatgctgcatccactttgcaaagtgggtctcagcaaacttcattggccgtggatcgtggactagatttcnctctcaccatccagtctagtttcgctaacctgaacgtntttcgactaacttactactcgtcaaactaggtaccttacggttacgtcccttcgttcgtaccgtcggtaccgaacggtaccgaggtcggaaactcgaaacgtacgtgtacggctgaccgactactactgttcttacg

SEQ ID NO: 194009 - DNA, 663 bp, Homo sapiens
  misc_feature: GYAE6OF02IN1HR.21.32.C10.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
tcagtcgtcgctcgcacgaccggtgctcgatttagtatagacatcaacacacaaaggggagtctcagtcaggacacagcatggacatgagggtcccgctcagctcctgggctcctgctactctgctccgaggtgccagatgtgacatccagatgacccagtctccatccctcctgtctgccatccagtagganacagngtcaccatcagttcgcggcaagtccagngcataccaatattgaatggtatcaagtttaaacaagggtaacaccccgtaaactctcgatctancgtctcgactacgtctacttagaccgtaaagttcggggtacttcgaagtactaaaccttctaagttcggtacccgtagtagtcgtaggtactacggtactttacgactcgtaccactacgtactacgacgtagtttaccgactaaaccttacgtaacgttagttttaacgtaccgtaaactttaacgttaacgtcgtaacctaacgtaacgttacgttaaccgggttaccttacccgtaggttaccgtacgggtttaccggaccgtaaccgggtaacctaaggggttaacgtaaccgtaaaccgtaaacggtaacttcggggtaccttaggtacccttacggtaaccctaatccgttacgttaccttaacccg

SEQ ID NO: 194010 - DNA, 593 bp, Homo sapiens
  misc_feature: GYAE6OF02IS1OS.21.32.C10.1.454.CMB.1.raw
  modified_base (220)..(220): a, c, t, g, unknown or other
  misc_feature (220)..(220): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctccctgtctgcatccataggagacagaatcactatttattgccgganaagtcacgacaataaactaccttttaaatgtatcagcacaaaccgagggaacgccccaaagctacctgatgatgctgacactactaatttagagtaggtcggggtacccatccgaggttcagtcggacagtggatcgtaggaactaaatttcactctacacctancgagctagtcagtaccaacgtagaagttntttacgactaattacctattacgtacaatagtaacgttactagttactttcctttaccgtaccgtttccgggtaccctaggggtaaccctacggtacgtaacgttacctaacgtaaacccggtaagttcggtacggtcctacgtacctaacccgttagttcccgttcgttaccttaccg

SEQ ID NO: 194011 - DNA, 608 bp, Homo sapiens
  misc_feature: GYAE6OF02F094R.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaactcctagatctatgctgcatccactttgactaaaggtggggtactacagacaaacttcaagttcggccgtggacttcgtagggactagtattttcactctacacctatcagctagttgacaacctgacgtatttgactaacttactactcgtacaacgtacggtactttacggtcgttaccctcgttacgtaaccggttaccggaccgtaaacggggaacccgtaaggggttaacggtaaaacgttaaccgaaaaaccggttaaccgttaggttaccggtaccgtacggtacctaacccgtacttaccgttcggttacctttaaccg

SEQ ID NO: 194012 - DNA, 547 bp, Homo sapiens
  misc_feature: GYAE6OF02GE8TD.21.32.C10.1.454.CMB.1.raw
  modified_base (273)..(273): a, c, t, g, unknown or other
  misc_feature (273)..(273): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacncccctaaaactccctgatctatgctgcatccactttgactaaagtgggtctcagcaaacttcattggccgtggatcgtgggacagtatttcactctcactntcagctagttnacactgacgtntttgactaacttactatgtacaactggtaccttacgggtcttcccctcgttcggtaccgttccggacctaaacggggtaccaggggttagaaacgtaacgaaaacggtacttggacgtcgtacgacctaccgtattcttacgttccttacc

SEQ ID NO: 194013 - DNA, 622 bp, Homo sapiens
  misc_feature: GYAE6OF02JBOHO.21.32.C10.1.454.CMB.1.raw
  modified_base (499)..(499): a, c, t, g, unknown or other
  misc_feature (499)..(499): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctgcatccataggagacaggacgtcaccatcacttggtcgggcaagccagacgctaagttacctaaactatttcgaaagtttcggtattacctaaacggtttaaaacccgaaggggtaaacgtaccccctaaacttcctaggaacttctaatcgtctgctactcctactttgacgtaaagggttcgggtctacgagtactaacttcgagttcgggcgtagagttcgtgggactacgtacttccactctacgtaccatcgatcgtagttcgactaacctggtacttagtttacgacttaacttacttacgttcgactaacgngtacgtttaccggtctacccgttgtacggtaccgttcggaaccgtaacgggaccgtaggtacggtaaactacggaaacgtacgtggtacgtcgtacgactacctgtacccttagttccttacg

SEQ ID NO: 194014 - DNA, 740 bp, Homo sapiens
  misc_feature: GYAE6OF02H633V.21.32.C10.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcccctcctgtctcgacactccagtaggacacgagacgtccaccatctacgttcggtacgggacacgaccagganactacttaacctaacttagtttagagtttaggtatacgtaaacgtttaaaccggaggtaaaccgtaaccccttaaacttcccgtagtaacttaccttagtcgtctgacctaacttacccgttagtttacgaacggtaaagggttcgggtaccttacgaacgtaccttaaacttcgtacggtttcggaccggttaggacttcgggtagaacgtagttactttactacctctaccacctatactacgtacgtacgtttacaccgttaaccgttagtacgtttacgtttcgtaaccttaaactttaccttacgtacgaaccgtaacgttaccgggttaccgtttaccgggttaccttccccgttacgtttccgggttaacccgggttccgaacccgggtaacggtaaccggtaacgggtaccggtaaaccgtcgtaaaccggtagtacgggttacgtccgtacggtaccctacttacgttacttacgttacccttaccg

SEQ ID NO: 194015 - DNA, 808 bp, Homo sapiens
  misc_feature: GYAE6OF02H8JAM.21.32.C10.1.454.CMB.1.raw
  modified_base (198)..(198): a, c, t, g, unknown or other
  misc_feature (198)..(198): n is a, c, g, or t
tcagtcgtcgctcgcacgaccggtgctcgattttagtatagacatcaacacacaaaggggagtctcagtcaggacacagcatggacatgagggtccccgctcagctcctggggctcctgctactctggctccgaggtgccagatgtgacatccagatgacccagtcctccatccctcctgtctgctatccagtagganacagacgtaccaccattccacgtttcggccgggacaacgccagacgactactttaacccaactttagttttacgaagttttacggtattaccgttaaagttttaaaccggaagggaaaccgtaacccccgttaaaactccccgttaggtaacttccgttaactcgtaccgtctaccgtaacttcccgttacgttttacggaccgtaaagggttcggggttactaccgtacgaaccttaaacgttctacggtttacgggaccgttaggtacgttaccggtacgggtaaccttacggttacttttacccgtaccgttacccttaccgaacccttagttaccccgtagtaccgttaaggtttccgaccgttaaacccggttgtaacgtttagtttccgtaactttaaaccctttacgttaacgttaccgtaaccttaacggttacggttaccgttttaacgggttcccgtacccgtttccgttacggttacccggtttacgggaaacccgtacggggtaaacctaggggtaacggaaactaaccgtaaaacggtacgttacgtacgggtcttaccggactacccttacgttacccgtttacgtccgtttaccg

SEQ ID NO: 194016 - DNA, 729 bp, Homo sapiens
  misc_feature: GYAE6OF02FNQNT.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatccacgttgtcggcaagccagagcataccaactattagtaacttggtatctaattaaaccgaagggtaacgacccctaacttcccgtagacttactatcgtactgacctatcccgtaacttttcgaccgtaaaaggttcggggtctacgtacgtaacctaaaccgtttctaaggttcggtaccgttagggtacgttacggttacggggaacgtacggttaacttttacctaacgttccctacgaaccctacttacgacgtacttacggttacgtaaccctaaccgttgtaacgttagttttaccgacctttaaaccttacttaaccgttcgtaccaaacggtacggttaccgtttaacccggtcgttaccccgttacgttacggttaaccggttccccggaaacggtaaccggggtaaacccggtaaggggtaaccggtaaaacgttaaccgggaaaaccggttaactcggggttacgaccgtaccggacctaaccggtctttaaccgttcgttaccttaccc

SEQ ID NO: 194017 - DNA, 873 bp, Homo sapiens
  misc_feature: GYAE6OF02HXGXP.21.32.C10.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatccctccctgtctgcactccatagganacagagtcaccatcacttggtcgggcaaacgccagagcacttaaccaacttaatttagaactttagggtacttacgtaacgtttaaaaccgaaggggaaaaccgtaccccctaaaaccgtccctagtacttaccgtatgacctcgacctacgtaccctaacgtttgaccgtaaaacggttcgggggtactaccgaagtacctaaaacgttctaagtttcgggtaccggttaggtaacgttacgtacggggtaacgtaacggttaacttttacggtaacccttccgtaacctaaccccgtaattaccgaacggttaccgttaacggttttacgaacccgtaaaccgttacggtaaaccgtttacgttttaaccggtaacccgttaaaacccttttaccgtttaaaccgttacggttaacccgtaaaacgggtacccgggttaaaccggttttacccggggtttacccgtttaccccgtttacccgggtttaccgtaacccggggttttacccggggaaaccccggttaaaccggggaacccgggtttaaaacgggtaccgggttaaaaaaccggtaaccggttaaaaaacccggtaaccggtttaagggtccgggtaccgttaacggacccgtaaacccggttaccgtttaccggttaccgttaccgttttaaccccg

SEQ ID NO: 194018 - DNA, 675 bp, Homo sapiens
  misc_feature: GYAE6OF02H9VDF.21.32.C10.1.454.CMB.1.raw
  modified_base (223)..(223): a, c, t, g, unknown or other
  misc_feature (223)..(223): n is a, c, g, or t
  modified_base (323)..(323): a, c, t, g, unknown or other
  misc_feature (323)..(323): n is a, c, g, or t
  modified_base (665)..(665): a, c, t, g, unknown or other
  misc_feature (665)..(665): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcatccctgtctgcatctgtcggagacagaatccacctatttacttgaccgganaagtcacgacaataaactacctttttaaatcggtatcagacaacaaacgagggacgacccaaagtctaccgtgattcgatgctgcactactaagtttagngtacggtcgggaccctagtcccgtaggttcaggtcggtcgaagtaggactacgtaggtaaactaacgtttcaccgttacctacgacctaactcggaacgtccgtagttacctacggactaaacccggttaaggtacgtttaatttcgacctttaaactttacgttacttaggtaaccaaagttacggttaacgtaaccgttagtttaacccgtttcctttacccgttaggtttcccggacccggtttaccggggaaccgttacggttaccgtaataacggtttaaccaaacgggtttaccttcggtaagttccgtacgtacccgttaaccgtgttcccgttntttaaccccg

SEQ ID NO: 194019 - DNA, 803 bp, Homo sapiens
  misc_feature: GYAE6OF02JVPI4.21.32.C10.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagtcgtcgctcgcacgaccggtgctcgatttagtatagacatcaacacacaaagggagtctcagtcaggacacagcatggacatgagggtcccgctcagctcctgggctcctgctactctggctccgaggtgccagatgtgacatccagatgacccagtctccatcctcctgtctgcatccatagganacagagtcaccntcacgttgacggcaagccagagcattaccaacttnttacgaattggtactacgtaagttaaaccgaggaaacgtacccctaaacgtccctagacttctatgtactcgacctatcctacttcgacgtaaaggtcggtactacgacgtacctaaaactttcgtaacttacgggtcccgttaggtaattcccgggttagggtaaccgtaagtttaccgttttaccaccgtttaccttaccgaacccgtttagtaccccgtaaggttaccgttaacggttttaccggaacccgttaaaccgttaccggtacgtttaaaccgtttttcggaaaccccttttaaacgtttacccgttaacccgtttaggttaacccgtaaaacccgttccgggttaaccttttacccgggttaccgttcccccgttttacggttaccgggtaacccgggtttaaaccggaacccggtaaacggggtaaaccggttacgggtttaaaccggttaaaacctaacccgggtaaaaccgggttaaacttccggggtaacggttaacccgtacggtaacccggtaaccttacggtttacccgttagttacccgttttaaccg

SEQ ID NO: 194020 - DNA, 687 bp, Homo sapiens
  misc_feature: GYAE6OF02HH1F6.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctacctctggctccgaggtgccagatgtgacatccagatgaccccagtctccatccctccctgtctgcatccagtaggagacagacgtccaccatcacgttggccgggacaagccaggacgctaattaaccaacttatttagaattggtaatcgtaaacgtttaaaccgaacgggtaaactacccccttaaaactcccgtagtacttacgtatacgcgtacgcctactacctacgttttaggaacgttaaaggggtcgggtactacaaggtaacctaaacttcgtattccgggacgttggaactcgtaggactagtactttccactccgacctaccagtcgacgtacttacggttacaccgtaacctggttaacgttattttaccgaaccttaaccgtttactaacgttcgtaacctaacgtacggttactttacccgggtccttccccgtttagttacccgggttaccggttacggaacccgtaacggggaccgtaagggtacgtaaacgtaaccgaaacggttacgtggaccgtactcgacctaccgtactcgttacgtaccttacg

SEQ ID NO: 194021 - DNA, 723 bp, Homo sapiens
  misc_feature: GYAE6OF02I5G1U.21.32.C10.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagtcgtcgctcgcacgaccggtgctcgatttagtatagacatcaacacacaaaggggagtctcagtcaggacacagcatggaccatgagggtcccgctcagctcctggggctcctgctactcgtcggctccgaggtgccagatcgtgacattccagatgacccagtctcatcctcctgtctgcatccatagganacagngtcaccatcacgttgtcggcaacgccagngccacgttaaccaactactttacgaatttggtaattctaacgtttaaaccgaagggtaaacgacccctaaaactccctagacgttctatcggctagcctactccgtacttttacgacgtaaaggtcggggtcctacgacgactaaaccttcgtaacgttcggcggttacggacgttacgtacggggaacctaaggttacgttacctaacgttcctaacctaaccgtcgtaccgagtaccgttaggtttcgacccgtaaccggttcgaacccgtttagtttacgacctttaaacttacgtacttacgtaccaacgtcgtaccgtttaccggtccgttaccgtaccttacggtaaccggttccggaaccggtaacgggtaaccggtacggttaacggtaaaaccgttcccgaaaaccggttaccgtacggttaaccggtcccgtttaaccggaaccgtttacccgagtttaccgttacggttcccgttttaaccg

SEQ ID NO: 194022 - DNA, 574 bp, Homo sapiens
  misc_feature: GYAE6OF02FLYE4.21.32.C10.1.454.CMB.1.raw
tcagtcgtcgctcgcacgaccggtgctcgatttagtatagacatcaacacacaaagggggagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaaactcctgatctatgctgcatcctactttgacgtaaagtgggtctcagacaaacttcattggccgtaggatcgtgggacagtatttcactctacacctatcagtctagttcgaccaactcgacgtattttcgacttaacttactactgtacaactacggtacttacggtcgttccctcgttacgtaccggttcggaccgaaggggtacctaagggtacggaaacgtaaccgaaaccgtaaccgttaggtacggtacgtacgtaccctaaccgtactccgttacgtcctttacg

SEQ ID NO: 194023 - DNA, 862 bp, Homo sapiens
  misc_feature: GYAE6OF02GMQ61.21.32.C10.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatcgacccagtctaccatcctccctgtctgactatccaataggganacgagacgtcaccattcacgtttggccgggacaagtccagacgctattaccaacttatttacgaattcggtatcgtaagttttaaaccgaagggtaaacgtaccccttaaaactcccgtacgtaattaccgttaatacgtaccgttacggacctaacttccccgttaaccgttttacggaaccgttaaaacggggtttcgggggttaccttacccgaaggtttacctaaaaccgttttcgtaacggtttaccgggtacccggttaggttacgttaccgggttaggggtaacttaacgggttacttttaccgttaacccgttccgttaaccgtaacccctaaagttaccctaacgggtacctttaacggggtttacaaccgttaaacccgttggtaacccgttttaagtttttaccggaacccgttttaaacctttaaccgttaacccgtttacgtaaacccgttaaaccgtaaacgggtttaccttttaccggggtttcccgtttaaccccttcggtttaacgacccggttttaccgggaaccggtaaacgggacccggttaaacgggtcggttaaaaccgtacgttaaaaaccgggactttaacgggacggtttcctaacgggaaccttaccgtaatttccggttaacgttctttaaccgg

SEQ ID NO: 194024 - DNA, 621 bp, Homo sapiens
  misc_feature: GYAE6OF02GEQ4J.21.32.C10.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtcctccatccctccctgtctgcatccatagganacagagtcaccatcacttgcggcaagccagagcattaccaacttattgaagttggtatactaagttaaaccagggaaactacccctaaactccgtagatctatcgctagcatcctacgtttgacgtaaggtgggtctacgacgtactaaacttcgtagttcggcgtaggacttcgtacgggactagtactttaccgtacttcctacacctactcgagtacgttagtttcgaccgtaactagtacgttatttcgactacgttaccttagtactacgtaacgtacggtacgtttacgtccgttccgttaccgttacgttcggtacccggtaccgaaccgggtacgtacggtaacggtaacgtaaaccgtaacgtaacggtacgtacggacgttaccgacgtaaccgtactacgtacgttccttaccg

SEQ ID NO: 194025 - DNA, 611 bp, Homo sapiens
  misc_feature: GYAE6OF02JAC6I.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctccctgtctgcatccaataggagacagagtcaccatcacgttgcgggacaagccagagcataccaactattagaattggtatactagttaaacgagggaaacgacccctaaactcctagatctatgctgctatcctacttgactaaggtgggtctcgagacaaacttcattcggcgtgtatcgtggactagtagttacacgtactcaccatacagtctagttcactaaccgtgtaacgttatttacgaactaacctttaacttacgtacgtacaacgtacggtacctttacggtaccgtttcccgtagttaccgttaaccggttaccggtaaccgaaacgggtaaccgtaacgggtaacggtaacgttaaacgaaaccggttaagtacggtacggtaactacggaccttaaaccgtacgttaccgtgttaccttaaccg

SEQ ID NO: 194026 - DNA, 753 bp, Homo sapiens
  misc_feature: GYAE6OF02I4KRW.21.32.C10.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagtatagacatcaacacacaaaggggagtctcagtcaggacacagcatggacatgagggtccccgctcagctccgtggggctccgtgctactctggctccgaggtgccagatgtgacatccagatcgacccagtctccatccctcctgtctgcactccagtagganacaggacgtcaacctatactacgttcgggaccgggaccaaacggcccgaagacgtacctaacttaacccaacttaagtttaggtaacgtttggttaacttaccgttaaacgtttaaaaccggaacgggtaaacccgtaacccccttaaaaccttccgtaaggtaccttacgtaacgtcgtactcgactaccgttcctaacgtttggaaccgtaagggttggtaccctagtaccgaaacttaaccgtttgacggtttaccgggtcggtacggtacttacggggagggtaccgtaagttaccgtttcctacgtacccttacacgtacctacgggtaactcgttacggttacgacgttaccgtaggtacctttattaacgacccttaactttaccgtacttacgtaacccgtaagtaccggtaccgtttaccggttccgttaccgttcgtaccgggtaccggttaccggacgggtaaccgggaacgtagggtaacgtaacgtaaccgtaaaccggtgtaccggcgtcgacgtctacccttagtcttacgttactccg

SEQ ID NO: 194027 - DNA, 756 bp, Homo sapiens
  misc_feature: GYAE6OF02ITYMW.21.32.C10.1.454.CMB.1.raw
tcagtcgtcgctcgcacgaccggtgctcgatttagtatagacatcaacacacaaaggggagtctcagtcaggacacagcatggacatgagggtcccgctcagctcctggggctcctgctactctggctccgaggtgccagatgtgacatccagatgaccagtctccactccctccctgtctgcactccagtaggagacagacgtccaccatctacgttggtcgggacaacgccgagacgactaacttaacctaaacttagtttagtaagtttaggttatacgtaacggtttaaaccgaacgggaaacctacccccgtaaactccgtagtactcttagtcgccgtacgacctacttaccttactttacgaacgtaagggttcggggttaccgtacgtaacgtaactaaacctttacgtacggtttcgggtaccggttaggtacgttcggtacgggtactacggttactttacctacgttacctacctaacctaactactacgtacgttacgtttacgtaccgtaaccgtacgtacgttacgtttacgttaccgttaacttaacttaccgttaccgtacgtacgtaccggttacgttaccgttaccgttcccgttcgttacgttaccggtaccggtaccggaactaaccggggggggggggggggggggggggggggtacgtaacggtaacgtaaccgtaacgtaacggtacggttacgtacgtacgtcgtaccgtacgttacgttacgttcgttacc

SEQ ID NO: 194028 - DNA, 634 bp, Homo sapiens
  misc_feature: GYAE6OF02GIOAJ.21.32.C10.1.454.CMB.1.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
  modified_base (616)..(616): a, c, t, g, unknown or other
  misc_feature (616)..(616): n is a, c, g, or t
tcagtcgtcgctcgcacgaccggtgctcgatttagtatagacatcaacacacaaaggggagtctcagtcaggacacagcatggacatgagggtcccgctcagctcctggggctcctgctactctggctccgaggtgccagatgtgacatccagatcgacccagtctccatcctcctgtctgcatccataggagacagngtcaccatcacttgcgganaagccagncataccaactattagattggtatctaagttaaaccaggtaacgtaccctaaactcctagtactctatcgactgctactcctactttgactaaaggtcgggtcctacgtacgactaaaccgttntacgttacgggcgttaggatcgtagggactagtactttcgacttcgtaccacgtacgtactacgtacttaggttacgacctaaaccgtgtaacgttatttaccggacttaaccgtttacctacgtttaccgtaacgtaaccgtaaggtccgttaccggtttcgtacccttacgtacgtaccggttacggaacggtaacgggtaaccgtacggtaacggtaacgtaacgaaacgttaacgtacggttcgaacgttcgaaccgttaaccncgtttatcgttactaccg

SEQ ID NO: 194029 - DNA, 795 bp, Homo sapiens
  misc_feature: GYAE6OF02HD2K7.21.32.C10.1.454.CMB.1.raw
tcagtcgtcgctcgcacgaccggtgctcgatttagtatagacatcaacacacaaaggggagtctcagtcaggacacagcatggacatgagggtccccgctcagctcctggggctcctgctactctggctccgaggtgccagatgtgacatccagatgacccagtctccatcctcctgtctagcatccataggagacagtagtccaccatcacttgcgggacaagccagagctattaccaacttatttgaatttggtactacgtaagtttaaaaccgaggggtaaaccgtaccccttaaaaccgtccctaggtacttaccttaagttggcctacggccacgttaccctaacgtttcgaaccgttaaagggttcggggtaccttcgaacggtaacctaaaactttcgtaagtttcgggtacccggttaggacgttaccgggtagggtaacctaaggttaccttttacctaaccttccttacccaaccgtactaccgtaacgtaccgttaggtttaccgaccttaaccgttaggtaaccgtttaagtttttccggaacccttaaacggtttaccttaacgttaccggtaaccctaaacggttccggtttaaccgtttaccgggttacccgtttacccgttaccggttaccggttaacccgggttcccggaaaccggtaaccggggtaaccgtaacggggtaacggtaaaccgtaaccgaaacccggttaacgtcggtaccgggtaaccgttaccggtaccctaacgtacccgtttacgtttccggttccttaacccgg

SEQ ID NO: 194030 - DNA, 585 bp, Homo sapiens
  misc_feature: GYAE6OF01BJASE.33.20.B09.1.454.CMB.1.raw
  modified_base (336)..(336): a, c, t, g, unknown or other
  misc_feature (336)..(336): n is a, c, g, or t
  modified_base (580)..(580): a, c, t, g, unknown or other
  misc_feature (580)..(580): n is a, c, g, or t
tcagtacacacactcacgaccggtgctcgatttagtgtagtgtgaagggtaaagggggtagggaactgctccagttaggacccagagggaaccatggaagccccagctcgacgcttctcttcctcctggcctactctggctcccaggggaagagcccaccctctcctgcagggccagtcagtagtgttagcggtacctagccctggtaccaacagagacctggccaggcctcccaggctcctcatccatggtcgcatccaccgaggccactggcatcccagaccaggttcagtggcagtcgggtcgtgggacacgacttcattctcacctatcgancagactggatccgtagaaggtagtttcgactagtgttattacgtgtcagtcgagtacggtagtcatctaccgtacgttcgccgaaggtacctaaggtacgaactacgaaacgtacgtgtacggctgactacgtattccgtgttcttactacttccttacccgactacttctacgtaacgttgtacgtcgtacgtcggacggtacgggcggtggaccgaacggtaccgtacgtagtacggcgtgngtacg

SEQ ID NO: 194031 - DNA, 598 bp, Homo sapiens
  misc_feature: GYAE6OF01AU5B0.33.20.B09.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (590)..(590): a, c, t, g, unknown or other
  misc_feature (590)..(590): n is a, c, g, or t
tcagtacacacactcacgaccggtgctcgatttagtgtagtgtgaagggtaaagggggaggaactgctcagttaggacccagagggaaccatggaagccccagctcagcttctcttcctcctgtctactctggctcccagataccaccggggaaattgtgttgacacagtctccagccaccctgtctttgtctccaggggaangccaccctctcctgcagggccagtcagactgttagcagcgcttcttagcctggtaccngcagaacctggccaggcctccgaggctcctctctatggtgcatccaccgacgggcccactggcctaactccccgagaaccgtaggttccacggtcggctaggtcggggtctgggacaggacttcacttctacacctatccgaactggtactcggacgcctagaacgtagtttcgcgtagttactttattacgtgtacagtactagtatacgtacgggtacgtacggttcggaccgtaacgggtaccgtaaggtacggtaatacgaaacgtacgtgtcggtacgtacgaccaccgacgtctcgttccttctacgttcccttcccgtcctntcgtacgg

SEQ ID NO: 194032 - DNA, 629 bp, Homo sapiens
  misc_feature: GYAE6OF01EMVK3.33.20.B09.1.454.CMB.1.raw
  modified_base (468)..(468): a, c, t, g, unknown or other
  misc_feature (468)..(468): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcacgtggaaccggcactaccgttggtgattatggctacgtctcctggtaccacaatacccagacagacgaccccccaattcttgatttttgatgtcacttatccggccctcgaggtacgtttctctacttcgttttctctggctccaagtctggcagtaccggccctcccgtgacctatccgtcgtgggcctcgaggtctcggacgacgaggtcttagtttacttctgtctgtctcaattactactattcagttagtntaacttctacgaaagttccggggaccggggtacctagtcggaccttacggacccgttacctaagtccacggaccccgtaaggtcccgtacccggtccccccgttcggttccctacccttccgttcccgttacccccgtccccttcccttcgtacggttcgg

SEQ ID NO: 194033 - DNA, 582 bp, Homo sapiens
  misc_feature: GYAE6OF01A4GVI.33.20.B09.1.454.CMB.1.raw
tcagtacacacactcacgaccggtgctcgatttagtgtagtgtgaagggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagacgccccccaactcttgtatttttgatgtctacttatcggccctcaggtagtttctcatcgtttctctgctccaagtctggcagtacggcctccctgaccatcctcgtcgggcctccgaggtcctggaccgacgaggtcgttagtttacttcgtgtctgctcatactactattcgtagtagtgatctacgtaaacgttcgggacgggggtacctagtcgtcgtcgaccgtctaacgtcacgcccgaacggtcgtccgccccgttcgtacctccttccgttccgttccccgccctcctcgtacggtcg

SEQ ID NO: 194034 - DNA, 569 bp, Homo sapiens
  misc_feature: GYAE6OF01A78XI.33.20.B09.1.454.CMB.1.raw
tcagtacacacactcacgaccggtgctcgatttagtgtagtgtgaagggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatccccctgcactggaaccggcactaccgttggtgattatggctacgtctcctggtaccgacaatacccagacagacgccccccaatcttgatttttgatgtcacttatcggccctcaggtagtttctcattcgttttctctggctccaagtctggcagtaccggcctccctgaccatcctcgtgggcctccgaggcctggacgacgaggtcttgtttacttctgctgctcattatactattcagttagtgtatctacgtaaacgttcggggaccgggggacctagtcgcgtcgacccgttctaagtccacgcccgaaggcctcgccccgtggtccacgttcctccgttccccaccctccctgtgtcg

SEQ ID NO: 194035 - DNA, 573 bp, Homo sapiens
  misc_feature: GYAE6OF01A7GGQ.33.20.B09.1.454.CMB.1.raw
tcagtacacacactcacgaccggtgctcgatttagtgtagtgtgaagggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagacgccccccaatcttgatttttgatgtcacttatccggccctcaggtagtttctctatcgttttctctggctccaagtctggcagtacggcctccctgaccatctctgggctccgaggctgacgacgagtctgtttacttctgtctgctcatatactattcagtagtgattcgtactaaagttccgggacgggggtacctagttcgcttcgacccgttactaagtccacgcccgaaggtcctccgcccccgtcggtcccaccttccgttccgttaccccacccttcctcgtcgttcgg

SEQ ID NO: 194036 - DNA, 637 bp, Homo sapiens
  misc_feature: GYAE6OF01CADTW.33.20.B09.1.454.CMB.1.raw
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
tcagtacacacactcacgaccggtgctcgatttagtgtagtgtgaagggggggtcgtcgggaggcagcgacccccgggacgtctccaccatggacctgggcctcgtgctaatcctcaccctcctcactcagggcacagggtcctgggcccagtctggccctgactcaacctgcctccggtgtctgggtctccgtggacagtcgatcaccatccccgtgcacgtggaaccggcactaccggttggtgatttagtcggcctacggtctaccgtggtaccgagaactacccagacagtcgcccccaattcttgnttttgatcgtctagttatcggcctgaggtagtttcncgattcgttctctggctcagtcngcagtcgctctnacntcngnggctcgagctgacgacgngtcttaggttcttacgngtactgactnattatacatttcgaggtagtagattacgtaacgtaaacggtttccggggacggggtaaccctagtaccgtcgtagtacccgtaccgttaaccggtcccgaaccggtaccccgaaagggtcctacccgggtacccccgttggggtaccctaacgttccgttacccggttaccccctaccccttaccgttacgtacggtttcgg

SEQ ID NO: 194037 - DNA, 770 bp, Homo sapiens
  misc_feature: GYAE6OF01C3B85.33.20.B09.1.454.CMB.1.raw
  modified_base (260)..(260): a, c, t, g, unknown or other
  misc_feature (260)..(260): n is a, c, g, or t
  modified_base (455)..(455): a, c, t, g, unknown or other
  misc_feature (455)..(455): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccgcactacgtggtgattatggctacgtctcgtggtaccganaactaccagacacgacgcccccaatcttgtactttttgatcgtctactttacgtccggcctcgtagtacgtttctctatttccgtttctcgttcggccttaccgaagtttccgtggcctaacggtaccggtcccttcccgtacggaccctacgttcctcggtcgggtcctccgaagggtctaggaacggtaacgnggtctttcgtttaccttcgtcgtcgtcgtactacctaattactaacttacttacgtaagttacgttaagtacttaccgttaaacggtaaacgggtttaccggggacccgggggggtaacctacgttcgggtacccgttaaccgggtaacccgttaaccggtaaaccggttaccgaaacccgggtaccccgtaaacggggtccccgttaccccggtaccccccgtttcccggggttaaccccttacccgttccccgtttaccccgttaccccccgtaacccccttttccccggttaaccgtcgggttttacccggg

SEQ ID NO: 194038 - DNA, 830 bp, Homo sapiens
  misc_feature: GYAE6OF01D0P0L.33.20.B09.1.454.CMB.1.raw
  modified_base (219)..(219): a, c, t, g, unknown or other
  misc_feature (219)..(219): n is a, c, g, or t
tcagtacacacactcacgaccggtgctcgatttagtgtagtgtgaaggggggggtctcgggaggggcagccgacccccgggacggtctccgaccagtggcctgggactctggctaatcctcacccctcctctactctaggcacgagggtcctgggcccagtctgcctgacctcgaacctgcctcgtgtcgtcgggtctcctggacacgtcgatccaccnctcccctgcgacgtacggaaccggcactaccgttgtgtattagtcggactaccgtctccgtaggtaccgtataactacccagacctacgaaccgacccccctaaattccgttagttacgttttcgacttcgtacctaaccgttaacgacccggtacccttacgtacgggtacccttttcctacctaacgtttcccgttttaccttaccgttacggcccgtttaacccgtaaacggttcccggtaccgggtacccgttaccggttaccccgggtaccccttacccgtacgtacccgtacgttcccggttacggtccggggtcccgttaccggaacgggtaccgttacggaaccgttacccgggtacggttacccttaaccggttttacctccgtacgtaccgtcgtaccctactaacgtacttacgtagttacgtaggtttacgtacgtaactttaccgttaacgtaacgggttccggggtaccgggtactagttcgtacgttaccgtaccgttaccgtacgtccgaccgtaccggtacgtccgtacccggtaccctgggtaccctccgtacccgttacccgttccccgtaaccgtccgtagtccgttacgg

SEQ ID NO: 194039 - DNA, 556 bp, Homo sapiens
  misc_feature: GYAE6OF01AFYW6.33.20.B09.1.454.CMB.1.raw
  modified_base (221)..(221): a, c, t, g, unknown or other
  misc_feature (221)..(221): n is a, c, g, or t
  modified_base (379)..(379): a, c, t, g, unknown or other
  misc_feature (379)..(379): n is a, c, g, or t
tcagtacacacactcacgaccggtgctcgatttagtgtagtgtgaagggggggtctcgggaggcagcgcccccgggacgtctccaccatggcctgggctctgctaatcctcaccctcctcactcagggcacagggtcctggcccagtctgccctgactcaacctgcctccgtgtctgggtctcctggacagtcgatcaccatcccctgcactggaaccggnactaccgttggtgattatggctacgtctcctggtaccgacaataccccagacagacgccccccaatcttgatttttgatgtcactttatccggccctcaggagttttcctcattcgttttctctggctccaagtctggcagtacggcctccctgaccntctctgggctccaggctgacgacgaggctgtttactctgctgctcatatactattcagttagtgatctactaaagttcgggcgggggtaccagtgccttagacccgtactaagtccacgcccaaggctcgcccccgtcggtcctacgtctcgttaccccacccctcctcgagttcgg

SEQ ID NO: 194040 - DNA, 634 bp, Homo sapiens
  misc_feature: GYAE6OF01DBBFK.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcagtcaccatctcctgcactggaaccagcagtgactagtttggtggttactcgaccgttgtcctcctggtaaccaacaaccacccaggcacacgaccccaaactcactactttatgtagtcactaacgccggcctcgacgggtccctgactcgtcttctctcggctaccgaagtcgtggcacgccgaccggtcctccctacgacctactccgtcgtcgggtcctccgagggtcgtacggacgggacggtacggtctttagttttacttacgtcgtccgttacgtacccgttatacctacttcgacgcacgtctcgtcgtacgtacgttcgggacggtacgggtaacgacggtcgtaccgttagtacgtccgacgacccgtaggtccgtcccggtccccgtcggtccctccgtccttcccgttcccctcccgtcctaccgg

SEQ ID NO: 194041 - DNA, 662 bp, Homo sapiens
  misc_feature: GYAE6OF01CZPIA.33.20.B09.1.454.CMB.1.raw
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccacaatacccagacagacgcccccaatcttgatttttgatgtcacttatcggccctnaggtagtttcncattcgtttctctggctcaagtctggcagtaccggccttccctgacctatcctcgtcgggctccgaggtctggacgtacggaggtcttgttttaccttctgtctgctacatatactatttcagttacgtgtactctacgtaaacggtttccggggaccgggggtacctagtcggtaccgttacggtacccgttaaccgtaacggttaccaacccgggaccccgtaaagggtccccgttacccggtaccccccccgtttcgggttaccccgttaccgttccccgtttcccggtttaccccccctacccctttaccccgtccgttaacggtttcggg

SEQ ID NO: 194042 - DNA, 573 bp, Homo sapiens
  misc_feature: GYAE6OF01DL9QO.33.20.B09.1.454.CMB.1.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (447)..(447): a, c, t, g, unknown or other
  misc_feature (447)..(447): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccgcactaccgtggtgattatggctacgtctcctggtaaccgacaatacccagacaagaccgccccccaaactcctttgtatttttgatgtctacttatcggccctnaggtagtttctcattcgtttctntgctccaagtctggcagtacggcctcctgaccatctctcggctccaggctgacgacgagtcttgtttactctgctgctacatatactattcagttagtntacttctacgaaacgtttcggggacggggtacagtcgtactcgacgtcctaagtcacgaccacggtcctccgaccccgtcggtcctaccgtccgttccttaccccctacccttcctccgtgttcgg

SEQ ID NO: 194043 - DNA, 709 bp, Homo sapiens
  misc_feature: GYAE6OF01ER7VE.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctcgtgtctgggtctcctggacagtcgatcaccactcccctgcactcggaaccggcactaccgttggtgtattagtggctacgtctccgtggtaccgacaactacccagacacgaccgccccccaaacttctttgtatttttggattgtctaccttagtccggcccctgtacgggtagttttctctacttcgttttcttctggtccttacctaagtctcggtctacggtaccgccctcctagaccctactccttcggtcggtcctccgtggccgtagtaaccggacggtcggtcgtttcgtttaaccgtttctcggtccttggtccttactacttaattacctactttcgtaagttagttgaacttctaacgtaaccggttaccggggacggggggtacctagttcggtacgttaccggtaccgttacccgtaacgtcccgaaccggaacccgtaccggtccgttaccccggtcccccgttccggttaccctaccgttcccttacccgttccccctaccccgtcccttacgtcggttacgg

SEQ ID NO: 194044 - DNA, 671 bp, Homo sapiens
  misc_feature: GYAE6OF01A9X5I.33.20.B09.1.454.CMB.1.raw
  modified_base (262)..(262): a, c, t, g, unknown or other
  misc_feature (262)..(262): n is a, c, g, or t
tcagtacacacactcacgaccggtgctcgatttagtgtagtgtgaaggggatggtgatcgactgtccaggagacccagacacggaggcagcgcccccgggacgtctccaccatggcctgggctctgctaatcctcaccctcctcactcagggcacagggtcctgggcccagtctgccctgactcaacctgcctccgtgtctgggtctcctggacagtcgatccaccactcccctgcacgtcggaaccggcactacgttggtntattagtggctacgtctccgtaggtaccgacaactacccagacacgaccgaccccctaattccgttgttactttttgacttcgtacctactttacgtccggtccctcgtacggtacttttcctacttacgtttccgtttctcgtcggtcctacctaagtcgtacggacgtacggtacccgtccctccctacgtacctacttccgtcggtcggtcctacccgacggtcgtacggaccggtacggtacggttcgtttcgttttacctcgtcgtcgtacgtctactaagttactacttagttacgtagttacgtatacgtactacgtaacgggttccggggaccggggtactagtcggtccgtaccgtaccgttacgtacgtacgacccgaccggtaccgtcccgtccccgg

SEQ ID NO: 194045 - DNA, 800 bp, Homo sapiens
  misc_feature: GYAE6OF01C9GQ6.33.20.B09.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagtacacacactcacgaccggtgctcgatttagtgtagtgtgaagggggggtctcaggaggcagcgctctcaggacgtcaccaccatggcctggctctgctcctcctcaccctcctcactcagggcacagggtcctgggcccagtctgccctgactcagccctccctccgcgtccgggtctcctggacagtcagtcgcatcctcctgcactggaaccngccgtgacgttggngttanaagtntgtctctagtaccaacngcaccagcaaacgcccaaactctgattangtaggtcagtgagccgccctcgacgggtccctgacgtcgccttcgtcgtggtcctaccgtaagtccgtacggaccgtaaaccgacccggtacccgtccccgtacgaccctaacgttcccgtttcggtacggggtacccttccggaacgggtccgtcgggtaaagggtaacggtcgggtaacgggttacctaagggttaactttttaacgtttaaccgttacggtaacctacggttaaccttaccgggtaattaccgggaccggtaacggggaccgttaaaccggtaaaacgtttaaagggtttttaaaccgggggtgggtttaaccgggggaccgggtacgggtaaacgtaaccgggggttaacccggacccggtttaaccgtaaacggtacccgggtaaccggtaaccccggttaaaccggtccccggttccccgggtacccccccggttaccgggttaccgtaacccgttttcccggtcccggtttaacccccccttaaccccccggg

SEQ ID NO: 194046 - DNA, 910 bp, Homo sapiens
  misc_feature: GYAE6OF01DIBR2.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcgagggcacgacggggtcctgggccccaggttcctcgcccttagacttaccaacccttgcccgtccggttgtcgttcgggtccttaccgtggaactggttccggtaccacctagttcctccgtcggccgtcgtacggaacctaggttacgtcggtaacggttgggaacgtccttaagtcgaactttagtccgttcgtaccgtacggtaaacccaaacaaccgtaccgtacggaaccgaaaccgtaccccttaatttacgttagttactttcgtacgtacgttacgtacttaaccgtaaccgtccggtaccgttacggttacggttcctacgtcgtcgtcttcgtcgtcgtacctaccgtacgtcgtcgtacacggtcccgtaccgtaccctaccgtaccgtaccgttacgtcccgttacggtccggtaccgtacggtacggtacggtacggtaacgggtacggttcgttacgtttacgtttacgtcgttacgttaccgtacccgttaccgttaacgtaccgttaacgtaccgtacggtaccgtacgttacccgttacgttacgttaacccgggttaaccgggtaccggggtaaccggggtaaccggtaacccggtttaaccgggttacccgttaaccggtttaaccgttaaccggtacccggtaaccggtacccggtaaccgggttaccccggtacccccggttaccccggttaccgttaccccgttacccggttccccgtttacccccgttacccccgttacccggttacccgttcggtaaccgg

SEQ ID NO: 194047 - DNA, 546 bp, Homo sapiens
  misc_feature: GYAE6OF02I81N8.33.20.B09.1.454.CMB.1.raw
tcagtacacacactcacgaccggtgctcgatttagtgtagtgtgaagggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagacgccccccaactcttgatttttgatgtctacttatcggccctcaggggtttctcatcgcttctctgctccaagtctggcagcacgcctccctgaccatctctcgggctccgaggctgaggacgaggtcttgtttacttactgctgcccgttatactattcagcagtctctctacgaattcgggcggacgggactaaggtcgaccgtacttaagcagacccaggcctccgccccgttgtcctactctcgttccccacctcctctagtgtcg

SEQ ID NO: 194048 - DNA, 601 bp, Homo sapiens
  misc_feature: GYAE6OF02HDJOU.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagacgcccccaatcttgattttgatgtcacttatcggccctcaggtagtttctcattcgtttctctggctcagtctggcagtacggcctccctgaccatctcgtcgggctccgaggcctggacgacgaggtcttgtttacttctgctgctctatatactattcagtagtgtatctacaaagttcgggaccgggggacagtcgcgttcggacccgttaccgttaacgtccgacgacccgaacggtcccttccggccccccgttacggttaccctaccgttccgttacccggttcccccgtccccgtttcccgttaccgtacggttcgg

SEQ ID NO: 194049 - DNA, 587 bp, Homo sapiens
  misc_feature: GYAE6OF02ISD51.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaactacccagacagacgccccccaatcttgtatttttgattgtcactttatccggccctcgaggtagttttcctctacttccgttttctctggtcctccaagttctggctagtaccggcctcccgtgacctattctcgtgggctcgagctgacgacgaggtcttgtttacttctgtctgctctatatactattcagttagtgtatctactaagttcgggacggggactagtgtcgtacgacccgttacgtagtacacgacctaacggcctccgccccgtcgtcctaccgttccgttccgttccccgtccctccgtccagttcgg

SEQ ID NO: 194050 - DNA, 551 bp, Homo sapiens
  misc_feature: GYAE6OF02H1FBC.33.20.B09.1.454.CMB.1.raw
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagacgccccccaatcttgattttgatgtcacttatcggccctcaggtagtttctctatcgtttctctggctccaagtctgcagtacgcctcctgaccatctcgtggctccgaggtctgacgacgagctgtttacttctgctgctcatatactattcagtagtgatctactaaacgttcgggacggggacctagtcgctcgaccgtactaagtccacgcccaaggcctccgtccccgtcgtactaccgttctccgttccccacccgtcctcagttcgg

SEQ ID NO: 194051 - DNA, 716 bp, Homo sapiens
  misc_feature: GYAE6OF02IKTIY.33.20.B09.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtacacacactcacgaccggtgctcgatttagtgtagtgtgaaggggggggtctcgggaggcagcgcccccgggacgtctccaccatggcctgggctctgctcctcctcaccctcctcactcagggcacagggtcctgggcccagtctgcccctgactcagccctccctccgcgtccgggtctcctggacagtcagtcgccatctcctgcactggaaccngccgtgacgttggtggttataagtntgtctcctggtaccaacagccacccaggacaaacgcccccaaatcttgatttatgagtcactgacggccggcctcgacgggtccctgactcgtcttctctggctaccgagtctggacacacggcctccctgaccctatctcgtcggtcctaccgaggtcctaggaggtactggaaggtcttaggtaactttagttccgtgacctacgtcgttacggttactgggacgacgggtcggtaaccgtaaaacgttaaacgggtttttaaacggggttcggtttaccgggggacgggtaacggggtaacccggtaaacgggttaccggtaaccccggttaacccgtaaaggttacccgaccgggtaacccggaacgggtcccggttaccccggcccccgtttacggtacccaacccggtttcccgttacccggttccccccgtacccgtttaccccgttcgtacggtttacgg

SEQ ID NO: 194052 - DNA, 629 bp, Homo sapiens
  misc_feature: GYAE6OF02FJ6QT.33.20.B09.1.454.CMB.1.raw
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctgggcccagtctgccctgactcaacctgcctccgcgtccgggtctcctggacagtcagtcgccatctcctgcactggaaccngccgtgacgttggtggttataagtatgtctcctggtaccaangcacccaggcaaacgccccaaatcttgatttangagtcactgagcggcctcgacgggtcccngactcgtcttctctcggctaccagtctggctaacgacggcctccgtgaccatctcgtcgggctccgaggtctaggagtacgtggaggtctaggtaactttagttacgtcgctacgtccttacgtagtcgtacgagggccgactaaacgtaaggtttttaacggggtcggttacgggacgggtaacggggtaacctaagggtcgtaccgtacgttaagaccgtacgacccgaaggtccctccgtacccccgtacggtacctaccgttccggttacgttcccccgtccttcctacgtacggttcgg

SEQ ID NO: 194053 - DNA, 730 bp, Homo sapiens
  misc_feature: GYAE6OF02G111M.33.20.B09.1.454.CMB.1.raw
  modified_base (266)..(266): a, c, t, g, unknown or other
  misc_feature (266)..(266): n is a, c, g, or t
tcagtacacacactcacgaccggtgctcgatttagtgtagtgtgaaggggggggtctcgggaggcagcgcccccgggacgtctccaccatggcctgggctctgctaatcctcaccctcctcactcagggcacagggtcctggcccagtctgccctgactcaacctgcctccgtgtctgggtctcctggacagtcgatcaccactcccctgcacgtcggaaccggcactaccgttggtgtattatggctacgtctcctggtaccganaactaccagacagaccgcccccctaatcttagtattttgatcgtacacttatccggcctcgaggtactttctctacttccggtttcctcgtcggtacccttaccgtaacgttccgtagggtaccgtaccggttacccggtccccttccccgtacgaaccctacgttcgtaccgtcgggtcctacccggaggtccgtacgaccggtacggacgttccgtttacgtttaaccgttcgtcgtcgtcgtaccttacgtaacttactacttattacgtagttagtacgtactaccgtaaacgtaagggttaccggggtaccggggtaacctaggttccggtaccgtacggtacccggttaaccgtacgtaccgaccggtaaccgacggtcccgtacccggtccccgttcggtaccctaccgttcccggttacccgttacccccgtccctaccttccggttagttccggg

SEQ ID NO: 194054 - DNA, 1117 bp, Homo sapiens
  misc_feature: GYAE6OF02ISKHF.33.20.B09.1.454.CMB.1.raw
tcagtacacacactcacgaccggtgctcgatttagtgtagtgtgaaggggggggtcgtcgggaggcagcgcccccgggaccgtctccaccatggcctgggctctgctaatcctcaccctcctcacctcagggcacagggtcctgggcccagtctgccctcgactcaacctcgcctccgtgtcgtgggtcctccgtggaccagtcgactcaccactcccctgcaccgtacggaacccggctaccgttaccggttggtagtaacgttactcggtaccgttaccgtccttacccgtacgggtacccgaaccgtaaactaaccccgtaagaaccgaacgaacccggtaccccccctaaaaccgttccgtttaggttaactttttaggtacttacgttaccgtaaccgttttaccgtacccggggtccccttacggtaacggttcgttttacctacgtaacgtttaccgttttccgttacgttccgggtacttacccgtaagttccgtacgggacgtacggtacccggacccttccccgtaacgtaacccgttacgttacccgttccggtaccgggtacccttaccccggtaaggggtcccgtttaacccggggaaaccccgggtacggggttaaaccccgggtttccgttttacccggtttttaaaccccgggttttccgtaacccggggtttcccgttacgggttcccccttaaacggtaaacgttttaaaacccgttttaacccgttaaacgtttttaaaccggtaacgggtttaacggttaaaccgttaacccgttttaaccgtaaaacccggtttaaaaccgggggtttacccccgggggggttaaacccggggggtaacccttaaacggggtttcccgtaaccggtttaaccgggtaaaccccccggttttaaacccgggttaaacccgggtaacccggtaaaccggtaccccccgggttaaagggtccccccgggtttaaacccccgttaccccccggggtaaccggtttacccccggttaacccccgtttttaaccccgggtttacccccgttaaccccccccgtttaacccccggtacccgtttacccgggttaccccgggtttttaacgggg

SEQ ID NO: 194055 - DNA, 613 bp, Homo sapiens
  misc_feature: GYAE6OF01EZSBO.42.71.G05.1.454.CMB.1.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
tcagtgacgtatgtcacgaccggtgctcgatttagtgtcgtcgcaagagagaggggggagccccagccctgggactcccagctgtttctgcttgctgatcaggactgcacacagagaactcaccatggagtttgggctgagctgggttttccttgttgctcttttaaaaggtgtcgaatgtgaggtgcagctgggtggaggtccgggggaggtcttagttcaggccgtggggggtccctgagactctcctgtgcagcctntggattccaccttcagtagtaattggatgcacgtgggtccncaagcctccgaggggagggctgggtgtgggtctcgagtcttgttagttggtgagtagggaataacacgaaggagtacggggactcggtaggaacgggccgtatcagcatctaccagacgaacaaccgaccaaagaactacgttagatcgtaaggaaatgaaacaagtcgtagggacgaccgaaggaccgacgggtcttggttacttagtttacgtaggttaagtaaaacgtgtaccggtgggtcgttaacgttaggtttcgtttagacgttacggtcggggtacgaacgggtacccgttggtcccgtacccg

SEQ ID NO: 194056 - DNA, 967 bp, Homo sapiens
  misc_feature: GYAE6OF01D4RJF.42.71.G05.1.454.CMB.1.raw
tcagtgacgtatgtcacgaccggtgctcgatttagtgtcgtcgcaagagagaggggggagccccagccctgggactcccagctgtttctgcttgctgatcaggactgcacacagagaactcaccatggaggtttgggctgagtcgttgggtttttccttgttgtctttacgtttttaaaagggtgtacggtaatggtggaggtcgcgaggcgtgggtgggacgggtccggggggaggtcgtttagttccgacggtcccggttcgggggggttccctaggacgtaccttccgtccgttggtcgccgacgtcccgttcgtacggtactttcctacccctttgtaaggttaagttaaagtttcggaattcggacctaccggttccggggtaccccgacccgaaacggtcccgttacccgggaaggggggaacgggggtccgttggggttcgggttcgggttaccgtcgaacgggttcgtttagggtttttaagtttcggggtacgtaaggttacggggtaaacgttaaaaccgaaacggtaaaacgggtaacgggtttaacccgggggtaaccgttaccggggtaagggaaaccggggtccgtaacgtttacgacgtactacgttcccgtaccgaaggaacgtaaccgaaaccggtaaccccgaaaaggtaaaccttacgggtttaagtaacgttccggtaaaggtaaaaacttacggaaaccttaacggttccgggtacggggaaccgacccgggaacgggtaacccggtacccgggttacgttcggttttaacccgtttaagtttttaccggtaagggttaaaacgttaaaaacggtcggtttaccgggtcggggggtttaacccgttagggtttacgggttttacggtttacggtaacggtttacccgggtacggggggtttacccgaaaccgggtttaccccggttggtacccccgtttaccccgg

SEQ ID NO: 194057 - DNA, 823 bp, Homo sapiens
  misc_feature: GYAE6OF01DNO0B.42.71.G05.1.454.CMB.1.raw
tcagtgacgtatgtcacgaccggtgctcgatttagtgtcgtcgcaagagagaggggggagccccagccctgggactcccagctgtttctgcttgctgatcaggactgcaccacagagaacctcaccagtggtaggtttgggctgagtcgttgggtttttccttgttgtactttacgttttaaaaggtcgtacgtaattggtggtaggtgacgaggtcgtggggttgggacgggttccggggggaggttcctttacggttccgtacgggtcccgggttcgggggggttccccctaggtacgtaccttccgttcccgtggtcgccgacggtcccttcgtggtactttccgtaaccttacgtaaggttaagttaagttcggatcggaccgtacggtccgggtaccccacgaacgtccgacggggaaggggacgggtcggtggtggtcgggtctacgtggttgttaggtttagtgggtagtacggttagggaacttaaaccgaaggaacggtacggtaccgggtaccttcggacggtacgggcctagtacgacgtctacgtacctacgacgaaacgaccaaacggaccctaaaggtaacgttaggttacttaagtcgtaaaggtaacctaggtaaacctagttccgggaagggaccgaaccggaacgggaccgtacgttcccgtttagtttaaccgtttgtttaacggtaaggttaaacggaacggttgtccgggttagggacccggttttaagtcgggttttaacggttccgtacggtaacggggtttccggggaccaaccggggttccttcggccccttacccgg

SEQ ID NO: 194058 - DNA, 669 bp, Homo sapiens
  misc_feature: GYAE6OF01AZ8M0.42.71.G05.1.454.CMB.1.raw
  modified_base (301)..(301): a, c, t, g, unknown or other
  misc_feature (301)..(301): n is a, c, g, or t
tcagtgacgtatgtcacgaccggtgctcgatttagtgtcgtcgcaagagagaggggggagccccagccctgggactcccagctgtttctgcttgctgatcaggactgcacacagagaactcaccatggagtttgggctgagctgggttttccttgttgcttcttttaaaaggtgtcgaatgtgaggtgcagctggtggaggtccgggggagcttagttcagccgtggggggtccctgagactctccgtgtcgcagcctcgtggattccaccttcagtagtaattggatgcacgtgggtccnccaagcctaccgaggggaagggcgtgggtggtgggtctcgaggtcttggttattgggtgagtagggagtaaacgacgaaggagtaccggggactccggtaggaacgggtccgtattcgagactacgtcctaccgagaacgaaccaaccgacccaaagtaaccgtacgttagtaactcggtaaggtaaactagaaactagtcggtagggacgtaccggaggaaccgtcggtcgttcgtactttagttacgtaggtaaagtaaaacgtcgttacggtacggggtcggttaacgtagggttttcggttacgtaacggttacggtacggggtaccgtaaccggggtaacccggttcggtacccgtaccccgg

SEQ ID NO: 194059 - DNA, 552 bp, Homo sapiens
  misc_feature: GYAE6OF02HB6A2.42.71.G05.1.454.CMB.1.raw
  modified_base (443)..(443): a, c, t, g, unknown or other
  misc_feature (443)..(443): n is a, c, g, or t
  modified_base (481)..(481): a, c, t, g, unknown or other
  misc_feature (481)..(481): n is a, c, g, or t
tcagtgacgtatgtcacgaccggtgctcgatttagtgtcgtcgcaagagagaggggggagccccagccctgggactcccagctgtttctgcttgctgatcaggactgcacacagagaactcaccatggagtttgggctgagcgtgggttttcctgttgctcttttaaaaggtgtcgaatgtgaggtgcagctggtggagtccgggggaggcttagttcagcctggggggtccctgagactctcctgtgcagcctctggattcaccttcagtagtaattggatgcactgggtccgccaagctccaggggaaggggctgggtgtgggtctcagctgttattggtgatgggagtaacacaagatacgggactccgtgaagggccgattcagcatctccagagacaacgccaaagacacgttgatcgtagaatgaacatcagggacncgaggacacggctgtcttatttcgtagttagtaaagtntcgtaggggcggtaactagggttacgtttagacttacggtcgggtacacggggtaaccctggtctacccgg

SEQ ID NO: 194060 - DNA, 162 bp, Homo sapiens
  misc_feature: GYAE6OF01CP6EE.49.22.B11.1.454.CMB.1.raw
  modified_base (162)..(162): a, c, t, g, unknown or other
  misc_feature (162)..(162): n is a, c, g, or t
tcagagtcgagagacacgaccggtgctcgatttagacgacagctcagggcacgaccggtgctcgatttagtcacgcgagaaggggaaggggctggccctgacgtgtttctgttcccgcctcatctctcacgactgtgaggcggtctggacgaggcatagtgn

SEQ ID NO: 194061 - DNA, 164 bp, Homo sapiens
  misc_feature: GYAE6OF01C0TMQ.49.22.B11.1.454.CMB.1.raw
  modified_base (161)..(164): a, c, t, g, unknown or other
  misc_feature (161)..(164): n is a, c, g, or t
tcagagtcgagagacacgaccggtgctcgatttagacgacagctcagggcacgaccggtgctcgatttagtcacgcgagaaggggaaaggggctggccctgacgtgtttctgttcccacctcctctctctcgactctgagcgggctggcaaggcgcatagnnnn

SEQ ID NO: 194062 - DNA, 163 bp, Homo sapiens
  misc_feature: GYAE6OF01D2UJ8.49.22.B11.1.454.CMB.1.raw
  modified_base (162)..(163): a, c, t, g, unknown or other
  misc_feature (162)..(163): n is a, c, g, or t
tcagagtcgagagacacgaccggtgctcgatttagacgacagctcagggcacgaccggtgctcgatttagtcacgcgagaaggggaaaggggctggccctgacgtgtttctgttcccaccctcctctctctcgactctgagcgggctggcaaggcgcatagnn

SEQ ID NO: 194063 - DNA, 128 bp, Homo sapiens
  misc_feature: GYAE6OF01B77NY.49.22.B11.1.454.CMB.1.raw
  modified_base (128)..(128): a, c, t, g, unknown or other
  misc_feature (128)..(128): n is a, c, g, or t
tcagagtcgagagacacgaccggtgctcgatttagacgacagctcagggcacgaccggtgctcgatttagtcactctgttcccgccctcctctctctcgactctgagcgggctggcaaggcgcatagn

SEQ ID NO: 194064 - DNA, 164 bp, Homo sapiens
  misc_feature: GYAE6OF01ECVXQ.49.22.B11.1.454.CMB.1.raw
  modified_base (163)..(164): a, c, t, g, unknown or other
  misc_feature (163)..(164): n is a, c, g, or t
tcagagtcgagagacacgaccggtgctcgatttagacgacagctcagggcacgaccggtgctcgatttagtcacgcgagaaggggaaagggggctggccctgacgtgtttctgttcccaccctcctctctctcgactctgagcgggctggcaaggcgcatagnn

SEQ ID NO: 194065 - DNA, 163 bp, Homo sapiens
  misc_feature: GYAE6OF01D5KVX.49.22.B11.1.454.CMB.1.raw
  modified_base (163)..(163): a, c, t, g, unknown or other
  misc_feature (163)..(163): n is a, c, g, or t
tcagagtcgagagacacgaccggtgctcgatttagacgacagctcagggcacgaccggtgctcgatttagtcacgcgagaaggggaaagggggctggccctgacgtgtttctgttcccgccctcctctctctcgactctgagcgggctggcaaggcgcatagn

SEQ ID NO: 194066 - DNA, 163 bp, Homo sapiens
  misc_feature: GYAE6OF01CBXNI.49.22.B11.1.454.CMB.1.raw
  modified_base (160)..(163): a, c, t, g, unknown or other
  misc_feature (160)..(163): n is a, c, g, or t
tcagagtcgagagacacgaccggtgctcgatttagacgacagctcaggcacgaccggtgctcgatttagtcacgcgagaaggggaaggggctggccctgacgtgtttctgttcccgccctcctctctctcgactctgagcgggctggcaaggcgcatagnnnn

SEQ ID NO: 194067 - DNA, 161 bp, Homo sapiens
  misc_feature: GYAE6OF02INS4Y.49.22.B11.1.454.CMB.1.raw
  modified_base (161)..(161): a, c, t, g, unknown or other
  misc_feature (161)..(161): n is a, c, g, or t
tcagagtcgagagacacgaccggtgctcgatttagacgacagctcagggcacgaccggtgctcgatttagtcacgcgagaaggggaaaggggctggccctgacgtgttctgttcccgccctcctctctctcgactctgagcgggctggcaaggcgcatagn

SEQ ID NO: 194068 - DNA, 163 bp, Homo sapiens
  misc_feature: GYAE6OF02FWL9O.49.22.B11.1.454.CMB.1.raw
  modified_base (163)..(163): a, c, t, g, unknown or other
  misc_feature (163)..(163): n is a, c, g, or t
tcagagtcgagagacacgaccggtgctcgatttagacgacagctcagggcacgaccggtgctcgatttagtcacgcgagaaggggaaagggggctggccctgacgtgtttctgttcccaccctcctctctctcgactctgagcgggctggcaaggcgcatagn

SEQ ID NO: 194069 - DNA, 163 bp, Homo sapiens; identical to SEQ ID NO: 194062
  misc_feature: GYAE6OF02IYTDK.49.22.B11.1.454.CMB.1.raw
  modified_base (162)..(163): a, c, t, g, unknown or other
  misc_feature (162)..(163): n is a, c, g, or t

SEQ ID NO: 194070 - DNA, 509 bp, Homo sapiens
  misc_feature: GYAE6OF01AYH62.9.19.B08.1.454.CMB.1.raw
  modified_base (442)..(442): a, c, t, g, unknown or other
  misc_feature (442)..(442): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacacgcccccagggtcctcatctttggttacagtaatcggccctcaggggtccctgaccgattctctggctccaagtctgacacctcacgcctccctggcccatcactgggctccagactgagatgaggctcattattactgccagtcttangtactaaacgtcagaactgtttgggtgttcgggcggacgggacctaagcgtagacccgtctcgtacg

SEQ ID NO: 194071 - DNA, 778 bp, Homo sapiens
  misc_feature: GYAE6OF01CXAOP.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcttcctcactctcctcgctcactgcacagggtcctgggcccagtctgtgctgacgcacgcccgccctcagtcgtcgtcggggccccagggcaggacgggtcaccatcctcctgcacgtggcacgcacgttaccaacgacgtcggggactaaggttatgatcgtaccacgttacggtaaccgagacctacgtttaccgaacggaaccaccggcccccgtaacgggttcccttacgtacgtttcgtttttacgggttaaccgtaaggttaaaccgttccggtaccccgttaccggtaaccgggggttccccttacgggaaacccgttacgtttccgttccgttacgggtacccttacccgtaaacggttcccgtaaccggtaaccctacccgttaccgaaccgttcccccgttccccggtaccgggtacccctaacgttacccgaacccggtttaccggggtacccttacccggtaaggtaccgttagggaacggtacgtacgggaccggtaccttaacgtaactttaacgttaccgtaccgtacctacgttacgttatacgtaaactaaccgacgtaacgtaacgttagggttaggttacggtacggacgggtaacggaaccgtaacggtccgtaccgtacccgttcgtcgtaaccgg

SEQ ID NO: 194072 - DNA, 641 bp, Homo sapiens
  misc_feature: GYAE6OF01ALEZE.9.19.B08.1.454.CMB.1.raw
tcagtgatacgtctcacgaccggtgctcgatttagtgagtcagtaaggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggcccccagggcagagggtcaccatctcctgcactggcagcagttccaacatcggggcaggttatgatgtccactggtaccagcagtttccaggaacagccccagggtcctcatctttggttacagtaactcggccctcgaggggtccctgaccgtacttctctggcctccaagtcctgaccacctcacgccctccctcggccctatccgaccttaggggccctacccgacgtactagggaggacttggacgggtccttcgtaacttttacgttaaccttcggtacctaacggtttccctttaacgtacgtaaacctaaaccggttacccgtaaaggtaaccccgttaaggttttcgggggttacggtttaccggggaccggggtaacggggttaaccccgaagggtacccttcgggtaacccccggttcccgttaccggaaccgg

SEQ ID NO: 194073 - DNA, 605 bp, Homo sapiens
  misc_feature: GYAE6OF01D4I15.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcacgcccgccctcagtgtccgtcggggcccccaggggcaggacgggtccaccatcctcctgccacgtggcagcagttaccaacagtcggggctaggttatgatgtccacttcggtaccagctagtttccaggaacaccgccccgagggttccctctaatcttttacggttacagttaactcggccctcgacggggtccctgaccgtacttctcgtcgcctctaacgtctacgaccacctcacgtccctccgtcggccctatccacgtcggcctcccgagacgtggacggagtgacggtctactactttacttacgtcgacctagttcttacgtacgtaaacctaaacgtacaaggtaactggttttacgggttggttccgggacgggtacgggaaccgtaacgtacgtacgacccgtccgtcgtaccgg

SEQ ID NO: 194074 - DNA, 681 bp, Homo sapiens
  misc_feature: GYAE6OF01BJHE8.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacagtcggggctaggttatgatgtccactggtaccagcagtttccaggacacgccccgaggtcctcatctttggttacagtaactcggccctcgacggggtccctgaccgtattctcgtcggcctaccgtaacgtctacgacctacctcacgtcccctcccgtcggccctacgtcctaaccgtcgggtcctcccgaacggtacgtacggacgggtactcgggacggtccttacgttaacgttttaacgtttacccgttcggtacccgttacggtttacctttaacgttacggtaaaccgtaaaaccggttacgtaaacggttaaaccggttacggtttttacgggggttacgggtttaccgggggaccggggtaaacggggaacccgtaacggtaccggtttaccgggtaaccccggttcccgtaccggtaacccggg

SEQ ID NO: 194075 - DNA, 875 bp, Homo sapiens
  misc_feature: GYAE6OF01BN2QF.9.19.B08.1.454.CMB.1.raw
  modified_base (190)..(190): a, c, t, g, unknown or other
  misc_feature (190)..(190): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacgagggtcctgggcccagtctgtgctggacgcacgcccgcctnagtgtcgtcggggcccagggcaggacgggtccaccacttcctcctgcacgtggcacgctacgttccaaacgcggtcggggctaggttatggtatgtccacgtcggtaccagtactagttaccgaacggtaaccaccggccccgtagggtcctacgtacgtttcgtttacgttaacgacgttaacgtcccggtcccgtacgggtaccggggttcccgtacgtacccgttacgtttaccgtcggtacggtacccttaccgtaaacggttccgtaccgttaaccccgtacccgttaacccggtcccgttcccccgtaccccggttaccgaccctaccgttaccggtaaacccgggttccgggaccccgtttaccggaacggtcccggttaaggggaccggttaaggtccgggttaccggtaccttaacgtttaaccgttttaccgtttaacccgtaccggtttaacccggttaacgtttacccgttaaacggttaaccggtaaaacccgttaaaccggtaaacggttaaaaccggtttaaccgggtttacggggtttttaccggggggtaccgggtttaaccccgggggtaaccggggttaaacccgggtaaacccgggtaaccggggttaacccggttacccccgggtttaaaccccggttcccgggttaacccgtaaaccccgggg

SEQ ID NO: 194076 - DNA, 735 bp, Homo sapiens
  misc_feature: GYAE6OF01DQJ47.9.19.B08.1.454.CMB.1.raw
  modified_base (149)..(149): a, c, t, g, unknown or other
  misc_feature (149)..(149): n is a, c, g, or t
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
tcagtgatacgtctcacgaccggtgctcgatttagtgagtcagtaagggggagctctgcttcagctgtgggcacaagaggcagtactcaggacaatctccagcatgccctggtctcctctcctcctcactctcctcgctcactgcacgngggtcctgggcccagtctgtgcngacgcacgcccgtcctcnggtcgtcgcggggccccagggcaggaggtcaccatcctcctgcacgtggccagtccacgttaccaacgacggttccggggacgtaaggttataggtacttcgtccgtacgtacggtaccaacgtcgtacgttaccgaacggaaccaccggtcccgtacggtcctactacgtttcgtttacggtaactacgtaacgtccgtcccgtacgggtacgggtccctacgaccgttacgttctcgttcgtacctacgtaacgtctacgacctacctacgaccgtccctccgtcgtcctactccgtacgtccggtactaccgtacgacgtacggaggtacgtaggtaccgtacttaacgttacgtttaacttaccgttcgtaaccgttaaccgtttacgtaaccgttaaccgtaaaaccgttaacggtaaaccgtaaaggttaaccggttttacgggttttacgggggttaccggtttccggggaaaccggggtaaccggaaaccggtacggtacccggttacccgttacccggtccctacggtaaacccgg

SEQ ID NO: 194077 - DNA, 755 bp, Homo sapiens
  misc_feature: GYAE6OF01AXOS2.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacagtcggggcaggttatgatgtccactggtaccagcagtttccaggaacacgccccaggtcctcattctttggtacagtaatccggcctcgaggggtccctgacccgtattctcgtcggccttaccaagttcctacgaccacccttcacgtcccctcccgtggacccctactccgaaccgttcggggcccttacccgaacgggtaccgtttacgggaacgggtacgttacgggtaacggggtaccctttaaccgtaaactttttaacgtttaacccgttacggttaccccggttaacggttttacccgttttaacgttaaccggtaaaaccgttaaaaaacccggttcccggtaaaaacgggttaaaccggttttaagggttttttaccgggggggttacggttttacccgggggaacccgggggtaaaccggggtaaaccccggttaaaccgggtaccccgtttaacggggtaaccccccggtttacccggtacccggttaaaccccggg

SEQ ID NO: 194078 - DNA, 772 bp, Homo sapiens
  misc_feature: GYAE6OF01EUZ3R.9.19.B08.1.454.CMB.1.raw
  modified_base (142)..(142): a, c, t, g, unknown or other
  misc_feature (142)..(142): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (291)..(291): a, c, t, g, unknown or other
  misc_feature (291)..(291): n is a, c, g, or t
  modified_base (488)..(488): a, c, t, g, unknown or other
  misc_feature (488)..(488): n is a, c, g, or t
tcagtgatacgtctcacgaccggtgctcgatttagtgagtcagtaagggggaggctctgcttcagctgtgggcacaagaggcagtactcaggacaatctccagcatcgccctggtcctcctcctcctcctcactcctcctcnctcactcgcacgacgggtccgtcggcccagttctgtgctgacgcacgcccncctnagtcgtccgtcgggaccccngggacaggacggtccacctactcctctagcacgtcggacacgctacgtaccaacgacggtacggtataggttanacgtacgtacccgtccgtaacggttcggtaacccaggttaccgttacggtttacccgaaacggacccgtacccgaccggtaccgttacccgtatttacgtttcgtttaggtaactaaccgtacgtcccgtaccgttacgaccgggtacctacggaccttcgtccgtacgtccgactaccggaagttcaaccgtaccnccgtacccgtaccgttacccgtcccgtaccggtaccctaccgttacgacccgggtacgtaccctaacggtaccgtagggtacggtaaacggttacgtacggttaacgtacccgtttaagtttaaccgtttaacggttcctaaccggtttaccgttaaaccgtttagttaaccggtaacgttaaaaccgtaacgttaacgaaacggtttacgttagggtttacggggtacggtacgggtacggaccgaaatcccggttacgtacgtacccgtagtccgtaaccgg

SEQ ID NO: 194079 - DNA, 641 bp, Homo sapiens
  misc_feature: GYAE6OF01CP95T.9.19.B08.1.454.CMB.1.raw
  modified_base (250)..(250): a, c, t, g, unknown or other
  misc_feature (250)..(250): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacgagggtcctgggcccagtctgtgctgacgcagcccgccctcagtggtccgtcggggcccccgaggggcaggacgggtcaccgatcctcctgcacgtgggacncagcctacaacagtacgggaatcgctatgttcacactcgtaccagtcacgtccttaccgaggtaacctaccgtacccccaaacccgtcatctagtacggtaatagtaacgtccgcctcggacggtcctagtacgtacttcgtcgtggtccctacgaacgtcgtacgacctaccgttcgaccgtccctcccgtacggtcccaacgttccgacggttcgggtacttacggacggtcgtaggaacgtgacgggacgtcgtagttactttaaccgttcgtccgaaccttaccgttactagtaccggtaacacggtccgttaacgtccgtaagggtaaccgttaggtggttaacgttcggtacgggacggtaacgggaacctgggtccgttaccgg

SEQ ID NO: 194080 - DNA, 652 bp, Homo sapiens
  misc_feature: GYAE6OF01BNE5Q.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagcccgccctcagtgtcgtcggggccccaggggcaggaggtccaccatcctcctgcacgtggcagcagttccaacagtcggggactaggttatgatgtccacgtcggtaccagctacgtttccgaacggtaaccacgcccccgaacgggtcctctacttctttggttactagtaactcggccctcgacgggtccgtacgaccgtacttctctcggctacgaacgtctacgacctacctcacgtccctcccgtcggaccctactactaccgtcggacctccacgacgtagacggagtggtacggtcttacgtaactttaacttacgtacgtcttaacgttacttagtaaccgtaaccgtaaaccgtcgaaacggttaacgttaggttttacggggttacgggttccggggaccgggtaaccgggtaaaccgtaacggtaccgttacccggtacccgtttcccggtcgtaacccggg

SEQ ID NO: 194081 - DNA, 782 bp, Homo sapiens
  misc_feature: GYAE6OF01AYTNV.9.19.B08.1.454.CMB.1.raw
  modified_base (280)..(280): a, c, t, g, unknown or other
  misc_feature (280)..(280): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacgagggtcctgggcccagtctgtgctgacgcacgcccgcctcgagtgtcgtcggggccccagggcaggagggtccaccgatcctcctcgacacgtggctagctacgttccaacgcggtcggggactaggttangtacttcgtcctacgttacggtaccacggcgttaacgtttaccgaacggaaccgtacccggtaccccggtagggttaccctacgttacgtttaccgttttaaggttaaccgtaacggttaaccgtcccggtacccgttaccgggtaccggggttccctacggtaacccgtactttccgttccggtacggtacccttaaccgtaagttccgtacgtaaccccgtacctcggtaacccgtcccgttccccggtacgtacccctagttacccgacggttcccgggtaccctaccggtaacggaccgttacgggaacggttacggtacgtacgggttaccttaacgttaacgtttaccttaaccggttcgacccgtttattaccgtagtaaccgtaaacgtaaccgtacgtaaacgtttaacggtcggtttacggggtacgggtacccgggacggggtaaccggtaaccgacggttacgacccggccgtttccgaggttaaccccg

SEQ ID NO: 194082 - DNA, 922 bp, Homo sapiens
  misc_feature: GYAE6OF01EVKCM.9.19.B08.1.454.CMB.1.raw
  modified_base (338)..(338): a, c, t, g, unknown or other
  misc_feature (338)..(338): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacgagggtcctgggcccagtctgtgctgaccgcacgccgccctcgagtgtccgtcggggaccccagggccaggacgggtccaccgacttcctcctggactacgtcgggcacggtctacgttccaaacgtggtacgggactaggttatgagttcgtaccagtcggacctagcgttacgttaccgacggaaccnccggtccccgaggttccacgttagtttcgttttacggttacctaacggttaaccgtcccggtacccgttcgggtaccggggttccccttaggaacccgttaccgtttcgtacgttaccggtacccttaccgtaacgtttaccgtaccgtaaccctcccgttaccgtaaccccgtccccgttaccccgtccggaaaccccttacgttacccggtaccggttcccgggtaaccccgtacccggttaaacgggtaccgtttaacggggtaacgggtttaacgttaccgggggtaaacgtttaccgtttaaccgtttaaaacgttttaccccgtttaaacccgtcccggttaaacccccttttaccgttaaaccccgtttacgaaacccgggttaacccgaacgggtttaacccggaaccgggtttaacccgggttaaaggtaaacccgggggtttaggttttacccgggggttaacggtttttaacccgggggggtaaccggggtaacccgggggggttttaaaccccgggaaaccgttacggggggttaaaaccccccgggttcccgggttttaaaacccccgggg

SEQ ID NO: 194083 - DNA, 719 bp, Homo sapiens
  misc_feature: GYAE6OF01AY4EU.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcacgccgccctcagtcgtcgtcggggccccagggcaggacggtccaccatctcctgcactggcagcagtaccaacgacgtcgggctaggttactgtattcgtaccgaacgttcggtaacccgagtcttacgtttaccgaaggaaccaccggtcccccgagggttccctacgtatttccgtttagtaacgtaacgttaccgccggtccccgtaccggtacggggttcccctaggtacccgtattccgtcggtcgtcccttaccgtaacgtcctacgtacccacccgttcaacccgtccccgtaccctacggaccctacgtaccgtaccggtcggtaccctaccggtaacgtacgtacgggagtaaccgttacgggacgttactcgttaacttacgttactcgaccttagtttacctagtaacctaacgtaaacgttccgtaaacgttacgtttacgggtttacgggttacggtaccggggtaaccgggtaacgggtaacccgtaacgggtcccgtaaccggtccccgtagttcccgtaaccggg

SEQ ID NO: 194084 - DNA, 497 bp, Homo sapiens
  misc_feature: GYAE6OF02IPBTN.9.19.B08.1.454.CMB.1.raw
  modified_base (463)..(463): a, c, t, g, unknown or other
  misc_feature (463)..(463): n is a, c, g, or t
tcagtgatacgtctcacgaccggtgctcgatttagtgagtcagtaaggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagccccagggtcctcatcttggtacagtaatcggccctcaggggtccctgaccgattctctggctccaagtctgacacctcacgcctccctggccatcactcgggctccagactgaggatgaggctcattattactgccagttcttatgacaaacgtcagaacattttgggngttcggcggagggaccaaggctgaccgtctcacg

SEQ ID NO: 194085 - DNA, 663 bp, Homo sapiens
  misc_feature: GYAE6OF02JVHV8.9.19.B08.1.454.CMB.1.raw
  modified_base (430)..(430): a, c, t, g, unknown or other
  misc_feature (430)..(430): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactgtaccagcagttccaggaacacgccccagggtcctcatctttggttacagtaactcggtccctcgacgggtccctgacccgattcctctcggctaccaagtctcgaccacctcacgccctcccgtcggccatccacgtcgggcctccgagacctgaaggnttacggacggtcgttactaagtttactttaaccgtcgtacccgtacgttcgtttaacgtacgtaaaccgtaaaccgttaccgtaaaggtaaacccggttaaacgggttttttacgggggttaccggtttttaacccggggggaccggggtaaaccgggggtaaccccggtaaaacgggtccccggtttaacgggtaaccccccggtttacccgggttacccgttaacccgggg

SEQ ID NO: 194086 - DNA, 528 bp, Homo sapiens
  misc_feature: GYAE6OF02HDEIU.9.19.B08.1.454.CMB.1.raw
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctgggggccccagggcagagggtcaccatctcctgcactggcagcagttccaacatcggggcaggttatgatgtccactcggtaccagctagtttccaggaacacgcccccagggtcctcatctttgtacagtaactcggcctcgacgggtccctagcccgtattctctcgctccaagtctgacncctcacgcctccctggcctatcacgtcgggcctccaggctggacgatacggnggctagacttattactcgccagttcgtancgacgtagtcgactaagtacattcgtcttacggaacgtcggtaccgaggtccaccggttccgtggtaccg

SEQ ID NO: 194087 - DNA, 703 bp, Homo sapiens
  misc_feature: GYAE6OF02GDM82.9.19.B08.1.454.CMB.1.raw
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctcggggccccagggccaggagggtcaccatctcctgcactggcagcagttccaacagtcgggactaggttactgacgtcgtaccacgtacggtaacccaaactaaccttaccgaacggtaaccacgacccccaaagtccatctaatttactacgaacaactatacggaacgccggacccgtcggtaacggggttccctacggacccgtacgttccgtcccggacttacccgtaacgttcgtacggacctaactacgttaccaacgtccccttacccgtcggaccctaacgtccaccggttcgggtacctcccgaggtccgtaggacggtagtacggaacggtccgttacgaacctttaacgttaccgtacgaccgtaacggttacgttaacgtacggtaccgtacgggtaccggtaaccttaaacggtaaaccgtacgtttacccggttaccggttacgggaaccggttaccgggaaaccctacgggttaccccgtacccgtttaccggg

SEQ ID NO: 194088 - DNA, 617 bp, Homo sapiens
  misc_feature: GYAE6OF02FIXLS.9.19.B08.1.454.CMB.1.raw
  modified_base (382)..(382): a, c, t, g, unknown or other
  misc_feature (382)..(382): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggcccccagggcagagggtcaccatctccgtgcacctggcagcagttccaacatcggggcacggttatgatgtccactggtaccagcagtttccaggaccacgcccccgaggtcctcgatctttggttacagtaactccggccctcgacgggtccctgacccgtattcctctcggctccaagtctnaccgacctcacgccctcccgtggcccataccacgtcgggcctacccgagtaccgttaggacggacgtcggacggtacttactacgtttaacttacctgacccgttacgttacctttaagtacgtaacctaaaccggtacaaacggtaacgttaacggttttcgggggtacggttaccgggtaccgggaaccgggtaccaacggtccgtaccgtacccggttcctaccgtaaccgg

SEQ ID NO: 194089 - DNA, 648 bp, Homo sapiens
  misc_feature: GYAE6OF02HW07S.9.19.B08.1.454.CMB.1.raw
  modified_base (581)..(581): a, c, t, g, unknown or other
  misc_feature (581)..(581): n is a, c, g, or t
tcagtgatacgtctcacgaccggtgctcgatttagtgagtcagtaagggggaggctctgcttcagctgtgggcacaagaggcagtactcaggacaatctccagcatgccctggtctcctctctcctcactctcctcgctcactgcacgagggtcctgggcccagtctgtgctgacgcacgcccgccctcagtcgtcgtcggggccccagggcaggacggtaccaccatcctccgttgccacgtgggacgcacgcctaccaaacacgtcgggaatcgcttagtagttagtaacgtcggtacagacacgtccttaccgacggtaaccaccgtaccccccaaccctctaactactagtacggtaataacgtactccgcccgtacgacggtcctacgacgtactcgtcgtaggcctaccgtacgtcgtacgcctacgtccgacgtcccctccgtacggacctaacgtccgacggttcgggtccttacggacggtccgtaggacgggtactcgggacgttcgttacggttaacttacgtttaccgcgtacccgttaccgttcctactacgactacgctacgtacgnggtaacggtagttcggttacgtagggtccgggacggtaccggaacctacggttaccgacggtaccgg

SEQ ID NO: 194090 - DNA, 752 bp, Homo sapiens
  misc_feature: GYAE6OF02IP6PY.9.19.B08.1.454.CMB.1.raw
  modified_base (341)..(341): a, c, t, g, unknown or other
  misc_feature (341)..(341): n is a, c, g, or t
tcagtgatacgtctcacgaccggtgctcgatttagtgagtcagtaagggggaggctctgcttcagctgtcgggcacaagaggcagtactcaggacaatctccagcatgccctggtctcctctctcctcactctcctcgctcactgcacgtagggtccgtgggccctaggtctgtggctaggacgcgacggcccgtccctgaggtggtccggtccgggggccccgaggggccagggtacgggtccaccgtatcccgttccgtcgccacgtggcacgctacgttaccaacgtacgggtcgggactacggtttatggtactcggtacctacggtcggtaacccnggtacgttaggttaccgacggaaccgaccggtacccccgtagggttccctaacgttactttacggtttacggttacgtaacgttacgtccgtacccgtacggtaccgggtcctacggtacgtacgttctacggtacgcgtaacgtacgttctacgacctaccgtcgaccgtcccctaccgtccgggtacctaacgtccgaaccggttcgtaccgtacgtaacgggtacgtaggtaacgtggtaccggacgttactagttaactttacgtaccgtacgtacgtccgtttacgttaataacgtaaccgtaaggtacgtaacggttacggtttaacggttggggttaccggggtcggtaaccgggtaaggtaaccggtaacgttccggtaacctaaccggttccgacgtaccgg

SEQ ID NO: 194091 - DNA, 772 bp, Homo sapiens
  misc_feature: GYAE6OF02JFBWE.9.19.B08.1.454.CMB.1.raw
  modified_base (151)..(151): a, c, t, g, unknown or other
  misc_feature (151)..(151): n is a, c, g, or t
  modified_base (300)..(300): a, c, t, g, unknown or other
  misc_feature (300)..(300): n is a, c, g, or t
tcagtgatacgtctcacgaccggtgctcgatttagtgagtcagtaagggggaggctctgcttcagctgtgggcacaagaggcagtactcaggacaatctccagcatcgccctggtctcctctcctcctcactctcctcgctcactgctacngggtcctcgggcccagtctgtcgtctgacgcgacgcccgcctcgcgttcgtccgtcgggggaccccagggccaggggtacggtaccactactcctccgtcgtcacgcggcaacggctaaccgttaccaaacgtcggtccgggacgttanggttactggtaccttcggtacgttacgacggtaccgagtttacccgtagggtaaccaacggttaccccacggggtccccttaggtctttaccgttcggtttaacttagtaacgttacggtaccgtccgtacgggtcccggacggttaccgtacgtttaccgtcgttacgtcgtaccgttaccgtccgttaacgtccgtaacctacccgtaccgtaccctaccccgggtccgtaccgttacgtccgtaacgttcggaccgtccgtaacgttaccgtagggttacgacggttcgacgtacggttaccgtaactttacgttacctacggttaccgtacggttacccgtttaacggtaccttaacgtaaaccggtaaacgttacgaaacgttacggttttaaaccgggttgtttaccgggacggtttaccgggaacgttaaccgcgtccggtacctccggtaccgttcgtaaccgg

SEQ ID NO: 194092 - DNA, 820 bp, Homo sapiens
  misc_feature: GYAE6OF02F95OE.9.19.B08.1.454.CMB.1.raw
  modified_base (83)..(83): a, c, t, g, unknown or other
  misc_feature (83)..(83): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
tcagtgatacgtctcacgaccggtgctcgatttagtgagtcagtaagggggaggctctgcttcagctgtgggcacaagaggcngtactcaggacaatctccagcatgccctggtctcctctctcctcactctcctcgctcactgcacgacgggtccgtggcccagttctgtcgtctgacgcgacgcccgcctcgagtcgtcgtcggggaccccagggcgaggtagggtacaccatcctccgngccgtacgtcggacncgacgtacgttaccaaacgaggttccggggacgttaaggttacgtagtaacgtcgttaaccccggacgttcgggttaacccacggttaccgtaacggtttacccggaaggaaacccgaccggacccccggttacgggttaccctacgtttacgtttacggttttacggttaactaaacggttaccgtccggtaccccgtacgggtaccgggttacccgtacggtaccgtacgtttccgtacgtaccgtacctaccgtaacgttccgaccgtaacccgtcctaccgtacccgtcccgttaccccgtcgtacccgacttccggaaccgttccgggccttaccgacgtacgtagggtacgtagttacgacgggtaccttagttaactttacggttaccgtaccggtaccgttaacgttacctttaacggaaacccgttaaccgtaaacgtacccggttaacgttaaccggtttaaggggttttaccgggttcggggttaaccggggaccgggtaacgggtaccgtacggttacccggtacgtaccccggtttacacggtaacccgg

SEQ ID NO: 194093 - DNA, 775 bp, Homo sapiens
  misc_feature: GYAE6OF02ICH8M.9.19.B08.1.454.CMB.1.raw
tcagtgatacgtctcacgaccggtgctcgatttagtgagtcagtaagggggagctctgcttcagctgtgggcacaagaggcagtactcaggacaatctcagcatgccctggtctcctctcctcctcactctcctcgctcactgcacgagggtcctcggcccagtcctgtcgctagaccgcacggcccgtcctacgaggttcgtccggtccgggggaccccgaagggccgtaggacgggtaccaaccgtacttcctccgtcgtcctactcgggacacggtactaacggttaccaaacgtaggtaccggggacttaaggttagtgtaacgttcgtacccgtaagttcggtaaccacggtaccttaccggtttaccgaacggtaaccaccccggtccccggtaaggtcctacgtacgtttcgtttacggtacgtacgttaaccgtccggtacccgtacgggtcgggtccctgtaaccgttcttcgcgtacgtcctaccggtacttcggtacgcctaacctcgtacccgtccccttccggtaccggtcctaccgtaccgtaccgggttcgggttaccctttaacggccggttaacggtagggaaggttacgtaccgggtacgtacttagtttaactttacgttccgtaccgttactaccgtttacgacgtacgaacccggtaagtcccaaggtacctaagggtacggttaacggtttgtaccgggttacggttacggggtaacgtaccgggtaacgacggttaccgaccggttaaccgg

SEQ ID NO: 194094 - DNA, 918 bp, Homo sapiens
  misc_feature: GYAE6OF02FFWVI.9.19.B08.1.454.CMB.1.raw
  modified_base (189)..(189): a, c, t, g, unknown or other
  misc_feature (189)..(189): n is a, c, g, or t
  modified_base (293)..(293): a, c, t, g, unknown or other
  misc_feature (293)..(293): n is a, c, g, or t
tcagtgatacgtctcacgaccggtgctcgatttagtgagtcagtaagggggaggctctgcttcagctgtgggcacaagaggcaggtactcaggacaatctccagcatgccctggtctcctctcctcctcactctcctcgctcactgcacagggtcctgggcccagtctgtgctgacgtcagccgccctnagtcgtcgtcggggccccagggtcaggacgggtccaccagtcctctgcacgtggcagctagttccacagtcgggactaggttactgtatcgtccactggtaccngtctacgtttccgaggaccaccggtccccgagggtcctacgtacttccgttttacggtaactacggttaaccgtcccggtccccgtacggtaccggggttaccccgttacggtaacccgttacgttttcccgtaccggttacgggtaccccgttaacccgtaaacggtttccctttaaacgggaaccccgttaaccccgtttaccggacccggttacccccgttaccccggttaccgggtaaccccgtaacggttaccccggttaaccgggttacccggggtaccccttacccggtaacggtaacccggttaggggaaccgggtttaacgtacggggtaacccgggttaccgtttaccgttaaccgttttaaccgtttacccgttaccgggtaaccccgtttaaccggtttaaccgttaaccggttaaaccgtaaacccgttaaacccggtttacgtaaaccgggtttaaacccgggttttaacggggttttaaccgggggggttaaccggtttaacccgggggaaccggggtttaaacccgggtaacccgggttaaacccgggttaccccgggtttaaccgggttaaccccccggttaaccggttacccggttaaaacccgggg

SEQ ID NO: 194095 - DNA, 125 bp, Homo sapiens
  misc_feature: GYAE6OF01A9SN8.51.29.C07.1.454.CMB.1.raw
  modified_base (113)..(125): a, c, t, g, unknown or other
  misc_feature (113)..(125): n is a, c, g, or t
tcagcgatcgtatacacgaccggtgctcgatttagagtgctacgaaggaagggcagcgtcactctgttccacctcctctcgtagcactctgagcggctggcaaggcgcatagnnnnnnnnnnnnn

SEQ ID NO: 194096 - DNA, 111 bp, Homo sapiens
  misc_feature: GYAE6OF01CZWKC.51.29.C07.1.454.CMB.1.raw
  modified_base (111)..(111): a, c, t, g, unknown or other
  misc_feature (111)..(111): n is a, c, g, or t
tcagcgatcgtatacacgaccggtgctcgattagagtgctacgaaggaaggcagcgtcactctgttccacctcctctcgtagcactctgagcggctggcaaggcgcatagn

SEQ ID NO: 194097 - DNA, 115 bp, Homo sapiens
  misc_feature: GYAE6OF01B7I15.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaaggcagcgtcactctgttcccaccctcctctcgtagcactctgagcggctggcaaggcgcatagn

SEQ ID NO: 194098 - DNA, 128 bp, Homo sapiens
  misc_feature: GYAE6OF01EDZ9F.51.29.C07.1.454.CMB.1.raw
  modified_base (115)..(128): a, c, t, g, unknown or other
  misc_feature (115)..(128): n is a, c, g, or t
tcagcgatcgtatacacgaccggtgctcgatttagagtgctacgaagggaagggcagcgtcactctgttcccgccctctctcgtagcactctgagcggctggcaaggcgcatagnnnnnnnnnnnnnn

SEQ ID NO: 194099 - DNA, 118 bp, Homo sapiens
  misc_feature: GYAE6OF01BYEWR.51.29.C07.1.454.CMB.1.raw
  modified_base (112)..(118): a, c, t, g, unknown or other
  misc_feature (112)..(118): n is a, c, g, or t
tcagcgatcgtatacacgaccggtgctcgatttagagtgctacgaaggaaggcagcgtcactctgttccacctcctctcgtagcactctgagcggctggcaaggcgcatagnnnnnnn

SEQ ID NO: 194100 - DNA, 116 bp, Homo sapiens
  misc_feature: GYAE6OF01EC44L.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaagggcagcgtcactctgttcccaccctcctctcgtagcactctgagcggctggcaaggcgcatagn

SEQ ID NO: 194101 - DNA, 115 bp, Homo sapiens; identical to SEQ ID NO: 194097
  misc_feature: GYAE6OF01ACX37.51.29.C07.1.454.CMB.1.raw
  modified_base (115)..(115): a, c, t, g, unknown or other
  misc_feature (115)..(115): n is a, c, g, or t

SEQ ID NO: 194102 - DNA, 116 bp, Homo sapiens; identical to SEQ ID NO: 194100
  misc_feature: GYAE6OF01C8YXO.51.29.C07.1.454.CMB.1.raw
  modified_base (116)..(116): a, c, t, g, unknown or other
  misc_feature (116)..(116): n is a, c, g, or t

SEQ ID NO: 194103 - DNA, 112 bp, Homo sapiens
  misc_feature: GYAE6OF01AL7BT.51.29.C07.1.454.CMB.1.raw
  modified_base (112)..(112): a, c, t, g, unknown or other
  misc_feature (112)..(112): n is a, c, g, or t
tcagcgatcgtatacacgaccggtgctcgattagagtgctacgaaggaaggcagcgtcactctgttcccgcctcctctcgtagcactctgagcggctggcaaggcgcatagn

SEQ ID NO: 194104 - DNA, 115 bp, Homo sapiens
  misc_feature: GYAE6OF01EBLSG.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaagggcagcgtcactctgttccaccctcctctcgtagcactctgagcggctggcaaggcgcatagn

SEQ ID NO: 194105 - DNA, 121 bp, Homo sapiens
  misc_feature: GYAE6OF01BL1N3.51.29.C07.1.454.CMB.1.raw
  modified_base (108)..(108): a, c, t, g, unknown or other
  misc_feature (108)..(108): n is a, c, g, or t
  modified_base (114)..(121): a, c, t, g, unknown or other
  misc_feature (114)..(121): n is a, c, g, or t
tcagcgatcgtatacacgaccggtgctcgatttagagtgctacgaagggaaggcgagcgtcactctgttcccacctctctcgtagcactctgagcggctggcaaggcncatagnnnnnnnn

SEQ ID NO: 194106 - DNA, 117 bp, Homo sapiens
  misc_feature: GYAE6OF01A13XH.51.29.C07.1.454.CMB.1.raw
  modified_base (112)..(117): a, c, t, g, unknown or other
  misc_feature (112)..(117): n is a, c, g, or t
tcagcgatcgtatacacgaccggtgctcgattagagtgctacgaaggaaggcgagcgtcactctgttccacctcctctcgtagcactctgagcggctggcaaggcgcatagnnnnnn

SEQ ID NO: 194107 - DNA, 114 bp, Homo sapiens
  misc_feature: GYAE6OF01BWK4I.51.29.C07.1.454.CMB.1.raw
  modified_base (113)..(114): a, c, t, g, unknown or other
  misc_feature (113)..(114): n is a, c, g, or t
tcagcgatcgtatacacgaccggtgctcgatttagagtgctacgaaggaaggcagcgtcactctgttcccgcctcctctcgtagcactctgagcggctggcaaggcgcatagnn

SEQ ID NO: 194108 - DNA, 113 bp, Homo sapiens
  misc_feature: GYAE6OF01B2P5M.51.29.C07.1.454.CMB.1.raw
  modified_base (113)..(113): a, c, t, g, unknown or other
  misc_feature (113)..(113): n is a, c, g, or t
tcagcgatcgtatacacgaccggtgctcgatttagagtgctacgaaggaaggcagcgtcactctgttcccacctcctctcgtagcactctgagcggctggcaaggcgcatagn

SEQ ID NO: 194109 - DNA, 139 bp, Homo sapiens
  misc_feature: GYAE6OF01AF5RA.51.29.C07.1.454.CMB.1.raw
  modified_base (117)..(139): a, c, t, g, unknown or other
  misc_feature (117)..(139): n is a, c, g, or t
tcagcgatcgtatacacgaccggtgctcgatttagagtgctacgaagggaagggcagcgtcactctgttcccaccctcctctgtagcactctgagcgggctggccaaggcgcatagnnnnnnnnnnnnnnnnnnnnnnn

SEQ ID NO: 194110 - DNA, 117 bp, Homo sapiens
  misc_feature: GYAE6OF01D1PPL.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctcctctcgtagcactctgagcggctggcaaggcgcatagn

SEQ ID NO: 194111 - DNA, 114 bp, Homo sapiens
  misc_feature: GYAE6OF01AGZZS.51.29.C07.1.454.CMB.1.raw
  modified_base (114)..(114): a, c, t, g, unknown or other
  misc_feature (114)..(114): n is a, c, g, or t
tcagcgatcgtatacacgaccggtgctcgatttagagtgctacgaagggaaggcagcgtcactctgttcccgcctcctctcgtagcactctgagcggctggcaaggcgcatagn

SEQ ID NO: 194112 - DNA, 116 bp, Homo sapiens; identical to SEQ ID NO: 194100
  misc_feature: GYAE6OF01CZFG0.51.29.C07.1.454.CMB.1.raw
  modified_base (116)..(116): a, c, t, g, unknown or other
  misc_feature (116)..(116): n is a, c, g, or t

SEQ ID NO: 194113 - DNA, 115 bp, Homo sapiens
  misc_feature: GYAE6OF01E4EJM.51.29.C07.1.454.CMB.1.raw
  modified_base (112)..(115): a, c, t, g, unknown or other
  misc_feature (112)..(115): n is a, c, g, or t
tcagcgatcgtatacacgaccggtgctcgatttagagtgctacgaaggaaggcagcgtcactctgttccgcctcctctcgtagcactctgagcggctggcaaggcgcatagnnnn

SEQ ID NO: 194114 - DNA, 113 bp, Homo sapiens
  misc_feature: GYAE6OF01CQAOO.51.29.C07.1.454.CMB.1.raw
  modified_base (113)..(113): a, c, t, g, unknown or other
  misc_feature (113)..(113): n is a, c, g, or t
tcagcgatcgtatacacgaccggtgctcgattagagtgctacgaagggaaggcagcgtcactctgttcccgcctcctctcgtagcactctgagcggctggcaaggcgcatagn

SEQ ID NO: 194115 - DNA, 116 bp, Homo sapiens
  misc_feature: GYAE6OF01CRIAK.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaagggcagcgtcactctgttcccgccctcctctcgtagcactctgagcggctggcaaggcgcatagn

SEQ ID NO: 194116 - DNA, 116 bp, Homo sapiens; identical to SEQ ID NO: 194115
  misc_feature: GYAE6OF01BBHH9.51.29.C07.1.454.CMB.1.raw
  modified_base (116)..(116): a, c, t, g, unknown or other
  misc_feature (116)..(116): n is a, c, g, or t

SEQ ID NO: 194117 - DNA, 117 bp, Homo sapiens
  misc_feature: GYAE6OF01EARWJ.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaaggcagcgtcactctgttcccgccctcctctcgtagcactctgagcgggctggcaaggcgcatagn

SEQ ID NO: 194118 - DNA, 117 bp, Homo sapiens
  misc_feature: GYAE6OF01AUI8B.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaagggcagcgtcactctgttcccgcctcctctcgtagcactctgagcggctggcaaggcgcatagnn

SEQ ID NO: 194119 - DNA, 158 bp, Homo sapiens
  misc_feature: GYAE6OF01CGOMP.51.29.C07.1.454.CMB.1.raw
  modified_base (121)..(122): a, c, t, g, unknown or other
  misc_feature (121)..(122): n is a, c, g, or t
  modified_base (124)..(158): a, c, t, g, unknown or other
  misc_feature (124)..(158): n is a, c, g, or t
tcagcgatcgtatacacgaccggtgctcgatttagagtgctacgaaggaaaggcagacggtcaactctcgttcccgcccgtcctctccgtagcactctgagcggctggcaaggcgcatagnntnnnnnnnnnnnnnnnnnnnnnnnnnnnnnnnnnnn

SEQ ID NO: 194120 - DNA, 113 bp, Homo sapiens
  misc_feature: GYAE6OF01D39F5.51.29.C07.1.454.CMB.1.raw
  modified_base (113)..(113): a, c, t, g, unknown or other
  misc_feature (113)..(113): n is a, c, g, or t
tcagcgatcgtatacacgaccggtgctcgatttagagtgctacgaaggaaggcagcgtcactctgttcccgcctcctctcgtagcactctgagcggctggcaaggcgcatagn

SEQ ID NO: 194121 - DNA, 128 bp, Homo sapiens
  misc_feature: GYAE6OF01D4SAW.51.29.C07.1.454.CMB.1.raw
  modified_base (119)..(128): a, c, t, g, unknown or other
  misc_feature (119)..(128): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnnnnnnnn

SEQ ID NO: 194122 - DNA, 117 bp, Homo sapiens
  misc_feature: GYAE6OF01BZTXK.51.29.C07.1.454.CMB.1.raw
  modified_base (114)..(117): a, c, t, g, unknown or other
  misc_feature (114)..(117): n is a, c, g, or t
tcagcgatcgtatacacgaccggtgctcgatttagagtgctacgaaggaaggcagcgtcactctgttcccgccctcctctcgtagcactctgagcggctggcaaggcgcatagnnnn

SEQ ID NO: 194123 - DNA, 117 bp, Homo sapiens
  misc_feature: GYAE6OF01C9YMO.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaagggcagcgtcactctgttcccaccctcctctcgtagcactctgagcgggctggcaaggcgcatagn

SEQ ID NO: 194124 - DNA, 115 bp, Homo sapiens; identical to SEQ ID NO: 194097
  misc_feature: GYAE6OF01APSB3.51.29.C07.1.454.CMB.1.raw
  modified_base (115)..(115): a, c, t, g, unknown or other
  misc_feature (115)..(115): n is a, c, g, or t

SEQ ID NO: 194125 - DNA, 116 bp, Homo sapiens; identical to SEQ ID NO: 194115
  misc_feature: GYAE6OF01DSFDY.51.29.C07.1.454.CMB.1.raw
  modified_base (116)..(116): a, c, t, g, unknown or other
  misc_feature (116)..(116): n is a, c, g, or t

SEQ ID NO: 194126 - DNA, 115 bp, Homo sapiens
  misc_feature: GYAE6OF01A927V.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaaggcagcgtcactctgttcccgccctcctctcgtagcactctgagcggctggcaaggcgcatagn

SEQ ID NO: 194127 - DNA, 116 bp, Homo sapiens
  misc_feature: GYAE6OF01AHYUY.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaggcagcgtcactctgttcccgccctcctctcgtagcactctgagcgggctggcaaggcgcatagn

SEQ ID NO: 194128 - DNA, 115 bp, Homo sapiens; identical to SEQ ID NO: 194126
  misc_feature: GYAE6OF01D6WS6.51.29.C07.1.454.CMB.1.raw
  modified_base (115)..(115): a, c, t, g, unknown or other
  misc_feature (115)..(115): n is a, c, g, or t

SEQ ID NO: 194129 - DNA, 116 bp, Homo sapiens; identical to SEQ ID NO: 194115
  misc_feature: GYAE6OF01C4OBH.51.29.C07.1.454.CMB.1.raw
  modified_base (116)..(116): a, c, t, g, unknown or other
  misc_feature (116)..(116): n is a, c, g, or t

SEQ ID NO: 194130 - DNA, 115 bp, Homo sapiens; identical to SEQ ID NO: 194126
  misc_feature: GYAE6OF01BHNR1.51.29.C07.1.454.CMB.1.raw
  modified_base (115)..(115): a, c, t, g, unknown or other
  misc_feature (115)..(115): n is a, c, g, or t

SEQ ID NO: 194131 - DNA, 116 bp, Homo sapiens
  misc_feature: GYAE6OF01BVID6.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaaggcagcgtcactctgttcccgccctcctctcgtagcactctgagcggctggcaaggcgcatagn

SEQ ID NO: 194132 - DNA, 115 bp, Homo sapiens; identical to SEQ ID NO: 194097
  misc_feature: GYAE6OF01B2T08.51.29.C07.1.454.CMB.1.raw
  modified_base (115)..(115): a, c, t, g, unknown or other
  misc_feature (115)..(115): n is a, c, g, or t

SEQ ID NO: 194133 - DNA, 117 bp, Homo sapiens
  misc_feature: GYAE6OF01EGLDF.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccaccctcctctcgtagcactctgagcggctggcaaggcgcatagn

SEQ ID NO: 194134 - DNA, 135 bp, Homo sapiens
  misc_feature: GYAE6OF01B360M.51.29.C07.1.454.CMB.1.raw
  modified_base (117)..(135): a, c, t, g, unknown or other
  misc_feature (117)..(135): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnnnnnnnnnnnnnnnnnn

SEQ ID NO: 194135 - DNA, 115 bp, Homo sapiens
  misc_feature: GYAE6OF01BWXL4.51.29.C07.1.454.CMB.1.raw
  modified_base (114)..(115): a, c, t, g, unknown or other
  misc_feature (114)..(115): n is a, c, g, or t
tcagcgatcgtatacacgaccggtgctcgatttagagtgctacgaaggaagggcagcgtcactctgttcccgcctcctctcgtagcactctgagcggctggcaaggcgcatagnn

SEQ ID NO: 194136 - DNA, 129 bp, Homo sapiens
  misc_feature: GYAE6OF01BFFGA.51.29.C07.1.454.CMB.1.raw
  modified_base (120)..(129): a, c, t, g, unknown or other
  misc_feature (120)..(129): n is a, c, g, or t
tcagcgatcgtatacacgaccggtgctcgatttagagtgctacgaagggaagggcgaggcgtcactctgttcccacccgtcctctcgtagcacctctgagcggctggcaaggcgcatagnnnnnnnnnn

SEQ ID NO: 194137 - DNA, 119 bp, Homo sapiens
  misc_feature: GYAE6OF01EE4UT.51.29.C07.1.454.CMB.1.raw
  modified_base (118)..(119): a, c, t, g, unknown or other
  misc_feature (118)..(119): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnn

SEQ ID NO: 194138 - DNA, 122 bp, Homo sapiens
  misc_feature: GYAE6OF01DIRQ7.51.29.C07.1.454.CMB.1.raw
  modified_base (114)..(122): a, c, t, g, unknown or other
  misc_feature (114)..(122): n is a, c, g, or t
tcagcgatcgtatacacgaccggtgctcgatttagagtgctacgaagggaagggcagcgtcactctgttccacctcctctcgtagcactctgagcggctggcaaggcgcatagnnnnnnnnn

SEQ ID NO: 194139 - DNA, 118 bp, Homo sapiens
  misc_feature: GYAE6OF01EJ73J.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagn

SEQ ID NO: 194140 - DNA, 118 bp, Homo sapiens
  misc_feature: GYAE6OF01ADUYM.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagn

SEQ ID NO: 194141 - DNA, 124 bp, Homo sapiens
  misc_feature: GYAE6OF01B9F2V.51.29.C07.1.454.CMB.1.raw
  modified_base (117)..(124): a, c, t, g, unknown or other
  misc_feature (117)..(124): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnn

SEQ ID NO: 194142 - DNA, 115 bp, Homo sapiens; identical to SEQ ID NO: 194097
  misc_feature: GYAE6OF01CB243.51.29.C07.1.454.CMB.1.raw
  modified_base (115)..(115): a, c, t, g, unknown or other
  misc_feature (115)..(115): n is a, c, g, or t

SEQ ID NO: 194143 - DNA, 118 bp, Homo sapiens; identical to SEQ ID NO: 194140
  misc_feature: GYAE6OF01BXAVL.51.29.C07.1.454.CMB.1.raw
  modified_base (118)..(118): a, c, t, g, unknown or other
  misc_feature (118)..(118): n is a, c, g, or t

SEQ ID NO: 194144 - DNA, 116 bp, Homo sapiens; identical to SEQ ID NO: 194100
  misc_feature: GYAE6OF01C35R9.51.29.C07.1.454.CMB.1.raw
  modified_base (116)..(116): a, c, t, g, unknown or other
  misc_feature (116)..(116): n is a, c, g, or t

SEQ ID NO: 194145 - DNA, 121 bp, Homo sapiens
  misc_feature: GYAE6OF01EJCPF.51.29.C07.1.454.CMB.1.raw
  modified_base (116)..(121): a, c, t, g, unknown or other
  misc_feature (116)..(121): n is a, c, g, or t
tcagcgatcgtatacacgaccggtgctcgatttagagtgctacgaagggaagggcagcgtcactctggttcccacctcctctcgtagcactctgagcggctggcaaggcgcatagnnnnnn

SEQ ID NO: 194146 - DNA, 115 bp, Homo sapiens; identical to SEQ ID NO: 194126
  misc_feature: GYAE6OF01C9KWX.51.29.C07.1.454.CMB.1.raw
  modified_base (115)..(115): a, c, t, g, unknown or other
  misc_feature (115)..(115): n is a, c, g, or t

SEQ ID NO: 194147 - DNA, 117 bp, Homo sapiens
  misc_feature: GYAE6OF01DSK63.51.29.C07.1.454.CMB.1.raw
tcagcgatcgtatacacgaccggtgctcgatttagagtgctacgaagggaaagggcagcgtcactctgttcccgccctcctctcgtagcactctgagcgggctggcaaggcgcatag

SEQ ID NO: 194148 - DNA, 117 bp, Homo sapiens
  misc_feature: GYAE6OF01B50VT.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaagggcagcgtcactctgttcccaccctcctctcgtagcactctgagcggctggcaaggcgcatagnn

SEQ ID NO: 194149 - DNA, 118 bp, Homo sapiens
  misc_feature: GYAE6OF01EC7NS.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnn

SEQ ID NO: 194150 - DNA, 118 bp, Homo sapiens; identical to SEQ ID NO: 194140
  misc_feature: GYAE6OF01DGW14.51.29.C07.1.454.CMB.1.raw
  modified_base (118)..(118): a, c, t, g, unknown or other
  misc_feature (118)..(118): n is a, c, g, or t

SEQ ID NO: 194151 - DNA, 118 bp, Homo sapiens; identical to SEQ ID NO: 194149
  misc_feature: GYAE6OF01CPU8D.51.29.C07.1.454.CMB.1.raw
  modified_base (117)..(118): a, c, t, g, unknown or other
  misc_feature (117)..(118): n is a, c, g, or t

SEQ ID NO: 194152 - DNA, 115 bp, Homo sapiens; identical to SEQ ID NO: 194097
  misc_feature: GYAE6OF01AZ7DY.51.29.C07.1.454.CMB.1.raw
  modified_base (115)..(115): a, c, t, g, unknown or other
  misc_feature (115)..(115): n is a, c, g, or t

SEQ ID NO: 194153 - DNA, 118 bp, Homo sapiens; identical to SEQ ID NO: 194140
  misc_feature: GYAE6OF01ET7XS.51.29.C07.1.454.CMB.1.raw
  modified_base (118)..(118): a, c, t, g, unknown or other
  misc_feature (118)..(118): n is a, c, g, or t

SEQ ID NO: 194154 - DNA, 118 bp, Homo sapiens; identical to SEQ ID NO: 194140
  misc_feature: GYAE6OF01EBYBC.51.29.C07.1.454.CMB.1.raw
  modified_base (118)..(118): a, c, t, g, unknown or other
  misc_feature (118)..(118): n is a, c, g, or t

SEQ ID NO: 194155 - DNA, 116 bp, Homo sapiens; identical to SEQ ID NO: 194115
  misc_feature: GYAE6OF01B5WBI.51.29.C07.1.454.CMB.1.raw
  modified_base (116)..(116): a, c, t, g, unknown or other
  misc_feature (116)..(116): n is a, c, g, or t

SEQ ID NO: 194156 - DNA, 115 bp, Homo sapiens
  misc_feature: GYAE6OF01BLC2I.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaagggcagcgtcactctgttcccacccctctcgtagcactctgagcgggctggcaaggcgcatagn

SEQ ID NO: 194157 - DNA, 117 bp, Homo sapiens; identical to SEQ ID NO: 194133
  misc_feature: GYAE6OF01BCN2P.51.29.C07.1.454.CMB.1.raw
  modified_base (117)..(117): a, c, t, g, unknown or other
  misc_feature (117)..(117): n is a, c, g, or t

SEQ ID NO: 194158 - DNA, 120 bp, Homo sapiens
  misc_feature: GYAE6OF01DL57G.51.29.C07.1.454.CMB.1.raw
  modified_base (119)..(120): a, c, t, g, unknown or other
  misc_feature (119)..(120): n is a, c, g, or t
tcagcgatcgtatacacgaccggtgctcgatttagagtgctacgaagggaaagggcaggcgtcactctgttcccaccctcctctcgtagcactctgagcgggctggcaaggcgcatagnn

SEQ ID NO: 194159 - DNA, 129 bp, Homo sapiens
  misc_feature: GYAE6OF01BWTPB.51.29.C07.1.454.CMB.1.raw
  modified_base (118)..(129): a, c, t, g, unknown or other
  misc_feature (118)..(129): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnn

SEQ ID NO: 194160 - DNA, 119 bp, Homo sapiens
  misc_feature: GYAE6OF01EAOUI.51.29.C07.1.454.CMB.1.raw
  modified_base (118)..(119): a, c, t, g, unknown or other
  misc_feature (118)..(119): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnn

SEQ ID NO: 194161 - DNA, 117 bp, Homo sapiens; identical to SEQ ID NO: 194148
  misc_feature: GYAE6OF01BT99W.51.29.C07.1.454.CMB.1.raw
  modified_base (116)..(117): a, c, t, g, unknown or other
  misc_feature (116)..(117): n is a, c, g, or t

SEQ ID NO: 194162 - DNA, 113 bp, Homo sapiens; identical to SEQ ID NO: 194120
  misc_feature: GYAE6OF01A5RLA.51.29.C07.1.454.CMB.1.raw
  modified_base (113)..(113): a, c, t, g, unknown or other
  misc_feature (113)..(113): n is a, c, g, or t

SEQ ID NO: 194163 - DNA, 117 bp, Homo sapiens; identical to SEQ ID NO: 194123
  misc_feature: GYAE6OF01CY2J8.51.29.C07.1.454.CMB.1.raw
  modified_base (117)..(117): a, c, t, g, unknown or other
  misc_feature (117)..(117): n is a, c, g, or t

SEQ ID NO: 194164 - DNA, 115 bp, Homo sapiens; identical to SEQ ID NO: 194097
  misc_feature: GYAE6OF01A6O5X.51.29.C07.1.454.CMB.1.raw
  modified_base (115)..(115): a, c, t, g, unknown or other
  misc_feature (115)..(115): n is a, c, g, or t

SEQ ID NO: 194165 - DNA, 116 bp, Homo sapiens; identical to SEQ ID NO: 194100
  misc_feature: GYAE6OF01BGBK7.51.29.C07.1.454.CMB.1.raw
  modified_base (116)..(116): a, c, t, g, unknown or other
  misc_feature (116)..(116): n is a, c, g, or t

SEQ ID NO: 194166 - DNA, 117 bp, Homo sapiens; identical to SEQ ID NO: 194110
  misc_feature: GYAE6OF01BWFHN.51.29.C07.1.454.CMB.1.raw
  modified_base (117)..(117): a, c, t, g, unknown or other
  misc_feature (117)..(117): n is a, c, g, or t

SEQ ID NO: 194167 - DNA, 125 bp, Homo sapiens
  misc_feature: GYAE6OF01CUP3R.51.29.C07.1.454.CMB.1.raw
  modified_base (116)..(125): a, c, t, g, unknown or other
  misc_feature (116)..(125): n is a, c, g, or t
tcagcgatcgtatacacgaccggtgctcgatttagagtgctacgaaggaaagggcagcgtcactctgttcccgccctcctctcgtagcactctgagcggctggcaaggcgcatagnnnnnnnnnn

SEQ ID NO: 194168 - DNA, 118 bp, Homo sapiens; identical to SEQ ID NO: 194140
  misc_feature: GYAE6OF01AUMJ5.51.29.C07.1.454.CMB.1.raw
  modified_base (118)..(118): a, c, t, g, unknown or other
  misc_feature (118)..(118): n is a, c, g, or t

SEQ ID NO: 194169 - DNA, 114 bp, Homo sapiens
  misc_feature: GYAE6OF01DRW99.51.29.C07.1.454.CMB.1.raw
  modified_base (114)..(114): a, c, t, g, unknown or other
  misc_feature (114)..(114): n is a, c, g, or t
tcagcgatcgtatacacgaccggtgctcgatttagagtgctacgaagggaaagggcagcgtcactctgttccctcctctcgtagcactctgagcgggctggcaaggcgcatagn

SEQ ID NO: 194170 - DNA, 116 bp, Homo sapiens; identical to SEQ ID NO: 194100
  misc_feature: GYAE6OF01CMXVG.51.29.C07.1.454.CMB.1.raw
  modified_base (116)..(116): a, c, t, g, unknown or other
  misc_feature (116)..(116): n is a, c, g, or t

SEQ ID NO: 194171 - DNA, 118 bp, Homo sapiens
  misc_feature: GYAE6OF01D9QNP.51.29.C07.1.454.CMB.1.raw
  modified_base (116)..(118): a, c, t, g, unknown or other
  misc_feature (116)..(118): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnn

SEQ ID NO: 194172 - DNA, 118 bp, Homo sapiens; identical to SEQ ID NO: 194139
  misc_feature: GYAE6OF01AOGYT.51.29.C07.1.454.CMB.1.raw
  modified_base (118)..(118): a, c, t, g, unknown or other
  misc_feature (118)..(118): n is a, c, g, or t

SEQ ID NO: 194173 - DNA, 117 bp, Homo sapiens
  misc_feature: GYAE6OF01BU1CC.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaagggcagcgtcactctgttcccgccctcctctcgtagcactctgagcgggctggcaaggcgcatagn

SEQ ID NO: 194174 - DNA, 118 bp, Homo sapiens; identical to SEQ ID NO: 194139
  misc_feature: GYAE6OF01EPO98.51.29.C07.1.454.CMB.1.raw
  modified_base (118)..(118): a, c, t, g, unknown or other
  misc_feature (118)..(118): n is a, c, g, or t

SEQ ID NO: 194175 - DNA, 116 bp, Homo sapiens
  misc_feature: GYAE6OF01DWWDA.51.29.C07.1.454.CMB.1.raw
tcagcgatcgtatacacgaccggtgctcgatttagagtgctacgaagggaaaggcagcgtcactctgttcccgccctcctctcgtagcactctgagcgggctggcaaggcgcatag

SEQ ID NO: 194176 - DNA, 117 bp, Homo sapiens; identical to SEQ ID NO: 194173
  misc_feature: GYAE6OF01DRB9T.51.29.C07.1.454.CMB.1.raw
  modified_base (117)..(117): a, c, t, g, unknown or other
  misc_feature (117)..(117): n is a, c, g, or t

SEQ ID NO: 194177 - DNA, 117 bp, Homo sapiens; identical to SEQ ID NO: 194133
  misc_feature: GYAE6OF01CPIND.51.29.C07.1.454.CMB.1.raw
  modified_base (117)..(117): a, c, t, g, unknown or other
  misc_feature (117)..(117): n is a, c, g, or t

SEQ ID NO: 194178 - DNA, 118 bp, Homo sapiens; identical to SEQ ID NO: 194139
  misc_feature: GYAE6OF01EFTTK.51.29.C07.1.454.CMB.1.raw
  modified_base (118)..(118): a, c, t, g, unknown or other
  misc_feature (118)..(118): n is a, c, g, or t

SEQ ID NO: 194179 - DNA, 117 bp, Homo sapiens; identical to SEQ ID NO: 194173
  misc_feature: GYAE6OF01DRCBN.51.29.C07.1.454.CMB.1.raw
  modified_base (117)..(117): a, c, t, g, unknown or other
  misc_feature (117)..(117): n is a, c, g, or t

SEQ ID NO: 194180 - DNA, 117 bp, Homo sapiens; identical to SEQ ID NO: 194117
  misc_feature: GYAE6OF01BJ8KI.51.29.C07.1.454.CMB.1.raw
  modified_base (117)..(117): a, c, t, g, unknown or other
  misc_feature (117)..(117): n is a, c, g, or t

SEQ ID NO: 194181 - DNA, 117 bp, Homo sapiens; identical to SEQ ID NO: 194123
  misc_feature: GYAE6OF01DTMK5.51.29.C07.1.454.CMB.1.raw
  modified_base (117)..(117): a, c, t, g, unknown or other
  misc_feature (117)..(117): n is a, c, g, or t

SEQ ID NO: 194182 - DNA, 113 bp, Homo sapiens; identical to SEQ ID NO: 194108
  misc_feature: GYAE6OF01BJUMO.51.29.C07.1.454.CMB.1.raw
  modified_base (113)..(113): a, c, t, g, unknown or other
  misc_feature (113)..(113): n is a, c, g, or t

SEQ ID NO: 194183 - DNA, 124 bp, Homo sapiens
  misc_feature: GYAE6OF01ACZV6.51.29.C07.1.454.CMB.1.raw
  modified_base (108)..(108): a, c, t, g, unknown or other
  misc_feature (108)..(108): n is a, c, g, or t
  modified_base (113)..(124): a, c, t, g, unknown or other
  misc_feature (113)..(124): n is a, c, g, or t
tcagcgatcgtatacacgaccggtgctcgatttagagtgctacgaagggaaggcagcgtcactctcgttcccacctctctcgtagcactctgagcggctggcaaggcncatgnnnnnnnnnnnn

SEQ ID NO: 194184 - DNA, 117 bp, Homo sapiens; identical to SEQ ID NO: 194173
  misc_feature: GYAE6OF01C3FSH.51.29.C07.1.454.CMB.1.raw
  modified_base (117)..(117): a, c, t, g, unknown or other
  misc_feature (117)..(117): n is a, c, g, or t

SEQ ID NO: 194185 - DNA, 117 bp, Homo sapiens; identical to SEQ ID NO: 194133
  misc_feature: GYAE6OF01BDZV1.51.29.C07.1.454.CMB.1.raw
  modified_base (117)..(117): a, c, t, g, unknown or other
  misc_feature (117)..(117): n is a, c, g, or t

SEQ ID NO: 194186 - DNA, 119 bp, Homo sapiens
  misc_feature: GYAE6OF01CYZ0I.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnn

SEQ ID NO: 194187 - DNA, 118 bp, Homo sapiens; identical to SEQ ID NO: 194140
  misc_feature: GYAE6OF01EU1AD.51.29.C07.1.454.CMB.1.raw
  modified_base (118)..(118): a, c, t, g, unknown or other
  misc_feature (118)..(118): n is a, c, g, or t

SEQ ID NO: 194188 - DNA, 117 bp, Homo sapiens; identical to SEQ ID NO: 194110
  misc_feature: GYAE6OF01BJTD6.51.29.C07.1.454.CMB.1.raw
  modified_base (117)..(117): a, c, t, g, unknown or other
  misc_feature (117)..(117): n is a, c, g, or t

SEQ ID NO: 194189 - DNA, 117 bp, Homo sapiens; identical to SEQ ID NO: 194173
  misc_feature: GYAE6OF01EC1P1.51.29.C07.1.454.CMB.1.raw
  modified_base (117)..(117): a, c, t, g, unknown or other
  misc_feature (117)..(117): n is a, c, g, or t

SEQ ID NO: 194190 - DNA, 118 bp, Homo sapiens; identical to SEQ ID NO: 194139
  misc_feature: GYAE6OF01DE2N4.51.29.C07.1.454.CMB.1.raw
  modified_base (118)..(118): a, c, t, g, unknown or other
  misc_feature (118)..(118): n is a, c, g, or t

SEQ ID NO: 194191 - DNA, 115 bp, Homo sapiens
  misc_feature: GYAE6OF01CFJ02.51.29.C07.1.454.CMB.1.raw
tcagcgatcgtatacacgaccggtgctcgatttagagtgctacgaagggaagggcagcgtcactctgttcccgccctcctctcgtagcactctgagcggctggcaaggcgcatag

SEQ ID NO: 194192 - DNA, 118 bp, Homo sapiens; identical to SEQ ID NO: 194139
  misc_feature: GYAE6OF01EGZR5.51.29.C07.1.454.CMB.1.raw
  modified_base (118)..(118): a, c, t, g, unknown or other
  misc_feature (118)..(118): n is a, c, g, or t

SEQ ID NO: 194193 - DNA, 116 bp, Homo sapiens; identical to SEQ ID NO: 194100
  misc_feature: GYAE6OF01A2VEH.51.29.C07.1.454.CMB.1.raw
  modified_base (116)..(116): a, c, t, g, unknown or other
  misc_feature (116)..(116): n is a, c, g, or t

SEQ ID NO: 194194 - DNA, 119 bp, Homo sapiens; identical to SEQ ID NO: 194160
  misc_feature: GYAE6OF01AJK0P.51.29.C07.1.454.CMB.1.raw
  modified_base (118)..(119): a, c, t, g, unknown or other
  misc_feature (118)..(119): n is a, c, g, or t

SEQ ID NO: 194195 - DNA, 115 bp, Homo sapiens; identical to SEQ ID NO: 194097
  misc_feature: GYAE6OF01BSBOH.51.29.C07.1.454.CMB.1.raw
  modified_base (115)..(115): a, c, t, g, unknown or other
  misc_feature (115)..(115): n is a, c, g, or t

SEQ ID NO: 194196 - DNA, 118 bp, Homo sapiens; identical to SEQ ID NO: 194140
  misc_feature: GYAE6OF01A2PG6.51.29.C07.1.454.CMB.1.raw
  modified_base (118)..(118): a, c, t, g, unknown or other
  misc_feature (118)..(118): n is a, c, g, or t

SEQ ID NO: 194197 - DNA, 134 bp, Homo sapiens
  misc_feature: GYAE6OF01DJUI4.51.29.C07.1.454.CMB.1.raw
  modified_base (120)..(134): a, c, t, g, unknown or other
  misc_feature (120)..(134): n is a, c, g, or t
tcagcgatcgtatacacgaccggtgctcgatttagagtgctacgaagggaaagggcagcgtcactctgttcccgcccgtcctctcgtagcactctgagcgggctggcaaggcgtcatagnnnnnnnnnnnnnnn

SEQ ID NO: 194198 - DNA, 132 bp, Homo sapiens
  misc_feature: GYAE6OF01D6BWZ.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnn

SEQ ID NO: 194199 - DNA, 117 bp, Homo sapiens; identical to SEQ ID NO: 194117
  misc_feature: GYAE6OF01AOGDY.51.29.C07.1.454.CMB.1.raw
  modified_base (117)..(117): a, c, t, g, unknown or other
  misc_feature (117)..(117): n is a, c, g, or t

SEQ ID NO: 194200 - DNA, 118 bp, Homo sapiens
  misc_feature: GYAE6OF01C3UWG.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnn

SEQ ID NO: 194201 - DNA, 116 bp, Homo sapiens
  misc_feature: GYAE6OF01BEZCR.51.29.C07.1.454.CMB.1.raw
tcagcgatcgtatacacgaccggtgctcgatttagagtgctacgaagggaagggcagcgtcactctgttcccgccctcctctcgtagcactctgagcgggctggcaaggcgcatag

SEQ ID NO: 194202 - DNA, 116 bp, Homo sapiens; identical to SEQ ID NO: 194100
  misc_feature: GYAE6OF01CELDB.51.29.C07.1.454.CMB.1.raw
  modified_base (116)..(116): a, c, t, g, unknown or other
  misc_feature (116)..(116): n is a, c, g, or t

SEQ ID NO: 194203 - DNA, 117 bp, Homo sapiens; identical to SEQ ID NO: 194133
  misc_feature: GYAE6OF01DS59B.51.29.C07.1.454.CMB.1.raw
  modified_base (117)..(117): a, c, t, g, unknown or other
  misc_feature (117)..(117): n is a, c, g, or t

SEQ ID NO: 194204 - DNA, 119 bp, Homo sapiens; identical to SEQ ID NO: 194137
  misc_feature: GYAE6OF01CAJX9.51.29.C07.1.454.CMB.1.raw
  modified_base (118)..(119): a, c, t, g, unknown or other
  misc_feature (118)..(119): n is a, c, g, or t

SEQ ID NO: 194205 - DNA, 116 bp, Homo sapiens; identical to SEQ ID NO: 194115
  misc_feature: GYAE6OF01ERY78.51.29.C07.1.454.CMB.1.raw
  modified_base (116)..(116): a, c, t, g, unknown or other
  misc_feature (116)..(116): n is a, c, g, or t

SEQ ID NO: 194206 - DNA, 117 bp, Homo sapiens
  misc_feature: GYAE6OF01CWGZ9.51.29.C07.1.454.CMB.1.raw
tcagcgatcgtatacacgaccggtgctcgatttagagtgctacgaagggaaagggcagcgtcactctgttcccaccctcctctcgtagcactctgagcgggctggcaaggcgcatag

SEQ ID NO: 194207 - DNA, 119 bp, Homo sapiens
  misc_feature: GYAE6OF01DPR2S.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnn

SEQ ID NO: 194208 - DNA, 117 bp, Homo sapiens; identical to SEQ ID NO: 194133
  misc_feature: GYAE6OF01CK5LE.51.29.C07.1.454.CMB.1.raw
  modified_base (117)..(117): a, c, t, g, unknown or other
  misc_feature (117)..(117): n is a, c, g, or t

SEQ ID NO: 194209 - DNA, 115 bp, Homo sapiens
  misc_feature: GYAE6OF01CQ12V.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaagggcagcgtcactctgttcccaccctcctctctagcactctgagcggctggcaaggcgcatagn

SEQ ID NO: 194210 - DNA, 159 bp, Homo sapiens
  misc_feature: GYAE6OF01A0HJQ.51.29.C07.1.454.CMB.1.raw
  modified_base (121)..(159): a, c, t, g, unknown or other
  misc_feature (121)..(159): n is a, c, g, or t
tcagcgatcgtatacacgaccggtgctcgatttagagtgctacgaagggaaagggtcgagcgtcactctgttcccaccctctcgtcgtagcactcctgagcgggctggcaaggcgcatagnnnnnnnnnnnnnnnnnnnnnnnnnnnnnnnnnnnnnnn

SEQ ID NO: 194211 - DNA, 117 bp, Homo sapiens; identical to SEQ ID NO: 194147
  misc_feature: GYAE6OF01CGNHD.51.29.C07.1.454.CMB.1.raw

SEQ ID NO: 194212 - DNA, 118 bp, Homo sapiens; identical to SEQ ID NO: 194149
  misc_feature: GYAE6OF01CLLVK.51.29.C07.1.454.CMB.1.raw
  modified_base (117)..(118): a, c, t, g, unknown or other
  misc_feature (117)..(118): n is a, c, g, or t

SEQ ID NO: 194213 - DNA, 118 bp, Homo sapiens; identical to SEQ ID NO: 194140
  misc_feature: GYAE6OF01DR5GA.51.29.C07.1.454.CMB.1.raw
  modified_base (118)..(118): a, c, t, g, unknown or other
  misc_feature (118)..(118): n is a, c, g, or t

SEQ ID NO: 194214 - DNA, 117 bp, Homo sapiens; identical to SEQ ID NO: 194173
  misc_feature: GYAE6OF01C9NIN.51.29.C07.1.454.CMB.1.raw
  modified_base (117)..(117): a, c, t, g, unknown or other
  misc_feature (117)..(117): n is a, c, g, or t

SEQ ID NO: 194215 - DNA, 117 bp, Homo sapiens; identical to SEQ ID NO: 194147
  misc_feature: GYAE6OF01BGBN2.51.29.C07.1.454.CMB.1.raw

SEQ ID NO: 194216 - DNA, 117 bp, Homo sapiens; identical to SEQ ID NO: 194147
  misc_feature: GYAE6OF01DFOF3.51.29.C07.1.454.CMB.1.raw

SEQ ID NO: 194217 - DNA, 117 bp, Homo sapiens; identical to SEQ ID NO: 194133
  misc_feature: GYAE6OF01EEVVQ.51.29.C07.1.454.CMB.1.raw
  modified_base (117)..(117): a, c, t, g, unknown or other
  misc_feature (117)..(117): n is a, c, g, or t

SEQ ID NO: 194218 - DNA, 116 bp, Homo sapiens
  misc_feature: GYAE6OF01CQUIR.51.29.C07.1.454.CMB.1.raw
tcagcgatcgtatacacgaccggtgctcgatttagagtgctacgaagggaaagggcagcgtcactctgttcccaccctcctctcgtagcactctgagcggctggcaaggcgcatag

SEQ ID NO: 194219 - DNA, 118 bp, Homo sapiens; identical to SEQ ID NO: 194139
  misc_feature: GYAE6OF01DS28P.51.29.C07.1.454.CMB.1.raw
  modified_base (118)..(118): a, c, t, g, unknown or other
  misc_feature (118)..(118): n is a, c, g, or t

SEQ ID NO: 194220 - DNA, 117 bp, Homo sapiens; identical to SEQ ID NO: 194147
  misc_feature: GYAE6OF01ECO11.51.29.C07.1.454.CMB.1.raw

SEQ ID NO: 194221 - DNA, 118 bp, Homo sapiens; identical to SEQ ID NO: 194140
  misc_feature: GYAE6OF01DDI8A.51.29.C07.1.454.CMB.1.raw
  modified_base (118)..(118): a, c, t, g, unknown or other
  misc_feature (118)..(118): n is a, c, g, or t

SEQ ID NO: 194222 - DNA, 116 bp, Homo sapiens; identical to SEQ ID NO: 194100
  misc_feature: GYAE6OF01DZX0P.51.29.C07.1.454.CMB.1.raw
  modified_base (116)..(116): a, c, t, g, unknown or other
  misc_feature (116)..(116): n is a, c, g, or t

SEQ ID NO: 194223 - DNA, 117 bp, Homo sapiens; identical to SEQ ID NO: 194110
  misc_feature: GYAE6OF01ADNVI.51.29.C07.1.454.CMB.1.raw
  modified_base (117)..(117): a, c, t, g, unknown or other
  misc_feature (117)..(117): n is a, c, g, or t

SEQ ID NO: 194224 - DNA, 116 bp, Homo sapiens
  misc_feature: GYAE6OF01DDOPP.51.29.C07.1.454.CMB.1.raw
tcagcgatcgtatacacgaccggtgctcgatttagagtgctacgaagggaaagggcagcgtcactctgttcccgcctcctctcgtagcactctgagcgggctggcaaggcgcatag

SEQ ID NO: 194225 - DNA, 118 bp, Homo sapiens; identical to SEQ ID NO: 194140
  misc_feature: GYAE6OF01EN0I9.51.29.C07.1.454.CMB.1.raw
  modified_base (118)..(118): a, c, t, g, unknown or other
  misc_feature (118)..(118): n is a, c, g, or t

SEQ ID NO: 194226 - DNA, 118 bp, Homo sapiens; identical to SEQ ID NO: 194171
  misc_feature: GYAE6OF01BBV10.51.29.C07.1.454.CMB.1.raw
  modified_base (116)..(118): a, c, t, g, unknown or other
  misc_feature (116)..(118): n is a, c, g, or t

SEQ ID NO: 194227 - DNA, 124 bp, Homo sapiens
  misc_feature: GYAE6OF01BBK4J.51.29.C07.1.454.CMB.1.raw
  modified_base (118)..(124): a, c, t, g, unknown or other
  misc_feature (118)..(124): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnn

SEQ ID NO: 194228 - DNA, 118 bp, Homo sapiens; identical to SEQ ID NO: 194140
  misc_feature: GYAE6OF01DXIGC.51.29.C07.1.454.CMB.1.raw
  modified_base (118)..(118): a, c, t, g, unknown or other
  misc_feature (118)..(118): n is a, c, g, or t

SEQ ID NO: 194229 - DNA, 118 bp, Homo sapiens; identical to SEQ ID NO: 194140
  misc_feature: GYAE6OF01D189H.51.29.C07.1.454.CMB.1.raw
  modified_base (118)..(118): a, c, t, g, unknown or other
  misc_feature (118)..(118): n is a, c, g, or t

SEQ ID NO: 194230 - DNA, 116 bp, Homo sapiens; identical to SEQ ID NO: 194100
  misc_feature: GYAE6OF01CLDK2.51.29.C07.1.454.CMB.1.raw
  modified_base (116)..(116): a, c, t, g, unknown or other
  misc_feature (116)..(116): n is a, c, g, or t

SEQ ID NO: 194231 - DNA, 126 bp, Homo sapiens
  misc_feature: GYAE6OF01DWVDB.51.29.C07.1.454.CMB.1.raw
  modified_base (115)..(126): a, c, t, g, unknown or other
  misc_feature (115)..(126): n is a, c, g, or t
tcagcgatcgtatacacgaccggtgctcgatttagagtgctacgaagggaagggcagcgtcactctgttcccgcctcctctcgtagcactctgagcggctggcaaggcgcatagnnnnnnnnnnnn

SEQ ID NO: 194232 - DNA, 118 bp, Homo sapiens; identical to SEQ ID NO: 194140
  misc_feature: GYAE6OF01D68RF.51.29.C07.1.454.CMB.1.raw
  modified_base (118)..(118): a, c, t, g, unknown or other
  misc_feature (118)..(118): n is a, c, g, or t

SEQ ID NO: 194233 - DNA, 149 bp, Homo sapiens
  misc_feature: GYAE6OF01DPUEM.51.29.C07.1.454.CMB.1.raw
  modified_base (82)..(82): a, c, t, g, unknown or other
  misc_feature (82)..(82): n is a, c, g, or t
  modified_base (119)..(149): a, c, t, g, unknown or other
  misc_feature (119)..(149): n is a, c, g, or t
tcagcgatcgtatacacgaccggtgctcgatttagagtgctacgaagggaaagggcagcgtcactctgttcccaccctcctntcgtagcactctgagccggctggcaaggcgcataggnnnnnnnnnnnnnnnnnnnnnnnnnnnnnnn

SEQ ID NO: 194234 - DNA, 114 bp, Homo sapiens
  misc_feature: GYAE6OF01CIA4Q.51.29.C07.1.454.CMB.1.raw
tcagcgatcgtatacacgaccggtgctcgatttagagtgctacgaagggaaggcagcgtcactctgttcccaccctcctctcgtagcactctgagcggctggcaaggcgcatag

SEQ ID NO: 194235 - DNA, 132 bp, Homo sapiens
  misc_feature: GYAE6OF01CVGSN.51.29.C07.1.454.CMB.1.raw
  modified_base (116)..(132): a, c, t, g, unknown or other
  misc_feature (116)..(132): n is a, c, g, or t
tcagcgatcgtatacacgaccggtgctcgatttagagtgctacgaagggaagggcagcgtcactctgttcccaccctctctcgtagcactctgagcgggctggcaaggcgcatagnnnnnnnnnnnnnnnnn

SEQ ID NO: 194236 - DNA, 117 bp, Homo sapiens; identical to SEQ ID NO: 194206
  misc_feature: GYAE6OF01BPYAT.51.29.C07.1.454.CMB.1.raw

SEQ ID NO: 194237 - DNA, 133 bp, Homo sapiens
  misc_feature: GYAE6OF01D55OQ.51.29.C07.1.454.CMB.1.raw
  modified_base (119)..(133): a, c, t, g, unknown or other
  misc_feature (119)..(133): n is a, c, g, or t
tcagcgatcgtatacacgaccggtgctcgatttagagtgctacgaagggaaagggcagcgtcactctgttcccgccctcctctcgtagcactcgtgagcgggctggcaaggcgcatagnnnnnnnnnnnnnnn

SEQ ID NO: 194238 - DNA, 117 bp, Homo sapiens; identical to SEQ ID NO: 194206
  misc_feature: GYAE6OF01DFCSD.51.29.C07.1.454.CMB.1.raw

SEQ ID NO: 194239 - DNA, 118 bp, Homo sapiens; identical to SEQ ID NO: 194139
  misc_feature: GYAE6OF01DRJDW.51.29.C07.1.454.CMB.1.raw
  modified_base (118)..(118): a, c, t, g, unknown or other
  misc_feature (118)..(118): n is a, c, g, or t

SEQ ID NO: 194240 - DNA, 136 bp, Homo sapiens
  misc_feature: GYAE6OF01BBKBQ.51.29.C07.1.454.CMB.1.raw
  modified_base (117)..(136): a, c, t, g, unknown or other
  misc_feature (117)..(136): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnnnnn

SEQ ID NO: 194241 - DNA, 118 bp, Homo sapiens; identical to SEQ ID NO: 194140
  misc_feature: GYAE6OF01CKBSA.51.29.C07.1.454.CMB.1.raw
  modified_base (118)..(118): a, c, t, g, unknown or other
  misc_feature (118)..(118): n is a, c, g, or t

SEQ ID NO: 194242 - DNA, 184 bp, Homo sapiens
  misc_feature: GYAE6OF01AZ1TQ.51.29.C07.1.454.CMB.1.raw
  modified_base (159)..(184): a, c, t, g, unknown or other
  misc_feature (159)..(184): n is a, c, g, or t
tcagcgatcgtatacacgaccggtgctcgatttagagtgctacgaagggaagggcacgaccggtgctcgatttagagtgctacgaagggaaagggccagcgtcactctgttcccgccctcctctcgtagcactctgagcgggctggcaaggcgcatagnnnnnnnnnnnnnnnnnnnnnnnnnn

SEQ ID NO: 194243 - DNA, 117 bp, Homo sapiens; identical to SEQ ID NO: 194206
  misc_feature: GYAE6OF01D8KN9.51.29.C07.1.454.CMB.1.raw

SEQ ID NO: 194244 - DNA, 117 bp, Homo sapiens; identical to SEQ ID NO: 194110
  misc_feature: GYAE6OF01E3MTO.51.29.C07.1.454.CMB.1.raw
  modified_base (117)..(117): a, c, t, g, unknown or other
  misc_feature (117)..(117): n is a, c, g, or t

SEQ ID NO: 194245 - DNA, 117 bp, Homo sapiens; identical to SEQ ID NO: 194133
  misc_feature: GYAE6OF01A4IJB.51.29.C07.1.454.CMB.1.raw
  modified_base (117)..(117): a, c, t, g, unknown or other
  misc_feature (117)..(117): n is a, c, g, or t

SEQ ID NO: 194246 - DNA, 113 bp, Homo sapiens
  misc_feature: GYAE6OF01DH40A.51.29.C07.1.454.CMB.1.raw
  modified_base (113)..(113): a, c, t, g, unknown or other
  misc_feature (113)..(113): n is a, c, g, or t
tcagcgatcgtatacacgaccggtgctcgatttagagtgctacgaagggaaggcagcgtcactctgttcccacctcctctcgtagcacctgagcggctggcaaggcgcatagn

SEQ ID NO: 194247 - DNA, 136 bp, Homo sapiens
  misc_feature: GYAE6OF01ATM9Y.51.29.C07.1.454.CMB.1.raw
  modified_base (118)..(136): a, c, t, g, unknown or other
  misc_feature (118)..(136): n is a, c, g, or t
tcagcgatcgtatacacgaccggtgctcgatttagagtgctacgaagggaaagggcgagcgtcactctgttcccgccctcctctcgtagcactctgagcggctggcaaggcgcatagnnnnnnnnnnnnnnnnnnn

SEQ ID NO: 194248 - DNA, 119 bp, Homo sapiens
  misc_feature: GYAE6OF01DIRWM.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaagggcagcgtcactctgttcccacctcctctcgtagcactctgagcgggctggcaaggcgcatagnnnn

SEQ ID NO: 194249 - DNA, 117 bp, Homo sapiens; identical to SEQ ID NO: 194133
  misc_feature: GYAE6OF01B1YRH.51.29.C07.1.454.CMB.1.raw
  modified_base (117)..(117): a, c, t, g, unknown or other
  misc_feature (117)..(117): n is a, c, g, or t

SEQ ID NO: 194250 - DNA, 118 bp, Homo sapiens; identical to SEQ ID NO: 194139
  misc_feature: GYAE6OF01BZUSG.51.29.C07.1.454.CMB.1.raw
  modified_base (118)..(118): a, c, t, g, unknown or other
  misc_feature (118)..(118): n is a, c, g, or t

SEQ ID NO: 194251 - DNA, 115 bp, Homo sapiens; identical to SEQ ID NO: 194097
  misc_feature: GYAE6OF01BPHSQ.51.29.C07.1.454.CMB.1.raw
  modified_base (115)..(115): a, c, t, g, unknown or other
  misc_feature (115)..(115): n is a, c, g, or t

SEQ ID NO: 194252 - DNA, 117 bp, Homo sapiens
  misc_feature: GYAE6OF01CXXJU.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaagggcagcgtcattctgttcccaccctcctctcgtagcactctgagcgggctggcaaggcgcatagn

SEQ ID NO: 194253 - DNA, 115 bp, Homo sapiens; identical to SEQ ID NO: 194191
  misc_feature: GYAE6OF01BOS2J.51.29.C07.1.454.CMB.1.raw

SEQ ID NO: 194254 - DNA, 118 bp, Homo sapiens
  misc_feature: GYAE6OF01DG7UL.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccgccctcctccgtagcactctgagcgggctggcaaggcgcatagnn

SEQ ID NO: 194255 - DNA, 118 bp, Homo sapiens; identical to SEQ ID NO: 194140
  misc_feature: GYAE6OF01BI3M9.51.29.C07.1.454.CMB.1.raw
  modified_base (118)..(118): a, c, t, g, unknown or other
  misc_feature (118)..(118): n is a, c, g, or t

SEQ ID NO: 194256 - DNA, 115 bp, Homo sapiens
  misc_feature: GYAE6OF01E2UF7.51.29.C07.1.454.CMB.1.raw
tcagcgatcgtatacacgaccggtgctcgatttagagtgctacgaagggaagggcagcgtcactctgttcccaccctcctctcgtagcactctgagcggctggcaaggcgcatag

SEQ ID NO: 194257 - DNA, 117 bp, Homo sapiens; identical to SEQ ID NO: 194147
  misc_feature: GYAE6OF01DFKVE.51.29.C07.1.454.CMB.1.raw

SEQ ID NO: 194258 - DNA, 143 bp, Homo sapiens
  misc_feature: GYAE6OF01ET2TD.51.29.C07.1.454.CMB.1.raw
  modified_base (119)..(143): a, c, t, g, unknown or other
  misc_feature (119)..(143): n is a, c, g, or t
tcagcgatcgtatacacgaccggtgctcgatttagagtgctacgaagggaaagggcagcgtcactctgttcccaccctcctctcgtagcactctgacgcggctggccaaggcgcatagnnnnnnnnnnnnnnnnnnnnnnnnn

SEQ ID NO: 194259 - DNA, 130 bp, Homo sapiens
  misc_feature: GYAE6OF01BIP4R.51.29.C07.1.454.CMB.1.raw
  modified_base (117)..(130): a, c, t, g, unknown or other
  misc_feature (117)..(130): n is a, c, g, or t
tcagcgatcgtatacacgaccggtgctcgatttagagtgctacgaagggaaagggcagcgtcactctggttcccgcctcctctcgtagcactctgagcggctggcaaggcgcatagnnnnnnnnnnnnnn

SEQ ID NO: 194260 - DNA, 117 bp, Homo sapiens; identical to SEQ ID NO: 194123
  misc_feature: GYAE6OF01DKWDL.51.29.C07.1.454.CMB.1.raw
  modified_base (117)..(117): a, c, t, g, unknown or other
  misc_feature (117)..(117): n is a, c, g, or t

SEQ ID NO: 194261 - DNA, 116 bp, Homo sapiens
  misc_feature: GYAE6OF01BOZRA.51.29.C07.1.454.CMB.1.raw
tcagcgatcgtatacacgaccggtgctcgatttagagtgctacgaagggaaagggcagcgtcactctgttcccgccctcctctcgtagcactctgagcggctggcaaggcgcatag

SEQ ID NO: 194262 - DNA, 119 bp, Homo sapiens; identical to SEQ ID NO: 194160
  misc_feature: GYAE6OF01A2XT4.51.29.C07.1.454.CMB.1.raw
  modified_base (118)..(119): a, c, t, g, unknown or other
  misc_feature (118)..(119): n is a, c, g, or t

SEQ ID NO: 194263 - DNA, 118 bp, Homo sapiens; identical to SEQ ID NO: 194149
  misc_feature: GYAE6OF01BTA33.51.29.C07.1.454.CMB.1.raw
  modified_base (117)..(118): a, c, t, g, unknown or other
  misc_feature (117)..(118): n is a, c, g, or t

SEQ ID NO: 194264 - DNA, 116 bp, Homo sapiens; identical to SEQ ID NO: 194100
  misc_feature: GYAE6OF01DCZ39.51.29.C07.1.454.CMB.1.raw
  modified_base (116)..(116): a, c, t, g, unknown or other
  misc_feature (116)..(116): n is a, c, g, or t

SEQ ID NO: 194265 - DNA, 118 bp, Homo sapiens; identical to SEQ ID NO: 194139
  misc_feature: GYAE6OF01BRAA4.51.29.C07.1.454.CMB.1.raw
  modified_base (118)..(118): a, c, t, g, unknown or other
  misc_feature (118)..(118): n is a, c, g, or t

SEQ ID NO: 194266 - DNA, 118 bp, Homo sapiens; identical to SEQ ID NO: 194140
  misc_feature: GYAE6OF01BHB0R.51.29.C07.1.454.CMB.1.raw
  modified_base (118)..(118): a, c, t, g, unknown or other
  misc_feature (118)..(118): n is a, c, g, or t

SEQ ID NO: 194267 - DNA, 116 bp, Homo sapiens; identical to SEQ ID NO: 194100
  misc_feature: GYAE6OF01BTXKR.51.29.C07.1.454.CMB.1.raw
  modified_base (116)..(116): a, c, t, g, unknown or other
  misc_feature (116)..(116): n is a, c, g, or t

SEQ ID NO: 194268 - DNA, 117 bp, Homo sapiens; identical to SEQ ID NO: 194133
  misc_feature: GYAE6OF01A7FAO.51.29.C07.1.454.CMB.1.raw
  modified_base (117)..(117): a, c, t, g, unknown or other
  misc_feature (117)..(117): n is a, c, g, or t

SEQ ID NO: 194269 - DNA, 116 bp, Homo sapiens
  misc_feature: GYAE6OF01C4L5V.51.29.C07.1.454.CMB.1.raw
tcagcgatcgtatacacgaccggtgctcgatttagagtgctacgaagggaagggcagcgtcactctgttcccaccctcctctcgtagcactctgagcgggctggcaaggcgcatag

SEQ ID NO: 194270 - DNA, 118 bp, Homo sapiens; identical to SEQ ID NO: 194140
  misc_feature: GYAE6OF01D1VYW.51.29.C07.1.454.CMB.1.raw
  modified_base (118)..(118): a, c, t, g, unknown or other
  misc_feature (118)..(118): n is a, c, g, or t

SEQ ID NO: 194271 - DNA, 117 bp, Homo sapiens; identical to SEQ ID NO: 194133
  misc_feature: GYAE6OF01CDLRF.51.29.C07.1.454.CMB.1.raw
  modified_base (117)..(117): a, c, t, g, unknown or other
  misc_feature (117)..(117): n is a, c, g, or t

SEQ ID NO: 194272 - DNA, 121 bp, Homo sapiens
  misc_feature: GYAE6OF01DCKDC.51.29.C07.1.454.CMB.1.raw
  modified_base (117)..(121): a, c, t, g, unknown or other
  misc_feature (117)..(121): n is a, c, g, or t
tcagcgatcgtatacacgaccggtgctcgatttagagtgctacgaagggaaaggcagcgtcactctgttctcgccctcctctcgtagcactctgagcgggctggcaaggcgcatagnnnnn

SEQ ID NO: 194273 - DNA, 117 bp, Homo sapiens; identical to SEQ ID NO: 194110
  misc_feature: GYAE6OF01DAOZ9.51.29.C07.1.454.CMB.1.raw
  modified_base (117)..(117): a, c, t, g, unknown or other
  misc_feature (117)..(117): n is a, c, g, or t

SEQ ID NO: 194274 - DNA, 118 bp, Homo sapiens; identical to SEQ ID NO: 194139
  misc_feature: GYAE6OF01DHJC6.51.29.C07.1.454.CMB.1.raw
  modified_base (118)..(118): a, c, t, g, unknown or other
  misc_feature (118)..(118): n is a, c, g, or t

SEQ ID NO: 194275 - DNA, 118 bp, Homo sapiens; identical to SEQ ID NO: 194139
  misc_feature: GYAE6OF01DVKOV.51.29.C07.1.454.CMB.1.raw
  modified_base (118)..(118): a, c, t, g, unknown or other
  misc_feature (118)..(118): n is a, c, g, or t

SEQ ID NO: 194276 - DNA, 129 bp, Homo sapiens
  misc_feature: GYAE6OF01EEF4Y.51.29.C07.1.454.CMB.1.raw
  modified_base (117)..(129): a, c, t, g, unknown or other
  misc_feature (117)..(129): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnnnnn

SEQ ID NO: 194277 - DNA, 118 bp, Homo sapiens; identical to SEQ ID NO: 194139
  misc_feature: GYAE6OF01B7CDK.51.29.C07.1.454.CMB.1.raw
  modified_base (118)..(118): a, c, t, g, unknown or other
  misc_feature (118)..(118): n is a, c, g, or t

SEQ ID NO: 194278 - DNA, 118 bp, Homo sapiens
  misc_feature: GYAE6OF01DA8VQ.51.29.C07.1.454.CMB.1.raw
  modified_base (115)..(118): a, c, t, g, unknown or other
  misc_feature (115)..(118): n is a, c, g, or t
tcagcgatcgtatacacgaccggtgctcgatttagagtgctacgaagggaaggcagcgtcactctgttcccgccctcctctcgtagcactctgagcggctggcaaggcgcatagnnnn

SEQ ID NO: 194279 - DNA, 118 bp, Homo sapiens; identical to SEQ ID NO: 194140
  misc_feature: GYAE6OF01DHN6O.51.29.C07.1.454.CMB.1.raw
  modified_base (118)..(118): a, c, t, g, unknown or other
  misc_feature (118)..(118): n is a, c, g, or t

SEQ ID NO: 194280 - DNA, 118 bp, Homo sapiens; identical to SEQ ID NO: 194139
  misc_feature: GYAE6OF01CZC18.51.29.C07.1.454.CMB.1.raw
  modified_base (118)..(118): a, c, t, g, unknown or other
  misc_feature (118)..(118): n is a, c, g, or t

SEQ ID NO: 194281 - DNA, 118 bp, Homo sapiens
  misc_feature: GYAE6OF01DHSQ1.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnn

SEQ ID NO: 194282 - DNA, 118 bp, Homo sapiens; identical to SEQ ID NO: 194140
  misc_feature: GYAE6OF01BKBAT.51.29.C07.1.454.CMB.1.raw
  modified_base (118)..(118): a, c, t, g, unknown or other
  misc_feature (118)..(118): n is a, c, g, or t

SEQ ID NO: 194283 - DNA, 141 bp, Homo sapiens
  misc_feature: GYAE6OF01A7EZY.51.29.C07.1.454.CMB.1.raw
  modified_base (114)..(141): a, c, t, g, unknown or other
  misc_feature (114)..(141): n is a, c, g, or t
tcagcgatcgtatacacgaccggtgctcgatttagagtgctacgaagggaagggcagcgtcactctgttcccacctctctcgtagcactctgagcggctggcaaggcgcatagnnnnnnnnnnnnnnnnnnnnnnnnnnnn

SEQ ID NO: 194284 - DNA, 116 bp, Homo sapiens; identical to SEQ ID NO: 194261
  misc_feature: GYAE6OF01CM1YH.51.29.C07.1.454.CMB.1.raw

SEQ ID NO: 194285 - DNA, 116 bp, Homo sapiens
  misc_feature: GYAE6OF01BGLXC.51.29.C07.1.454.CMB.1.raw
  modified_base (115)..(116): a, c, t, g, unknown or other
  misc_feature (115)..(116): n is a, c, g, or t
tcagcgatcgtatacacgaccggtgctcgatttagagtgctacgaagggaaggcagcgtcactctgttcccaccctcctctcgtagcactctgagcggctggcaaggcgcatagnn

SEQ ID NO: 194286 - DNA, 118 bp, Homo sapiens; identical to SEQ ID NO: 194140
  misc_feature: GYAE6OF01D8AG5.51.29.C07.1.454.CMB.1.raw
  modified_base (118)..(118): a, c, t, g, unknown or other
  misc_feature (118)..(118): n is a, c, g, or t

SEQ ID NO: 194287 - DNA, 118 bp, Homo sapiens; identical to SEQ ID NO: 194139
  misc_feature: GYAE6OF01AL08E.51.29.C07.1.454.CMB.1.raw
  modified_base (118)..(118): a, c, t, g, unknown or other
  misc_feature (118)..(118): n is a, c, g, or t

SEQ ID NO: 194288 - DNA, 117 bp, Homo sapiens; identical to SEQ ID NO: 194133
  misc_feature: GYAE6OF01DYQDJ.51.29.C07.1.454.CMB.1.raw
  modified_base (117)..(117): a, c, t, g, unknown or other
  misc_feature (117)..(117): n is a, c, g, or t

SEQ ID NO: 194289 - DNA, 120 bp, Homo sapiens
  misc_feature: GYAE6OF01DL20R.51.29.C07.1.454.CMB.1.raw
  modified_base (118)..(120): a, c, t, g, unknown or other
  misc_feature (118)..(120): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnn

SEQ ID NO: 194290 - DNA, 118 bp, Homo sapiens; identical to SEQ ID NO: 194140
  misc_feature: GYAE6OF01D8Z82.51.29.C07.1.454.CMB.1.raw
  modified_base (118)..(118): a, c, t, g, unknown or other
  misc_feature (118)..(118): n is a, c, g, or t

SEQ ID NO: 194291 - DNA, 118 bp, Homo sapiens; identical to SEQ ID NO: 194139
  misc_feature: GYAE6OF01BO2BG.51.29.C07.1.454.CMB.1.raw
  modified_base (118)..(118): a, c, t, g, unknown or other
  misc_feature (118)..(118): n is a, c, g, or t

SEQ ID NO: 194292 - DNA, 117 bp, Homo sapiens; identical to SEQ ID NO: 194133
  misc_feature: GYAE6OF01B7EQX.51.29.C07.1.454.CMB.1.raw
  modified_base (117)..(117): a, c, t, g, unknown or other
  misc_feature (117)..(117): n is a, c, g, or t

SEQ ID NO: 194293 - DNA, 115 bp, Homo sapiens; identical to SEQ ID NO: 194097
  misc_feature: GYAE6OF01A0HNV.51.29.C07.1.454.CMB.1.raw
  modified_base (115)..(115): a, c, t, g, unknown or other
  misc_feature (115)..(115): n is a, c, g, or t

SEQ ID NO: 194294 - DNA, 117 bp, Homo sapiens; identical to SEQ ID NO: 194110
  misc_feature: GYAE6OF01E2XE0.51.29.C07.1.454.CMB.1.raw
  modified_base (117)..(117): a, c, t, g, unknown or other
  misc_feature (117)..(117): n is a, c, g, or t

SEQ ID NO: 194295 - DNA, 124 bp, Homo sapiens
  misc_feature: GYAE6OF01B24HW.51.29.C07.1.454.CMB.1.raw
  modified_base (117)..(124): a, c, t, g, unknown or other
  misc_feature (117)..(124): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnnnnnnnn

SEQ ID NO: 194296 - DNA, 115 bp, Homo sapiens; identical to SEQ ID NO: 194191
  misc_feature: GYAE6OF01BUANC.51.29.C07.1.454.CMB.1.raw

SEQ ID NO: 194297 - DNA, 114 bp, Homo sapiens
  misc_feature: GYAE6OF01AH6H7.51.29.C07.1.454.CMB.1.raw
  modified_base (114)..(114): a, c, t, g, unknown or other
  misc_feature (114)..(114): n is a, c, g, or t
tcagcgatcgtatacacgaccggtgctcgatttagagtgctacgaaggaagggcagcgtcactctgttcccgcctcctctcgtagcactctgagcggctggcaaggcgcatagn

SEQ ID NO: 194298 - DNA, 117 bp, Homo sapiens; identical to SEQ ID NO: 194133
  misc_feature: GYAE6OF01B5VW3.51.29.C07.1.454.CMB.1.raw
  modified_base (117)..(117): a, c, t, g, unknown or other
  misc_feature (117)..(117): n is a, c, g, or t

SEQ ID NO: 194299 - DNA, 118 bp, Homo sapiens; identical to SEQ ID NO: 194139
  misc_feature: GYAE6OF01ENC03.51.29.C07.1.454.CMB.1.raw
  modified_base (118)..(118): a, c, t, g, unknown or other
  misc_feature (118)..(118): n is a, c, g, or t

SEQ ID NO: 194300 - DNA, 118 bp, Homo sapiens; identical to SEQ ID NO: 194140
  misc_feature: GYAE6OF01EDWYY.51.29.C07.1.454.CMB.1.raw
  modified_base (118)..(118): a, c, t, g, unknown or other
  misc_feature (118)..(118): n is a, c, g, or t

SEQ ID NO: 194301 - DNA, 136 bp, Homo sapiens
  misc_feature: GYAE6OF01ESW4X.51.29.C07.1.454.CMB.1.raw
  modified_base (119)..(136): a, c, t, g, unknown or other
  misc_feature (119)..(136): n is a, c, g, or t
tcagcgatcgtatacacgaccggtgctcgatttagagtgctacgaagggaaagggcgagcgtcactctgttcccgccctcctctcgtagcactctgagcgggctggcaaggcgcatagnnnnnnnnnnnnnnnnnn

SEQ ID NO: 194302 - DNA, 119 bp, Homo sapiens; identical to SEQ ID NO: 194160
  misc_feature: GYAE6OF01DN0F2.51.29.C07.1.454.CMB.1.raw
  modified_base (118)..(119): a, c, t, g, unknown or other
  misc_feature (118)..(119): n is a, c, g, or t

SEQ ID NO: 194303 - DNA, 115 bp, Homo sapiens
  misc_feature: GYAE6OF01AG7O3.51.29.C07.1.454.CMB.1.raw
tcagcgatcgtatacacgaccggtgctcgatttagagtgctacgaaggaagggcagcgtcactctgttcccgccctcctctcgtagcactctgagcgggctggcaaggcgcatag

SEQ ID NO: 194304 - DNA, 134 bp, Homo sapiens
  misc_feature: GYAE6OF01EFU7X.51.29.C07.1.454.CMB.1.raw
  modified_base (118)..(134): a, c, t, g, unknown or other
  misc_feature (118)..(134): n is a, c, g, or t
tcagcgatcgtatacacgaccggtgctcgatttagagtgctacgaagggaaagggcagcgtcgactctgttcccaccctctctcgtagccactctgagcggctggcaaggcgcatagnnnnnnnnnnnnnnnnn

SEQ ID NO: 194305 - DNA, 118 bp, Homo sapiens; identical to SEQ ID NO: 194139
  misc_feature: GYAE6OF01DV7C8.51.29.C07.1.454.CMB.1.raw
  modified_base (118)..(118): a, c, t, g, unknown or other
  misc_feature (118)..(118): n is a, c, g, or t

SEQ ID NO: 194306 - DNA, 116 bp, Homo sapiens; identical to SEQ ID NO: 194261
  misc_feature: GYAE6OF01DYQ1X.51.29.C07.1.454.CMB.1.raw

SEQ ID NO: 194307 - DNA, 118 bp, Homo sapiens; identical to SEQ ID NO: 194139
  misc_feature: GYAE6OF01D79VX.51.29.C07.1.454.CMB.1.raw
  modified_base (118)..(118): a, c, t, g, unknown or other
  misc_feature (118)..(118): n is a, c, g, or t

SEQ ID NO: 194308 - DNA, 143 bp, Homo sapiens
  misc_feature: GYAE6OF01EBXO9.51.29.C07.1.454.CMB.1.raw
  modified_base (120)..(143): a, c, t, g, unknown or other
  misc_feature (120)..(143): n is a, c, g, or t
tcagcgatcgtatacacgaccggtgctcgatttagagtgctacgaagggaaagggcagcgtcactctgttcccgccctcctctcgtagcactctgagcgggctggccaaggcgcattagnnnnnnnnnnnnnnnnnnnnnnnn

SEQ ID NO: 194309 - DNA, 118 bp, Homo sapiens; identical to SEQ ID NO: 194140
  misc_feature: GYAE6OF01EB77F.51.29.C07.1.454.CMB.1.raw
  modified_base (118)..(118): a, c, t, g, unknown or other
  misc_feature (118)..(118): n is a, c, g, or t

SEQ ID NO: 194310 - DNA, 116 bp, Homo sapiens; identical to SEQ ID NO: 194100
  misc_feature: GYAE6OF01CMK93.51.29.C07.1.454.CMB.1.raw
  modified_base (116)..(116): a, c, t, g, unknown or other
  misc_feature (116)..(116): n is a, c, g, or t

SEQ ID NO: 194311 - DNA, 117 bp, Homo sapiens; identical to SEQ ID NO: 194133
  misc_feature: GYAE6OF01CP6AE.51.29.C07.1.454.CMB.1.raw
  modified_base (117)..(117): a, c, t, g, unknown or other
  misc_feature (117)..(117): n is a, c, g, or t

SEQ ID NO: 194312 - DNA, 120 bp, Homo sapiens
  misc_feature: GYAE6OF01BAHM8.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnn

SEQ ID NO: 194313 - DNA, 118 bp, Homo sapiens; identical to SEQ ID NO: 194140
  misc_feature: GYAE6OF01EYXQ9.51.29.C07.1.454.CMB.1.raw
  modified_base (118)..(118): a, c, t, g, unknown or other
  misc_feature (118)..(118): n is a, c, g, or t

SEQ ID NO: 194314 - DNA, 119 bp, Homo sapiens
  misc_feature: GYAE6OF01A6WYX.51.29.C07.1.454.CMB.1.raw
  modified_base (115)..(119): a, c, t, g, unknown or other
  misc_feature (115)..(119): n is a, c, g, or t
tcagcgatcgtatacacgaccggtgctcgatttagagtgctacgaagggaagggcagcgtcactctgttcccacctctctcgtagcactctgagcgggctggcaaggcgcatagnnnnn

SEQ ID NO: 194315 - DNA, 117 bp, Homo sapiens; identical to SEQ ID NO: 194133
  misc_feature: GYAE6OF01BPIEM.51.29.C07.1.454.CMB.1.raw
  modified_base (117)..(117): a, c, t, g, unknown or other
  misc_feature (117)..(117): n is a, c, g, or t

SEQ ID NO: 194316 - DNA, 119 bp, Homo sapiens
  misc_feature: GYAE6OF01A1ZVY.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnn

SEQ ID NO: 194317 - DNA, 117 bp, Homo sapiens; identical to SEQ ID NO: 194110
  misc_feature: GYAE6OF01DE943.51.29.C07.1.454.CMB.1.raw
  modified_base (117)..(117): a, c, t, g, unknown or other
  misc_feature (117)..(117): n is a, c, g, or t

SEQ ID NO: 194318 - DNA, 149 bp, Homo sapiens
  misc_feature: GYAE6OF01EEFRB.51.29.C07.1.454.CMB.1.raw
  modified_base (120)..(149): a, c, t, g, unknown or other
  misc_feature (120)..(149): n is a, c, g, or t
tcagcgatcgtatacacgaccggtgctcgatttagagtgctacgaagggaaaggcagcggtcaactctcgttcccaccctcctctccgtagcactctgagcggctggcaaggcgcatagnnnnnnnnnnnnnnnnnnnnnnnnnnnnnn

SEQ ID NO: 194319 - DNA, 120 bp, Homo sapiens
  misc_feature: GYAE6OF01CCXT5.51.29.C07.1.454.CMB.1.raw
  modified_base (116)..(120): a, c, t, g, unknown or other
  misc_feature (116)..(120): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnnn

SEQ ID NO: 194320 - DNA, 118 bp, Homo sapiens; identical to SEQ ID NO: 194149
  misc_feature: GYAE6OF01A3OO6.51.29.C07.1.454.CMB.1.raw
  modified_base (117)..(118): a, c, t, g, unknown or other
  misc_feature (117)..(118): n is a, c, g, or t

SEQ ID NO: 194321 - DNA, 118 bp, Homo sapiens; identical to SEQ ID NO: 194139
  misc_feature: GYAE6OF01EBP0V.51.29.C07.1.454.CMB.1.raw
  modified_base (118)..(118): a, c, t, g, unknown or other
  misc_feature (118)..(118): n is a, c, g, or t

SEQ ID NO: 194322 - DNA, 117 bp, Homo sapiens; identical to SEQ ID NO: 194133
  misc_feature: GYAE6OF01AQ6YV.51.29.C07.1.454.CMB.1.raw
  modified_base (117)..(117): a, c, t, g, unknown or other
  misc_feature (117)..(117): n is a, c, g, or t

SEQ ID NO: 194323 - DNA, 133 bp, Homo sapiens
  misc_feature: GYAE6OF01D1FKV.51.29.C07.1.454.CMB.1.raw
  modified_base (118)..(133): a, c, t, g, unknown or other
  misc_feature (118)..(133): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnn

SEQ ID NO: 194324 - DNA, 115 bp, Homo sapiens; identical to SEQ ID NO: 194191
  misc_feature: GYAE6OF01AXFCS.51.29.C07.1.454.CMB.1.raw

SEQ ID NO: 194325 - DNA, 119 bp, Homo sapiens; identical to SEQ ID NO: 194137
  misc_feature: GYAE6OF01E4E86.51.29.C07.1.454.CMB.1.raw
  modified_base (118)..(119): a, c, t, g, unknown or other
  misc_feature (118)..(119): n is a, c, g, or t

SEQ ID NO: 194326 - DNA, 125 bp, Homo sapiens
  misc_feature: GYAE6OF01AM9CQ.51.29.C07.1.454.CMB.1.raw
  modified_base (118)..(125): a, c, t, g, unknown or other
  misc_feature (118)..(125): n is a, c, g, or t
tcagcgatcgtatacacgaccggtgctcgatttagagtgctacgaagggaagggcagcgtcactctgttcccaccctcctctcgtagcactcctgagcgggctggcaaggcgcatagnnnnnnnn

SEQ ID NO: 194327 - DNA, 163 bp, Homo sapiens
  misc_feature: GYAE6OF01D7LFN.51.29.C07.1.454.CMB.1.raw
  modified_base (123)..(163): a, c, t, g, unknown or other
  misc_feature (123)..(163): n is a, c, g, or t
tcagcgatcgtatacacgaccggtgctcgatttagagtgctacgaagggtaagggtcgaagcgtcacctgtgttcccaccctcctctcgtagcactctgagccggctggcaaggtcgcatagnnnnnnnnnnnnnnnnnnnnnnnnnnnnnnnnnnnnnnnnn

SEQ ID NO: 194328 - DNA, 118 bp, Homo sapiens; identical to SEQ ID NO: 194171
  misc_feature: GYAE6OF01CFS8F.51.29.C07.1.454.CMB.1.raw
  modified_base (116)..(118): a, c, t, g, unknown or other
  misc_feature (116)..(118): n is a, c, g, or t

SEQ ID NO: 194329 - DNA, 117 bp, Homo sapiens; identical to SEQ ID NO: 194147
  misc_feature: GYAE6OF01AJUHC.51.29.C07.1.454.CMB.1.raw

SEQ ID NO: 194330 - DNA, 117 bp, Homo sapiens; identical to SEQ ID NO: 194206
  misc_feature: GYAE6OF01AWD7O.51.29.C07.1.454.CMB.1.raw

SEQ ID NO: 194331 - DNA, 117 bp, Homo sapiens; identical to SEQ ID NO: 194133
  misc_feature: GYAE6OF01AX4CX.51.29.C07.1.454.CMB.1.raw
  modified_base (117)..(117): a, c, t, g, unknown or other
  misc_feature (117)..(117): n is a, c, g, or t

SEQ ID NO: 194332 - DNA, 118 bp, Homo sapiens; identical to SEQ ID NO: 194140
  misc_feature: GYAE6OF01DKZTS.51.29.C07.1.454.CMB.1.raw
  modified_base (118)..(118): a, c, t, g, unknown or other
  misc_feature (118)..(118): n is a, c, g, or t

SEQ ID NO: 194333 - DNA, 118 bp, Homo sapiens; identical to SEQ ID NO: 194149
  misc_feature: GYAE6OF01ANHFO.51.29.C07.1.454.CMB.1.raw
  modified_base (117)..(118): a, c, t, g, unknown or other
  misc_feature (117)..(118): n is a, c, g, or t

SEQ ID NO: 194334 - DNA, 118 bp, Homo sapiens; identical to SEQ ID NO: 194281
  misc_feature: GYAE6OF01A8KYJ.51.29.C07.1.454.CMB.1.raw
  modified_base (117)..(118): a, c, t, g, unknown or other
  misc_feature (117)..(118): n is a, c, g, or t

SEQ ID NO: 194335 - DNA, 118 bp, Homo sapiens; identical to SEQ ID NO: 194140
  misc_feature: GYAE6OF01EDY6O.51.29.C07.1.454.CMB.1.raw
  modified_base (118)..(118): a, c, t, g, unknown or other
  misc_feature (118)..(118): n is a, c, g, or t

SEQ ID NO: 194336 - DNA, 119 bp, Homo sapiens; identical to SEQ ID NO: 194316
  misc_feature: GYAE6OF01B5TBJ.51.29.C07.1.454.CMB.1.raw
  modified_base (117)..(119): a, c, t, g, unknown or other
  misc_feature (117)..(119): n is a, c, g, or t

SEQ ID NO: 194337 - DNA, 117 bp, Homo sapiens; identical to SEQ ID NO: 194110
  misc_feature: GYAE6OF01AZTRW.51.29.C07.1.454.CMB.1.raw
  modified_base (117)..(117): a, c, t, g, unknown or other
  misc_feature (117)..(117): n is a, c, g, or t

SEQ ID NO: 194338 - DNA, 118 bp, Homo sapiens; identical to SEQ ID NO: 194139
  misc_feature: GYAE6OF01D88DY.51.29.C07.1.454.CMB.1.raw
  modified_base (118)..(118): a, c, t, g, unknown or other
  misc_feature (118)..(118): n is a, c, g, or t

SEQ ID NO: 194339 - DNA, 117 bp, Homo sapiens; identical to SEQ ID NO: 194173
  misc_feature: GYAE6OF01CGZUM.51.29.C07.1.454.CMB.1.raw
  modified_base (117)..(117): a, c, t, g, unknown or other
  misc_feature (117)..(117): n is a, c, g, or t

SEQ ID NO: 194340 - DNA, 116 bp, Homo sapiens; identical to SEQ ID NO: 194218
  misc_feature: GYAE6OF01EC18A.51.29.C07.1.454.CMB.1.raw

SEQ ID NO: 194341 - DNA, 117 bp, Homo sapiens; identical to SEQ ID NO: 194206
  misc_feature: GYAE6OF01DYXGZ.51.29.C07.1.454.CMB.1.raw

SEQ ID NO: 194342 - DNA, 122 bp, Homo sapiens
  misc_feature: GYAE6OF01BV8XA.51.29.C07.1.454.CMB.1.raw
  modified_base (115)..(122): a, c, t, g, unknown or other
  misc_feature (115)..(122): n is a, c, g, or t
tcagcgatcgtatacacgaccggtgctcgatttagagtgctacgaagggaagggcagcgtcactctgttcccgcctcctctcgtagcactctgagcggctggcaaggcgcatagnnnnnnnn

SEQ ID NO: 194343 - DNA, 118 bp, Homo sapiens; identical to SEQ ID NO: 194139
  misc_feature: GYAE6OF01E6BQA.51.29.C07.1.454.CMB.1.raw
  modified_base (118)..(118): a, c, t, g, unknown or other
  misc_feature (118)..(118): n is a, c, g, or t

SEQ ID NO: 194344 - DNA, 118 bp, Homo sapiens; identical to SEQ ID NO: 194140
  misc_feature: GYAE6OF01CWZMI.51.29.C07.1.454.CMB.1.raw
  modified_base (118)..(118): a, c, t, g, unknown or other
  misc_feature (118)..(118): n is a, c, g, or t

SEQ ID NO: 194345 - DNA, 164 bp, Homo sapiens
  misc_feature: GYAE6OF01BHXCN.51.29.C07.1.454.CMB.1.raw
  modified_base (118)..(164): a, c, t, g, unknown or other
  misc_feature (118)..(164): n is a, c, g, or t
tcagcgatcgtatacacgaccggtgctcgatttagagtgctacgaagggaaaggcagacggtcactctgttcccacctcctctcgtagcactctgagcgggctggcaaggcgcatagnnnnnnnnnnnnnnnnnnnnnnnnnnnnnnnnnnnnnnnnnnnnnnn

SEQ ID NO: 194346 - DNA, 117 bp, Homo sapiens; identical to SEQ ID NO: 194110
  misc_feature: GYAE6OF01AQRC0.51.29.C07.1.454.CMB.1.raw
  modified_base (117)..(117): a, c, t, g, unknown or other
  misc_feature (117)..(117): n is a, c, g, or t

SEQ ID NO: 194347 - DNA, 117 bp, Homo sapiens; identical to SEQ ID NO: 194133
  misc_feature: GYAE6OF01DJSZB.51.29.C07.1.454.CMB.1.raw
  modified_base (117)..(117): a, c, t, g, unknown or other
  misc_feature (117)..(117): n is a, c, g, or t

SEQ ID NO: 194348 - DNA, 118 bp, Homo sapiens; identical to SEQ ID NO: 194140
  misc_feature: GYAE6OF01AFIIO.51.29.C07.1.454.CMB.1.raw
  modified_base (118)..(118): a, c, t, g, unknown or other
  misc_feature (118)..(118): n is a, c, g, or t

SEQ ID NO: 194349 - DNA, 118 bp, Homo sapiens; identical to SEQ ID NO: 194139
  misc_feature: GYAE6OF01DX3NU.51.29.C07.1.454.CMB.1.raw
  modified_base (118)..(118): a, c, t, g, unknown or other
  misc_feature (118)..(118): n is a, c, g, or t

SEQ ID NO: 194350 - DNA, 118 bp, Homo sapiens; identical to SEQ ID NO: 194140
  misc_feature: GYAE6OF01DZ8FB.51.29.C07.1.454.CMB.1.raw
  modified_base (118)..(118): a, c, t, g, unknown or other
  misc_feature (118)..(118): n is a, c, g, or t

SEQ ID NO: 194351 - DNA, 118 bp, Homo sapiens
  misc_feature: GYAE6OF01C4N8H.51.29.C07.1.454.CMB.1.raw
  modified_base (116)..(118): a, c, t, g, unknown or other
  misc_feature (116)..(118): n is a, c, g, or t
tcagcgatcgtatacacgaccggtgctcgatttagagtgctacgaaggaagggcagcgtcactctgttcccgccctcctctcgtagcactctgagcgggctggcaaggcgcatagnnn

SEQ ID NO: 194352 - DNA, 121 bp, Homo sapiens
  misc_feature: GYAE6OF01CBTX6.51.29.C07.1.454.CMB.1.raw
  modified_base (118)..(121): a, c, t, g, unknown or other
  misc_feature (118)..(121): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnn

SEQ ID NO: 194353 - DNA, 122 bp, Homo sapiens
  misc_feature: GYAE6OF01AQULJ.51.29.C07.1.454.CMB.1.raw
  modified_base (119)..(122): a, c, t, g, unknown or other
  misc_feature (119)..(122): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnn

SEQ ID NO: 194354 - DNA, 118 bp, Homo sapiens; identical to SEQ ID NO: 194140
  misc_feature: GYAE6OF01BA979.51.29.C07.1.454.CMB.1.raw
  modified_base (118)..(118): a, c, t, g, unknown or other
  misc_feature (118)..(118): n is a, c, g, or t

SEQ ID NO: 194355 - DNA, 117 bp, Homo sapiens; identical to SEQ ID NO: 194133
  misc_feature: GYAE6OF01BR3GX.51.29.C07.1.454.CMB.1.raw
  modified_base (117)..(117): a, c, t, g, unknown or other
  misc_feature (117)..(117): n is a, c, g, or t

SEQ ID NO: 194356 - DNA, 117 bp, Homo sapiens; identical to SEQ ID NO: 194206
  misc_feature: GYAE6OF01DJAII.51.29.C07.1.454.CMB.1.raw

SEQ ID NO: 194357 - DNA, 115 bp, Homo sapiens
  misc_feature: GYAE6OF01EF66I.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaagggcagcgtcactctgttcccacctcctctcgtagcactctgagcggctggcaaggcgcatagn

SEQ ID NO: 194358 - DNA, 118 bp, Homo sapiens; identical to SEQ ID NO: 194140
  misc_feature: GYAE6OF01AVA21.51.29.C07.1.454.CMB.1.raw
  modified_base (118)..(118): a, c, t, g, unknown or other
  misc_feature (118)..(118): n is a, c, g, or t

SEQ ID NO: 194359 - DNA, 118 bp, Homo sapiens; identical to SEQ ID NO: 194140
  misc_feature: GYAE6OF01DW6D2.51.29.C07.1.454.CMB.1.raw
  modified_base (118)..(118): a, c, t, g, unknown or other
  misc_feature (118)..(118): n is a, c, g, or t

SEQ ID NO: 194360 - DNA, 117 bp, Homo sapiens
  misc_feature: GYAE6OF01DB8CV.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaagggcagcgtcactctgttcccacctcctctcgtagcactctgagcgggctggcaaggcgcatagnn

SEQ ID NO: 194361 - DNA, 117 bp, Homo sapiens; identical to SEQ ID NO: 194206
  misc_feature: GYAE6OF01BOTMH.51.29.C07.1.454.CMB.1.raw

SEQ ID NO: 194362 - DNA, 118 bp, Homo sapiens; identical to SEQ ID NO: 194149
  misc_feature: GYAE6OF01BB1ZJ.51.29.C07.1.454.CMB.1.raw
  modified_base (117)..(118): a, c, t, g, unknown or other
  misc_feature (117)..(118): n is a, c, g, or t

SEQ ID NO: 194363 - DNA, 118 bp, Homo sapiens; identical to SEQ ID NO: 194140
  misc_feature: GYAE6OF01B5ALP.51.29.C07.1.454.CMB.1.raw
  modified_base (118)..(118): a, c, t, g, unknown or other
  misc_feature (118)..(118): n is a, c, g, or t

SEQ ID NO: 194364 - DNA, 160 bp, Homo sapiens
  misc_feature: GYAE6OF01CT7W2.51.29.C07.1.454.CMB.1.raw
  modified_base (159)..(160): a, c, t, g, unknown or other
  misc_feature (159)..(160): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnn

SEQ ID NO: 194365 - DNA, 120 bp, Homo sapiens
  misc_feature: GYAE6OF01BE1ZL.51.29.C07.1.454.CMB.1.raw
  modified_base (118)..(120): a, c, t, g, unknown or other
  misc_feature (118)..(120): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnn

SEQ ID NO: 194366 - DNA, 147 bp, Homo sapiens
  misc_feature: GYAE6OF01D6C80.51.29.C07.1.454.CMB.1.raw
  modified_base (120)..(147): a, c, t, g, unknown or other
  misc_feature (120)..(147): n is a, c, g, or t
tcagcgatcgtatacacgaccggtgctcgatttagagtgctacgaagggaaagggtcgagcgtcactctgttcccgccctcctctcgtagcactctgagcgggctggcaaggcgcatagnnnnnnnnnnnnnnnnnnnnnnnnnnnn

SEQ ID NO: 194367 - DNA, 117 bp, Homo sapiens; identical to SEQ ID NO: 194206
  misc_feature: GYAE6OF01EJM8H.51.29.C07.1.454.CMB.1.raw

SEQ ID NO: 194368 - DNA, 116 bp, Homo sapiens; identical to SEQ ID NO: 194261
  misc_feature: GYAE6OF01DEANS.51.29.C07.1.454.CMB.1.raw

SEQ ID NO: 194369 - DNA, 117 bp, Homo sapiens; identical to SEQ ID NO: 194173
  misc_feature: GYAE6OF01ANPCW.51.29.C07.1.454.CMB.1.raw
  modified_base (117)..(117): a, c, t, g, unknown or other
  misc_feature (117)..(117): n is a, c, g, or t

SEQ ID NO: 194370 - DNA, 116 bp, Homo sapiens; identical to SEQ ID NO: 194100
  misc_feature: GYAE6OF01CT8OZ.51.29.C07.1.454.CMB.1.raw
  modified_base (116)..(116): a, c, t, g, unknown or other
  misc_feature (116)..(116): n is a, c, g, or t

SEQ ID NO: 194371 - DNA, 119 bp, Homo sapiens; identical to SEQ ID NO: 194316
  misc_feature: GYAE6OF01BC09R.51.29.C07.1.454.CMB.1.raw
  modified_base (117)..(119): a, c, t, g, unknown or other
  misc_feature (117)..(119): n is a, c, g, or t

SEQ ID NO: 194372 - DNA, 124 bp, Homo sapiens
  misc_feature: GYAE6OF01AW19V.51.29.C07.1.454.CMB.1.raw
  modified_base (117)..(124): a, c, t, g, unknown or other
  misc_feature (117)..(124): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnn

SEQ ID NO: 194373 - DNA, 118 bp, Homo sapiens; identical to SEQ ID NO: 194140
  misc_feature: GYAE6OF01BPBSG.51.29.C07.1.454.CMB.1.raw
  modified_base (118)..(118): a, c, t, g, unknown or other
  misc_feature (118)..(118): n is a, c, g, or t

SEQ ID NO: 194374 - DNA, 122 bp, Homo sapiens
  misc_feature: GYAE6OF01AMDD3.51.29.C07.1.454.CMB.1.raw
  modified_base (119)..(122): a, c, t, g, unknown or other
  misc_feature (119)..(122): n is a, c, g, or t
tcagcgatcgtatacacgaccggtgctcgatttagagtgctacgaagggaaagggcagcgtcgactctgttcccgccctcctctcgtagcactctgagcgggctggcaaggcgcatagnnnn

SEQ ID NO: 194375 - DNA, 117 bp, Homo sapiens; identical to SEQ ID NO: 194206
  misc_feature: GYAE6OF01AGOJJ.51.29.C07.1.454.CMB.1.raw

SEQ ID NO: 194376 - DNA, 117 bp, Homo sapiens
  misc_feature: GYAE6OF01ARQSU.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaaggcagcgtcactctgttcccaccctcctctcgtagcactctgagcggctggcaaggcgcatagnn

SEQ ID NO: 194377 - DNA, 120 bp, Homo sapiens
  misc_feature: GYAE6OF01C9E4Q.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnn

SEQ ID NO: 194378 - DNA, 159 bp, Homo sapiens
  misc_feature: GYAE6OF01EMC09.51.29.C07.1.454.CMB.1.raw
  modified_base (123)..(159): a, c, t, g, unknown or other
  misc_feature (123)..(159): n is a, c, g, or t
tcagcgatcgtatacacgaccggtgctcgatttagagtgctacgaagggaaagggcaggccgtcactctgttcccaccctcctctcgtagcactctgaggccgggctggcaagggcgcatagnnnnnnnnnnnnnnnnnnnnnnnnnnnnnnnnnnnnn

SEQ ID NO: 194379 - DNA, 118 bp, Homo sapiens; identical to SEQ ID NO: 194140
  misc_feature: GYAE6OF01DODZM.51.29.C07.1.454.CMB.1.raw
  modified_base (118)..(118): a, c, t, g, unknown or other
  misc_feature (118)..(118): n is a, c, g, or t

SEQ ID NO: 194380 - DNA, 132 bp, Homo sapiens
  misc_feature: GYAE6OF01AW6W3.51.29.C07.1.454.CMB.1.raw
  modified_base (118)..(132): a, c, t, g, unknown or other
  misc_feature (118)..(132): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnn

SEQ ID NO: 194381 - DNA, 117 bp, Homo sapiens; identical to SEQ ID NO: 194133
  misc_feature: GYAE6OF01BQI2K.51.29.C07.1.454.CMB.1.raw
  modified_base (117)..(117): a, c, t, g, unknown or other
  misc_feature (117)..(117): n is a, c, g, or t

SEQ ID NO: 194382 - DNA, 118 bp, Homo sapiens; identical to SEQ ID NO: 194139
  misc_feature: GYAE6OF01D92BU.51.29.C07.1.454.CMB.1.raw
  modified_base (118)..(118): a, c, t, g, unknown or other
  misc_feature (118)..(118): n is a, c, g, or t

SEQ ID NO: 194383 - DNA, 118 bp, Homo sapiens; identical to SEQ ID NO: 194139
  misc_feature: GYAE6OF01CI8CB.51.29.C07.1.454.CMB.1.raw
  modified_base (118)..(118): a, c, t, g, unknown or other
  misc_feature (118)..(118): n is a, c, g, or t

SEQ ID NO: 194384 - DNA, 118 bp, Homo sapiens; identical to SEQ ID NO: 194171
  misc_feature: GYAE6OF01BPO86.51.29.C07.1.454.CMB.1.raw
  modified_base (116)..(118): a, c, t, g, unknown or other
  misc_feature (116)..(118): n is a, c, g, or t

SEQ ID NO: 194385 - DNA, 120 bp, Homo sapiens; identical to SEQ ID NO: 194377
  misc_feature: GYAE6OF01DE67N.51.29.C07.1.454.CMB.1.raw
  modified_base (117)..(120): a, c, t, g, unknown or other
  misc_feature (117)..(120): n is a, c, g, or t

SEQ ID NO: 194386 - DNA, 118 bp, Homo sapiens; identical to SEQ ID NO: 194140
  misc_feature: GYAE6OF01EBW1C.51.29.C07.1.454.CMB.1.raw
  modified_base (118)..(118): a, c, t, g, unknown or other
  misc_feature (118)..(118): n is a, c, g, or t

SEQ ID NO: 194387 - DNA, 117 bp, Homo sapiens; identical to SEQ ID NO: 194133
  misc_feature: GYAE6OF01A0ZSA.51.29.C07.1.454.CMB.1.raw
  modified_base (117)..(117): a, c, t, g, unknown or other
  misc_feature (117)..(117): n is a, c, g, or t

SEQ ID NO: 194388 - DNA, 116 bp, Homo sapiens
  misc_feature: GYAE6OF01EL3DF.51.29.C07.1.454.CMB.1.raw
tcagcgatcgtatacacgaccggtgctcgatttagagtgctacgaagggaaagggcagcgtcactctgttcccgccctcctctcgtacactctgagcgggctggcaaggcgcatag

SEQ ID NO: 194389 - DNA, 117 bp, Homo sapiens; identical to SEQ ID NO: 194206
  misc_feature: GYAE6OF01BR9IW.51.29.C07.1.454.CMB.1.raw

SEQ ID NO: 194390 - DNA, 123 bp, Homo sapiens
  misc_feature: GYAE6OF01ETFUE.51.29.C07.1.454.CMB.1.raw
  modified_base (118)..(123): a, c, t, g, unknown or other
  misc_feature (118)..(123): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnn

SEQ ID NO: 194391 - DNA, 118 bp, Homo sapiens; identical to SEQ ID NO: 194140
  misc_feature: GYAE6OF01E0JDR.51.29.C07.1.454.CMB.1.raw
  modified_base (118)..(118): a, c, t, g, unknown or other
  misc_feature (118)..(118): n is a, c, g, or t

SEQ ID NO: 194392 - DNA, 119 bp, Homo sapiens
  misc_feature: GYAE6OF01B2E39.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaaagggcagcgtcactctgttcccgcctcctctcgtagcactctgagcggctggcaaggcgcatagnnnn

SEQ ID NO: 194393 - DNA, 123 bp, Homo sapiens
  misc_feature: GYAE6OF01ADBRK.51.29.C07.1.454.CMB.1.raw
  modified_base (118)..(123): a, c, t, g, unknown or other
  misc_feature (118)..(123): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnn

SEQ ID NO: 194394 - DNA, 118 bp, Homo sapiens; identical to SEQ ID NO: 194140
  misc_feature: GYAE6OF01D0S4R.51.29.C07.1.454.CMB.1.raw
  modified_base (118)..(118): a, c, t, g, unknown or other
  misc_feature (118)..(118): n is a, c, g, or t

SEQ ID NO: 194395 - DNA, 118 bp, Homo sapiens; identical to SEQ ID NO: 194281
  misc_feature: GYAE6OF01ASNJS.51.29.C07.1.454.CMB.1.raw
  modified_base (117)..(118): a, c, t, g, unknown or other
  misc_feature (117)..(118): n is a, c, g, or t

SEQ ID NO: 194396 - DNA, 125 bp, Homo sapiens
  misc_feature: GYAE6OF01DM3N7.51.29.C07.1.454.CMB.1.raw
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnnnnn

SEQ ID NO: 194397 - DNA, 118 bp, Homo sapiens; identical to SEQ ID NO: 194140
  misc_feature: GYAE6OF01BH5PG.51.29.C07.1.454.CMB.1.raw
  modified_base (118)..(118): a, c, t, g, unknown or other
  misc_feature (118)..(118): n is a, c, g, or t

SEQ ID NO: 194398 - DNA, 139 bp, Homo sapiens
  misc_feature: GYAE6OF01CGBB7.51.29.C07.1.454.CMB.1.raw
  modified_base (120)..(139): a, c, t, g, unknown or other
  misc_feature (120)..(139): n is a, c, g, or t
tcagcgatcgtatacacgaccggtgctcgatttagagtgctacgaagggaaagggcgagcgtcactctgttcccggccctcctctcgtagcactctgagcgggctggcaaggcgcatagnnnnnnnnnnnnnnnnnnnn

SEQ ID NO: 194399 - DNA, 116 bp, Homo sapiens; identical to SEQ ID NO: 194261
  misc_feature: GYAE6OF01B6YQ6.51.29.C07.1.454.CMB.1.raw

SEQ ID NO: 194400 - DNA, 116 bp, Homo sapiens; identical to SEQ ID NO: 194115
  misc_feature: GYAE6OF01B2TCQ.51.29.C07.1.454.CMB.1.raw
  modified_base (116)..(116): a, c, t, g, unknown or other
  misc_feature (116)..(116): n is a, c, g, or t

SEQ ID NO: 194401 - DNA, 118 bp, Homo sapiens; identical to SEQ ID NO: 194140
  misc_feature: GYAE6OF01BX4FY.51.29.C07.1.454.CMB.1.raw
  modified_base (118)..(118): a, c, t, g, unknown or other
  misc_feature (118)..(118): n is a, c, g, or t

SEQ ID NO: 194402 - DNA, 144 bp, Homo sapiens
  misc_feature: GYAE6OF01ESPZY.51.29.C07.1.454.CMB.1.raw
  modified_base (118)..(144): a, c, t, g, unknown or other
  misc_feature (118)..(144): n is a, c, g, or t
tcagcgatcgtatacacgaccggtgctcgatttagagtgctacgaagggtaaagggcagcgtcactctgttcccgccctcctctcgtagcactctgagcggctggcaaggcgcatagnnnnnnnnnnnnnnnnnnnnnnnnnnn

SEQ ID NO: 194403 - DNA, 117 bp, Homo sapiens; identical to SEQ ID NO: 194117
  misc_feature: GYAE6OF01EELAM.51.29.C07.1.454.CMB.1.raw
  modified_base (117)..(117): a, c, t, g, unknown or other
  misc_feature (117)..(117): n is a, c, g, or t

SEQ ID NO: 194404 - DNA, 117 bp, Homo sapiens; identical to SEQ ID NO: 194206
  misc_feature: GYAE6OF01AMJYH.51.29.C07.1.454.CMB.1.raw

SEQ ID NO: 194405 - DNA, 118 bp, Homo sapiens; identical to SEQ ID NO: 194140
  misc_feature: GYAE6OF01CJTA3.51.29.C07.1.454.CMB.1.raw
  modified_base (118)..(118): a, c, t, g, unknown or other
  misc_feature (118)..(118): n is a, c, g, or t

SEQ ID NO: 194406 - DNA, 118 bp, Homo sapiens; identical to SEQ ID NO: 194149
  misc_feature: GYAE6OF01CKJ1C.51.29.C07.1.454.CMB.1.raw
  modified_base (117)..(118): a, c, t, g, unknown or other
  misc_feature (117)..(118): n is a, c, g, or t

SEQ ID NO: 194407 - DNA, 117 bp, Homo sapiens; identical to SEQ ID NO: 194206
  misc_feature: GYAE6OF01DHOM4.51.29.C07.1.454.CMB.1.raw

SEQ ID NO: 194408 - DNA, 118 bp, Homo sapiens
  misc_feature: GYAE6OF01EEAJ5.51.29.C07.1.454.CMB.1.raw
  modified_base (115)..(118): a, c, t, g, unknown or other
  misc_feature (115)..(118): n is a, c, g, or t
tcagcgatcgtatacacgaccggtgctcgatttagagtgctacgaagggaagggcagcgtcactctgttcccacctcctctcgtagcactctgagcggctggcaaggcgcatagnnnn

SEQ ID NO: 194409 - DNA, 118 bp, Homo sapiens; identical to SEQ ID NO: 194139
  misc_feature: GYAE6OF01E43FW.51.29.C07.1.454.CMB.1.raw
  modified_base (118)..(118): a, c, t, g, unknown or other
  misc_feature (118)..(118): n is a, c, g, or t

SEQ ID NO: 194410 - DNA, 118 bp, Homo sapiens; identical to SEQ ID NO: 194139
  misc_feature: GYAE6OF01CZSPL.51.29.C07.1.454.CMB.1.raw
  modified_base (118)..(118): a, c, t, g, unknown or other
  misc_feature (118)..(118): n is a, c, g, or t

SEQ ID NO: 194411 - DNA, 118 bp, Homo sapiens; identical to SEQ ID NO: 194281
  misc_feature: GYAE6OF01C6OXD.51.29.C07.1.454.CMB.1.raw
  modified_base (117)..(118): a, c, t, g, unknown or other
  misc_feature (117)..(118): n is a, c, g, or t

SEQ ID NO: 194412 - DNA, 118 bp, Homo sapiens; identical to SEQ ID NO: 194149
  misc_feature: GYAE6OF01BDS9K.51.29.C07.1.454.CMB.1.raw
  modified_base (117)..(118): a, c, t, g, unknown or other
  misc_feature (117)..(118): n is a, c, g, or t

SEQ ID NO: 194413 - DNA, 118 bp, Homo sapiens; identical to SEQ ID NO: 194140
  misc_feature: GYAE6OF01C2SEF.51.29.C07.1.454.CMB.1.raw
  modified_base (118)..(118): a, c, t, g, unknown or other
  misc_feature (118)..(118): n is a, c, g, or t

SEQ ID NO: 194414 - DNA, 123 bp, Homo sapiens; identical to SEQ ID NO: 194390
  misc_feature: GYAE6OF01B59TH.51.29.C07.1.454.CMB.1.raw
  modified_base (118)..(123): a, c, t, g, unknown or other
  misc_feature (118)..(123): n is a, c, g, or t

SEQ ID NO: 194415 - DNA, 118 bp, Homo sapiens; identical to SEQ ID NO: 194281
  misc_feature: GYAE6OF01BDB2X.51.29.C07.1.454.CMB.1.raw
  modified_base (117)..(118): a, c, t, g, unknown or other
  misc_feature (117)..(118): n is a, c, g, or t

SEQ ID NO: 194416 - DNA, 118 bp, Homo sapiens; identical to SEQ ID NO: 194139
  misc_feature: GYAE6OF01BHV34.51.29.C07.1.454.CMB.1.raw
  modified_base (118)..(118): a, c, t, g, unknown or other
  misc_feature (118)..(118): n is a, c, g, or t

SEQ ID NO: 194417 - DNA, 122 bp, Homo sapiens
  misc_feature: GYAE6OF01BV90Y.51.29.C07.1.454.CMB.1.raw
  modified_base (117)..(122): a, c, t, g, unknown or other
  misc_feature (117)..(122): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnn

SEQ ID NO: 194418 - DNA, 132 bp, Homo sapiens
  misc_feature: GYAE6OF01AW2IY.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnnnnnnnnnnnnnnnn

SEQ ID NO: 194419 - DNA, 119 bp, Homo sapiens; identical to SEQ ID NO: 194160
  misc_feature: GYAE6OF01B9EQG.51.29.C07.1.454.CMB.1.raw
  modified_base (118)..(119): a, c, t, g, unknown or other
  misc_feature (118)..(119): n is a, c, g, or t

SEQ ID NO: 194420 - DNA, 117 bp, Homo sapiens; identical to SEQ ID NO: 194133
  misc_feature: GYAE6OF01DRRUJ.51.29.C07.1.454.CMB.1.raw
  modified_base (117)..(117): a, c, t, g, unknown or other
  misc_feature (117)..(117): n is a, c, g, or t

SEQ ID NO: 194421 - DNA, 118 bp, Homo sapiens; identical to SEQ ID NO: 194139
  misc_feature: GYAE6OF01AWL0F.51.29.C07.1.454.CMB.1.raw
  modified_base (118)..(118): a, c, t, g, unknown or other
  misc_feature (118)..(118): n is a, c, g, or t

SEQ ID NO: 194422 - DNA, 120 bp, Homo sapiens
  misc_feature: GYAE6OF01BK8DT.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnn

SEQ ID NO: 194423 - DNA, 117 bp, Homo sapiens; identical to SEQ ID NO: 194206
  misc_feature: GYAE6OF01DPNZT.51.29.C07.1.454.CMB.1.raw

SEQ ID NO: 194424 - DNA, 159 bp, Homo sapiens
  misc_feature: GYAE6OF01EDVQ5.51.29.C07.1.454.CMB.1.raw
  modified_base (159)..(159): a, c, t, g, unknown or other
  misc_feature (159)..(159): n is a, c, g, or t
tcagcgatcgtatacacgaccggtgctcgatttagagtgctacgaagggaaagggcacgaccggtgctcgatttagagtgctacgaagggaaagggcagcgtcactctgttctcgccctcctctcgtagcactctgagcgggctggcaaggcgcatagn

SEQ ID NO: 194425 - DNA, 136 bp, Homo sapiens
  misc_feature: GYAE6OF01DZEGM.51.29.C07.1.454.CMB.1.raw
  modified_base (120)..(136): a, c, t, g, unknown or other
  misc_feature (120)..(136): n is a, c, g, or t
tcagcgatcgtatacacgaccggtgctcgatttagagtgctacgaagggaaagggcagcgtcactctgttccaccctccttcgtagcactctgagcgggctggcaagggccccccatagnnnnnnnnnnnnnnnnn

SEQ ID NO: 194426 - DNA, 118 bp, Homo sapiens; identical to SEQ ID NO: 194140
  misc_feature: GYAE6OF01E1MLQ.51.29.C07.1.454.CMB.1.raw
  modified_base (118)..(118): a, c, t, g, unknown or other
  misc_feature (118)..(118): n is a, c, g, or t

SEQ ID NO: 194427 - DNA, 118 bp, Homo sapiens; identical to SEQ ID NO: 194139
  misc_feature: GYAE6OF01AFCLQ.51.29.C07.1.454.CMB.1.raw
  modified_base (118)..(118): a, c, t, g, unknown or other
  misc_feature (118)..(118): n is a, c, g, or t

SEQ ID NO: 194428 - DNA, 116 bp, Homo sapiens; identical to SEQ ID NO: 194218
  misc_feature: GYAE6OF01E1MQ6.51.29.C07.1.454.CMB.1.raw

SEQ ID NO: 194429 - DNA, 121 bp, Homo sapiens
  misc_feature: GYAE6OF01DHZWX.51.29.C07.1.454.CMB.1.raw
  modified_base (117)..(121): a, c, t, g, unknown or other
  misc_feature (117)..(121): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnn

SEQ ID NO: 194430 - DNA, 118 bp, Homo sapiens
  misc_feature: GYAE6OF01DO8RX.51.29.C07.1.454.CMB.1.raw
  modified_base (116)..(118): a, c, t, g, unknown or other
  misc_feature (116)..(118): n is a, c, g, or t
tcagcgatcgtatacacgaccggtgctcgatttagagtgctacgaagggaaaggcagcgtcactctgttcccaccctcctctcgtagcactctgagcggctggcaaggcgcatagnnn

SEQ ID NO: 194431 - DNA, 123 bp, Homo sapiens
  misc_feature: GYAE6OF01A9ML2.51.29.C07.1.454.CMB.1.raw
  modified_base (118)..(123): a, c, t, g, unknown or other
  misc_feature (118)..(123): n is a, c, g, or t
tcagcgatcgtatacacgaccggtgctcgatttagagtgctacgaagggaaagggcagcgtcactctgttcccgccctcctctcgtagcactctgacgcggctggcaaggcgcatagnnnnnn

SEQ ID NO: 194432 - DNA, 118 bp, Homo sapiens; identical to SEQ ID NO: 194140
  misc_feature: GYAE6OF01BD5S1.51.29.C07.1.454.CMB.1.raw
  modified_base (118)..(118): a, c, t, g, unknown or other
  misc_feature (118)..(118): n is a, c, g, or t

SEQ ID NO: 194433 - DNA, 117 bp, Homo sapiens; identical to SEQ ID NO: 194133
  misc_feature: GYAE6OF01BH37G.51.29.C07.1.454.CMB.1.raw
  modified_base (117)..(117): a, c, t, g, unknown or other
  misc_feature (117)..(117): n is a, c, g, or t

SEQ ID NO: 194434 - DNA, 117 bp, Homo sapiens; identical to SEQ ID NO: 194133
  misc_feature: GYAE6OF01A8VVD.51.29.C07.1.454.CMB.1.raw
  modified_base (117)..(117): a, c, t, g, unknown or other
  misc_feature (117)..(117): n is a, c, g, or t

SEQ ID NO: 194435 - DNA, 122 bp, Homo sapiens
  misc_feature: GYAE6OF01CJL4H.51.29.C07.1.454.CMB.1.raw
  modified_base (115)..(122): a, c, t, g, unknown or other
  misc_feature (115)..(122): n is a, c, g, or t
tcagcgatcgtatacacgaccggtgctcgatttagagtgctacgagggaagggcagcggtcacgtctgttccgcctcctctcgtagcactctgagcggctggcaaggcgcatagnnnnnnnn

SEQ ID NO: 194436 - DNA, 117 bp, Homo sapiens; identical to SEQ ID NO: 194133
  misc_feature: GYAE6OF01BRWME.51.29.C07.1.454.CMB.1.raw
  modified_base (117)..(117): a, c, t, g, unknown or other
  misc_feature (117)..(117): n is a, c, g, or t

SEQ ID NO: 194437 - DNA, 133 bp, Homo sapiens
  misc_feature: GYAE6OF01BULAL.51.29.C07.1.454.CMB.1.raw
  modified_base (120)..(133): a, c, t, g, unknown or other
  misc_feature (120)..(133): n is a, c, g, or t
tcagcgatcgtatacacgaccggtgctcgatttagagtgctacgaagggaaagggtcgagcgtcactctgttcccaccctcctctcgtagcactctgagcgggctggcaaggcgcatagnnnnnnnnnnnnnn

SEQ ID NO: 194438 - DNA, 157 bp, Homo sapiens
  misc_feature: GYAE6OF01D7N8K.51.29.C07.1.454.CMB.1.raw
  modified_base (118)..(118): a, c, t, g, unknown or other
  misc_feature (118)..(118): n is a, c, g, or t
  modified_base (120)..(157): a, c, t, g, unknown or other
  misc_feature (120)..(157): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagntnnnnnnnnnnnnnnnnnnnnnnnnnnnnnnnnnnnnnn

SEQ ID NO: 194439 - DNA, 117 bp, Homo sapiens; identical to SEQ ID NO: 194147
  misc_feature: GYAE6OF01CZZRY.51.29.C07.1.454.CMB.1.raw

SEQ ID NO: 194440 - DNA, 118 bp, Homo sapiens; identical to SEQ ID NO: 194139
  misc_feature: GYAE6OF01BWEC9.51.29.C07.1.454.CMB.1.raw
  modified_base (118)..(118): a, c, t, g, unknown or other
  misc_feature (118)..(118): n is a, c, g, or t

SEQ ID NO: 194441 - DNA, 117 bp, Homo sapiens; identical to SEQ ID NO: 194133
  misc_feature: GYAE6OF01CHZUR.51.29.C07.1.454.CMB.1.raw
  modified_base (117)..(117): a, c, t, g, unknown or other
  misc_feature (117)..(117): n is a, c, g, or t

SEQ ID NO: 194442 - DNA, 116 bp, Homo sapiens; identical to SEQ ID NO: 194131
  misc_feature: GYAE6OF01AYDHT.51.29.C07.1.454.CMB.1.raw
  modified_base (116)..(116): a, c, t, g, unknown or other
  misc_feature (116)..(116): n is a, c, g, or t

SEQ ID NO: 194443 - DNA, 155 bp, Homo sapiens
  misc_feature: GYAE6OF01DVSXY.51.29.C07.1.454.CMB.1.raw
  modified_base (114)..(114): a, c, t, g, unknown or other
  misc_feature (114)..(114): n is a, c, g, or t
  modified_base (120)..(155): a, c, t, g, unknown or other
  misc_feature (120)..(155): n is a, c, g, or t
tcagcgatcgtatacacgaccggtgctcgatttagagtgctacgaagggaaagtgcgagcgtcaatctgttcccgccctcctctcgtagcactctgagcgggctggcaaaggcncatagnnnnnnnnnnnnnnnnnnnnnnnnnnnnnnnnnnnn

SEQ ID NO: 194444 - DNA, 124 bp, Homo sapiens
  misc_feature: GYAE6OF01CO1P5.51.29.C07.1.454.CMB.1.raw
  modified_base (118)..(124): a, c, t, g, unknown or other
  misc_feature (118)..(124): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnn

SEQ ID NO: 194445 - DNA, 119 bp, Homo sapiens; identical to SEQ ID NO: 194160
  misc_feature: GYAE6OF01EPLRZ.51.29.C07.1.454.CMB.1.raw
  modified_base (118)..(119): a, c, t, g, unknown or other
  misc_feature (118)..(119): n is a, c, g, or t

SEQ ID NO: 194446 - DNA, 119 bp, Homo sapiens
  misc_feature: GYAE6OF01CDYZ2.51.29.C07.1.454.CMB.1.raw
  modified_base (114)..(119): a, c, t, g, unknown or other
  misc_feature (114)..(119): n is a, c, g, or t
tcagcgatcgtatacacgaccggtgctcgatttagagtgctacgaagggaaggcagcgtcactctgttcccgccctcctctcgtagcactcgagcggctggcaaggcgcatagnnnnnn

SEQ ID NO: 194447 - DNA, 118 bp, Homo sapiens; identical to SEQ ID NO: 194140
  misc_feature: GYAE6OF01DIENN.51.29.C07.1.454.CMB.1.raw
  modified_base (118)..(118): a, c, t, g, unknown or other
  misc_feature (118)..(118): n is a, c, g, or t

SEQ ID NO: 194448 - DNA, 142 bp, Homo sapiens
  misc_feature: GYAE6OF01ET44A.51.29.C07.1.454.CMB.1.raw
  modified_base (115)..(115): a, c, t, g, unknown or other
  misc_feature (115)..(115): n is a, c, g, or t
  modified_base (121)..(142): a, c, t, g, unknown or other
  misc_feature (121)..(142): n is a, c, g, or t
tcagcgatcgtatacacgaccggtgctcgatttagagtgctacgaagggaaaggggcagcgtcactctgttcccaccctctctcgtagcactctgagccgggctcggcaacggcncatagnnnnnnnnnnnnnnnnnnnnnn

SEQ ID NO: 194449 - DNA, 117 bp, Homo sapiens
  misc_feature: GYAE6OF01D9O2W.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcacctgttcccaccctcctctcgtagcactctgagcgggctggcaaggcgcatagn

SEQ ID NO: 194450 - DNA, 118 bp, Homo sapiens; identical to SEQ ID NO: 194149
  misc_feature: GYAE6OF01ANT3D.51.29.C07.1.454.CMB.1.raw
  modified_base (117)..(118): a, c, t, g, unknown or other
  misc_feature (117)..(118): n is a, c, g, or t

SEQ ID NO: 194451 - DNA, 118 bp, Homo sapiens; identical to SEQ ID NO: 194149
  misc_feature: GYAE6OF01C4AZR.51.29.C07.1.454.CMB.1.raw
  modified_base (117)..(118): a, c, t, g, unknown or other
  misc_feature (117)..(118): n is a, c, g, or t

SEQ ID NO: 194452 - DNA, 154 bp, Homo sapiens
  misc_feature: GYAE6OF01BIMMI.51.29.C07.1.454.CMB.1.raw
  modified_base (119)..(154): a, c, t, g, unknown or other
  misc_feature (119)..(154): n is a, c, g, or t
tcagcgatcgtatacacgaccggtgctcgatttagagtgctacgaagggaaagggcgagcgtcactctgttcccaccctctctcgtagcactcctgagcggctggcaaggtcgcatagnnnnnnnnnnnnnnnnnnnnnnnnnnnnnnnnnnnn

SEQ ID NO: 194453 - DNA, 118 bp, Homo sapiens; identical to SEQ ID NO: 194140
  misc_feature: GYAE6OF01BI6VM.51.29.C07.1.454.CMB.1.raw
  modified_base (118)..(118): a, c, t, g, unknown or other
  misc_feature (118)..(118): n is a, c, g, or t

SEQ ID NO: 194454 - DNA, 118 bp, Homo sapiens
  misc_feature: GYAE6OF01DAFDD.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccaccctcctctcgtagcactctgagcggctggacaaggcgcatagn

SEQ ID NO: 194455 - DNA, 118 bp, Homo sapiens; identical to SEQ ID NO: 194149
  misc_feature: GYAE6OF01DAZZ3.51.29.C07.1.454.CMB.1.raw
  modified_base (117)..(118): a, c, t, g, unknown or other
  misc_feature (117)..(118): n is a, c, g, or t

SEQ ID NO: 194456 - DNA, 117 bp, Homo sapiens; identical to SEQ ID NO: 194133
  misc_feature: GYAE6OF01DKRNS.51.29.C07.1.454.CMB.1.raw
  modified_base (117)..(117): a, c, t, g, unknown or other
  misc_feature (117)..(117): n is a, c, g, or t

SEQ ID NO: 194457 - DNA, 118 bp, Homo sapiens; identical to SEQ ID NO: 194139
  misc_feature: GYAE6OF01BHKY4.51.29.C07.1.454.CMB.1.raw
  modified_base (118)..(118): a, c, t, g, unknown or other
  misc_feature (118)..(118): n is a, c, g, or t

SEQ ID NO: 194458 - DNA, 123 bp, Homo sapiens
  misc_feature: GYAE6OF01D39JS.51.29.C07.1.454.CMB.1.raw
  modified_base (118)..(123): a, c, t, g, unknown or other
  misc_feature (118)..(123): n is a, c, g, or t
tcagcgatcgtatacacgaccggtgctcgatttagagtgctacgaagggaaagggcaggcgtcactctgttcccgccctcctctcgtagcactctgagcggctggcaaggcgcatagnnnnnn

SEQ ID NO: 194459 - DNA, 118 bp, Homo sapiens; identical to SEQ ID NO: 194139
  misc_feature: GYAE6OF01EVYKP.51.29.C07.1.454.CMB.1.raw
  modified_base (118)..(118): a, c, t, g, unknown or other
  misc_feature (118)..(118): n is a, c, g, or t

SEQ ID NO: 194460 - DNA, 118 bp, Homo sapiens; identical to SEQ ID NO: 194140
  misc_feature: GYAE6OF01C2MFF.51.29.C07.1.454.CMB.1.raw
  modified_base (118)..(118): a, c, t, g, unknown or other
  misc_feature (118)..(118): n is a, c, g, or t

SEQ ID NO: 194461 - DNA, 119 bp, Homo sapiens; identical to SEQ ID NO: 194160
  misc_feature: GYAE6OF01B0OJB.51.29.C07.1.454.CMB.1.raw
  modified_base (118)..(119): a, c, t, g, unknown or other
  misc_feature (118)..(119): n is a, c, g, or t

SEQ ID NO: 194462 - DNA, 118 bp, Homo sapiens; identical to SEQ ID NO: 194140
  misc_feature: GYAE6OF01BJ5BZ.51.29.C07.1.454.CMB.1.raw
  modified_base (118)..(118): a, c, t, g, unknown or other
  misc_feature (118)..(118): n is a, c, g, or t

SEQ ID NO: 194463 - DNA, 119 bp, Homo sapiens; identical to SEQ ID NO: 194160
  misc_feature: GYAE6OF01B3Q9I.51.29.C07.1.454.CMB.1.raw
  modified_base (118)..(119): a, c, t, g, unknown or other
  misc_feature (118)..(119): n is a, c, g, or t

SEQ ID NO: 194464 - DNA, 117 bp, Homo sapiens; identical to SEQ ID NO: 194206
  misc_feature: GYAE6OF01B020F.51.29.C07.1.454.CMB.1.raw

SEQ ID NO: 194465 - DNA, 119 bp, Homo sapiens; identical to SEQ ID NO: 194316
  misc_feature: GYAE6OF01A3V4S.51.29.C07.1.454.CMB.1.raw
  modified_base (117)..(119): a, c, t, g, unknown or other
  misc_feature (117)..(119): n is a, c, g, or t

SEQ ID NO: 194466 - DNA, 117 bp, Homo sapiens; identical to SEQ ID NO: 194133
  misc_feature: GYAE6OF01D0AK5.51.29.C07.1.454.CMB.1.raw
  modified_base (117)..(117): a, c, t, g, unknown or other
  misc_feature (117)..(117): n is a, c, g, or t

SEQ ID NO: 194467 - DNA, 120 bp, Homo sapiens; identical to SEQ ID NO: 194289
  misc_feature: GYAE6OF01DU22G.51.29.C07.1.454.CMB.1.raw
  modified_base (118)..(120): a, c, t, g, unknown or other
  misc_feature (118)..(120): n is a, c, g, or t

SEQ ID NO: 194468 - DNA, 118 bp, Homo sapiens; identical to SEQ ID NO: 194139
  misc_feature: GYAE6OF01EERIE.51.29.C07.1.454.CMB.1.raw
  modified_base (118)..(118): a, c, t, g, unknown or other
  misc_feature (118)..(118): n is a, c, g, or t

SEQ ID NO: 194469 - DNA, 119 bp, Homo sapiens; identical to SEQ ID NO: 194160
  misc_feature: GYAE6OF01AFOX9.51.29.C07.1.454.CMB.1.raw
  modified_base (118)..(119): a, c, t, g, unknown or other
  misc_feature (118)..(119): n is a, c, g, or t

SEQ ID NO: 194470 - DNA, 117 bp, Homo sapiens
  misc_feature: GYAE6OF01CBTBV.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccaccctcctctcgtagcactcgagcgggctggcaaggcgcatagn

SEQ ID NO: 194471 - DNA, 191 bp, Homo sapiens
  misc_feature: GYAE6OF01B4O53.51.29.C07.1.454.CMB.1.raw
  modified_base (158)..(191): a, c, t, g, unknown or other
  misc_feature (158)..(191): n is a, c, g, or t
tcagcgatcgtatacacgaccggtgctcgatttagagtgctacgaagggaaagggcacgaccggtgctcgatttagagtgctacgagggaagggcagcgtcactctgttccacctctctcgtagcactcgtggagcgggactggcaaggccgcatagnnnnnnnnnnnnnnnnnnnnnnnnnnnnnnnnnn

SEQ ID NO: 194472 - DNA, 118 bp, Homo sapiens; identical to SEQ ID NO: 194149
  misc_feature: GYAE6OF01C1OCL.51.29.C07.1.454.CMB.1.raw
  modified_base (117)..(118): a, c, t, g, unknown or other
  misc_feature (117)..(118): n is a, c, g, or t

SEQ ID NO: 194473 - DNA, 118 bp, Homo sapiens; identical to SEQ ID NO: 194140
  misc_feature: GYAE6OF01EE046.51.29.C07.1.454.CMB.1.raw
  modified_base (118)..(118): a, c, t, g, unknown or other
  misc_feature (118)..(118): n is a, c, g, or t

SEQ ID NO: 194474 - DNA, 132 bp, Homo sapiens; identical to SEQ ID NO: 194380
  misc_feature: GYAE6OF01C4P1Y.51.29.C07.1.454.CMB.1.raw
  modified_base (118)..(132): a, c, t, g, unknown or other
  misc_feature (118)..(132): n is a, c, g, or t

SEQ ID NO: 194475 - DNA, 119 bp, Homo sapiens; identical to SEQ ID NO: 194160
  misc_feature: GYAE6OF01CJDGP.51.29.C07.1.454.CMB.1.raw
  modified_base (118)..(119): a, c, t, g, unknown or other
  misc_feature (118)..(119): n is a, c, g, or t

SEQ ID NO: 194476 - DNA, 121 bp, Homo sapiens; identical to SEQ ID NO: 194352
  misc_feature: GYAE6OF01BDB4T.51.29.C07.1.454.CMB.1.raw
  modified_base (118)..(121): a, c, t, g, unknown or other
  misc_feature (118)..(121): n is a, c, g, or t

SEQ ID NO: 194477 - DNA, 123 bp, Homo sapiens; identical to SEQ ID NO: 194390
  misc_feature: GYAE6OF01BHLGE.51.29.C07.1.454.CMB.1.raw
  modified_base (118)..(123): a, c, t, g, unknown or other
  misc_feature (118)..(123): n is a, c, g, or t

SEQ ID NO: 194478 - DNA, 118 bp, Homo sapiens; identical to SEQ ID NO: 194281
  misc_feature: GYAE6OF01B4VVC.51.29.C07.1.454.CMB.1.raw
  modified_base (117)..(118): a, c, t, g, unknown or other
  misc_feature (117)..(118): n is a, c, g, or t

SEQ ID NO: 194479 - DNA, 118 bp, Homo sapiens; identical to SEQ ID NO: 194140
  misc_feature: GYAE6OF01BT31Y.51.29.C07.1.454.CMB.1.raw
  modified_base (118)..(118): a, c, t, g, unknown or other
  misc_feature (118)..(118): n is a, c, g, or t

SEQ ID NO: 194480 - DNA, 118 bp, Homo sapiens; identical to SEQ ID NO: 194139
  misc_feature: GYAE6OF01EOCXU.51.29.C07.1.454.CMB.1.raw
  modified_base (118)..(118): a, c, t, g, unknown or other
  misc_feature (118)..(118): n is a, c, g, or t

SEQ ID NO: 194481 - DNA, 118 bp, Homo sapiens
  misc_feature: GYAE6OF01D8330.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnn

SEQ ID NO: 194482 - DNA, 143 bp, Homo sapiens
  misc_feature: GYAE6OF01A5EXV.51.29.C07.1.454.CMB.1.raw
  modified_base (122)..(143): a, c, t, g, unknown or other
  misc_feature (122)..(143): n is a, c, g, or t
tcagcgatcgtatacacgaccggtgctcgatttagagtgctacgaagggaaagggcgaggcgtcactctgttcccaccctcctctcgtagcactctgagcgggctcggcaaggcgcataggnnnnnnnnnnnnnnnnnnnnnn

SEQ ID NO: 194483 - DNA, 160 bp, Homo sapiens
  misc_feature: GYAE6OF01EAX95.51.29.C07.1.454.CMB.1.raw
  modified_base (159)..(160): a, c, t, g, unknown or other
  misc_feature (159)..(160): n is a, c, g, or t
tcagcgatcgtatacacgaccggtgctcgatttagagtgctacgaaggtaaagggcacgaccggtgctcgatttagagtgctacgaagggaaagggcagcgtcactctgttcccaccctcctctcgtagcactctgagcgggctggcaaggcgcatagnn

SEQ ID NO: 194484 - DNA, 114 bp, Homo sapiens
  misc_feature: GYAE6OF01E5ESO.51.29.C07.1.454.CMB.1.raw
tcagcgatcgtatacacgaccggtgctcgatttagagtgctacgaagggaaggcagcgtcactctgttcccgccctcctctcgtagcactctgagcggctggcaaggcgcatag

SEQ ID NO: 194485 - DNA, 119 bp, Homo sapiens; identical to SEQ ID NO: 194160
  misc_feature: GYAE6OF01EYH1R.51.29.C07.1.454.CMB.1.raw
  modified_base (118)..(119): a, c, t, g, unknown or other
  misc_feature (118)..(119): n is a, c, g, or t

SEQ ID NO: 194486 - DNA, 119 bp, Homo sapiens; identical to SEQ ID NO: 194160
  misc_feature: GYAE6OF01DY2XE.51.29.C07.1.454.CMB.1.raw
  modified_base (118)..(119): a, c, t, g, unknown or other
  misc_feature (118)..(119): n is a, c, g, or t

SEQ ID NO: 194487 - DNA, 129 bp, Homo sapiens
  misc_feature: GYAE6OF01ESJG1.51.29.C07.1.454.CMB.1.raw
  modified_base (118)..(129): a, c, t, g, unknown or other
  misc_feature (118)..(129): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnn

SEQ ID NO: 194488 - DNA, 157 bp, Homo sapiens
  misc_feature: GYAE6OF01A7H7M.51.29.C07.1.454.CMB.1.raw
  modified_base (114)..(114): a, c, t, g, unknown or other
  misc_feature (114)..(114): n is a, c, g, or t
  modified_base (120)..(157): a, c, t, g, unknown or other
  misc_feature (120)..(157): n is a, c, g, or t
tcagcgatcgtatacacgaccggtgctcgatttagagtgctacgaagggaaagggcgagcgtacactctgttcccacccgtcctctcgtagcactctgagcggctggcaaggcncatagnnnnnnnnnnnnnnnnnnnnnnnnnnnnnnnnnnnnnn

SEQ ID NO: 194489 - DNA, 117 bp, Homo sapiens; identical to SEQ ID NO: 194133
  misc_feature: GYAE6OF01BV6WG.51.29.C07.1.454.CMB.1.raw
  modified_base (117)..(117): a, c, t, g, unknown or other
  misc_feature (117)..(117): n is a, c, g, or t

SEQ ID NO: 194490 - DNA, 160 bp, Homo sapiens; identical to SEQ ID NO: 194364
  misc_feature: GYAE6OF01CMTBE.51.29.C07.1.454.CMB.1.raw
  modified_base (159)..(160): a, c, t, g, unknown or other
  misc_feature (159)..(160): n is a, c, g, or t

SEQ ID NO: 194491 - DNA, 118 bp, Homo sapiens; identical to SEQ ID NO: 194149
  misc_feature: GYAE6OF01CXUL3.51.29.C07.1.454.CMB.1.raw
  modified_base (117)..(118): a, c, t, g, unknown or other
  misc_feature (117)..(118): n is a, c, g, or t

SEQ ID NO: 194492 - DNA, 159 bp, Homo sapiens
  misc_feature: GYAE6OF01E4FFA.51.29.C07.1.454.CMB.1.raw
  modified_base (159)..(159): a, c, t, g, unknown or other
  misc_feature (159)..(159): n is a, c, g, or t
tcagcgatcgtatacacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatagn

SEQ ID NO: 194493 - DNA, 117 bp, Homo sapiens; identical to SEQ ID NO: 194206
  misc_feature: GYAE6OF01DG5GM.51.29.C07.1.454.CMB.1.raw

SEQ ID NO: 194494 - DNA, 117 bp, Homo sapiens; identical to SEQ ID NO: 194133
  misc_feature: GYAE6OF01EPETR.51.29.C07.1.454.CMB.1.raw
  modified_base (117)..(117): a, c, t, g, unknown or other
  misc_feature (117)..(117): n is a, c, g, or t

SEQ ID NO: 194495 - DNA, 128 bp, Homo sapiens
  misc_feature: GYAE6OF01BY7MI.51.29.C07.1.454.CMB.1.raw
  modified_base (120)..(128): a, c, t, g, unknown or other
  misc_feature (120)..(128): n is a, c, g, or t
tcagcgatcgtatacacgaccggtgctcgatttagagtgctacgaagggaaagggcaggcgtcactctgttcccacccgtcctctcgtagcacctctgagcggctggcaaggcgcatagnnnnnnnnn

SEQ ID NO: 194496 - DNA, 118 bp, Homo sapiens; identical to SEQ ID NO: 194139
  misc_feature: GYAE6OF01BS6GL.51.29.C07.1.454.CMB.1.raw
  modified_base (118)..(118): a, c, t, g, unknown or other
  misc_feature (118)..(118): n is a, c, g, or t

SEQ ID NO: 194497 - DNA, 118 bp, Homo sapiens; identical to SEQ ID NO: 194140
  misc_feature: GYAE6OF01DJYIC.51.29.C07.1.454.CMB.1.raw
  modified_base (118)..(118): a, c, t, g, unknown or other
  misc_feature (118)..(118): n is a, c, g, or t

SEQ ID NO: 194498 - DNA, 118 bp, Homo sapiens; identical to SEQ ID NO: 194139
  misc_feature: GYAE6OF01D6P2J.51.29.C07.1.454.CMB.1.raw
  modified_base (118)..(118): a, c, t, g, unknown or other
  misc_feature (118)..(118): n is a, c, g, or t

SEQ ID NO: 194499 - DNA, 117 bp, Homo sapiens; identical to SEQ ID NO: 194147
  misc_feature: GYAE6OF01AUCUF.51.29.C07.1.454.CMB.1.raw

SEQ ID NO: 194500 - DNA, 116 bp, Homo sapiens; identical to SEQ ID NO: 194100
  misc_feature: GYAE6OF01EQNL1.51.29.C07.1.454.CMB.1.raw
  modified_base (116)..(116): a, c, t, g, unknown or other
  misc_feature (116)..(116): n is a, c, g, or t

SEQ ID NO: 194501 - DNA, 127 bp, Homo sapiens
  misc_feature: GYAE6OF01EZIV4.51.29.C07.1.454.CMB.1.raw
  modified_base (118)..(127): a, c, t, g, unknown or other
  misc_feature (118)..(127): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnn

SEQ ID NO: 194502 - DNA, 118 bp, Homo sapiens; identical to SEQ ID NO: 194140
  misc_feature: GYAE6OF01DLGTT.51.29.C07.1.454.CMB.1.raw
  modified_base (118)..(118): a, c, t, g, unknown or other
  misc_feature (118)..(118): n is a, c, g, or t

SEQ ID NO: 194503 - DNA, 134 bp, Homo sapiens
  misc_feature: GYAE6OF01BZMJS.51.29.C07.1.454.CMB.1.raw
  modified_base (118)..(134): a, c, t, g, unknown or other
  misc_feature (118)..(134): n is a, c, g, or t
tcagcgatcgtatacacgaccggtgctcgatttagagtgctacgaagggaaagggcagcgtcactctgttcccaccctcctctcgtagcactctgagtcggctggcaaggcgcatagnnnnnnnnnnnnnnnnn

SEQ ID NO: 194504 - DNA, 118 bp, Homo sapiens; identical to SEQ ID NO: 194140
  misc_feature: GYAE6OF01DAE39.51.29.C07.1.454.CMB.1.raw
  modified_base (118)..(118): a, c, t, g, unknown or other
  misc_feature (118)..(118): n is a, c, g, or t

SEQ ID NO: 194505 - DNA, 117 bp, Homo sapiens
  misc_feature: GYAE6OF01B5APA.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgtcccaccctcctctcgtagcactctgagcgggctggcaaggcgcatagn

SEQ ID NO: 194506 - DNA, 118 bp, Homo sapiens; identical to SEQ ID NO: 194139
  misc_feature: GYAE6OF01BR4YC.51.29.C07.1.454.CMB.1.raw
  modified_base (118)..(118): a, c, t, g, unknown or other
  misc_feature (118)..(118): n is a, c, g, or t

SEQ ID NO: 194507 - DNA, 116 bp, Homo sapiens
  misc_feature: GYAE6OF01ELC9C.51.29.C07.1.454.CMB.1.raw
tcagcgatcgtatacacgaccggtgctcgatttagagtgctacgaagggaaagggcagcgtcactctgttccgccctcctctcgtagcactctgagcgggctggcaaggcgcatag

SEQ ID NO: 194508 - DNA, 118 bp, Homo sapiens; identical to SEQ ID NO: 194140
  misc_feature: GYAE6OF01C6GZJ.51.29.C07.1.454.CMB.1.raw
  modified_base (118)..(118): a, c, t, g, unknown or other
  misc_feature (118)..(118): n is a, c, g, or t

SEQ ID NO: 194509 - DNA, 132 bp, Homo sapiens; identical to SEQ ID NO: 194380
  misc_feature: GYAE6OF01DO1O9.51.29.C07.1.454.CMB.1.raw
  modified_base (118)..(132): a, c, t, g, unknown or other
  misc_feature (118)..(132): n is a, c, g, or t

SEQ ID NO: 194510 - DNA, 133 bp, Homo sapiens
  misc_feature: GYAE6OF01D9C0E.51.29.C07.1.454.CMB.1.raw
  modified_base (115)..(115): a, c, t, g, unknown or other
  misc_feature (115)..(115): n is a, c, g, or t
  modified_base (121)..(133): a, c, t, g, unknown or other
  misc_feature (121)..(133): n is a, c, g, or t
tcagcgatcgtatacacgaccggtgctcgatttagagtgctacgaagggaaagggcgaggcgtcactctgttcccacccgtcctctcgtagcacctctgagcggctggcaaggcncatagnnnnnnnnnnnnn

SEQ ID NO: 194511 - DNA, 118 bp, Homo sapiens; identical to SEQ ID NO: 194140
  misc_feature: GYAE6OF01CE4JS.51.29.C07.1.454.CMB.1.raw
  modified_base (118)..(118): a, c, t, g, unknown or other
  misc_feature (118)..(118): n is a, c, g, or t

SEQ ID NO: 194512 - DNA, 118 bp, Homo sapiens; identical to SEQ ID NO: 194139
  misc_feature: GYAE6OF01DMFR3.51.29.C07.1.454.CMB.1.raw
  modified_base (118)..(118): a, c, t, g, unknown or other
  misc_feature (118)..(118): n is a, c, g, or t

SEQ ID NO: 194513 - DNA, 117 bp, Homo sapiens; identical to SEQ ID NO: 194147
  misc_feature: GYAE6OF01EML9X.51.29.C07.1.454.CMB.1.raw

SEQ ID NO: 194514 - DNA, 134 bp, Homo sapiens
  misc_feature: GYAE6OF01A8093.51.29.C07.1.454.CMB.1.raw
  modified_base (118)..(134): a, c, t, g, unknown or other
  misc_feature (118)..(134): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnnnnnnn

SEQ ID NO: 194515 - DNA, 129 bp, Homo sapiens; identical to SEQ ID NO: 194159
  misc_feature: GYAE6OF01BW6T9.51.29.C07.1.454.CMB.1.raw
  modified_base (118)..(129): a, c, t, g, unknown or other
  misc_feature (118)..(129): n is a, c, g, or t

SEQ ID NO: 194516 - DNA, 116 bp, Homo sapiens
  misc_feature: GYAE6OF01BZLMQ.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaaggcagcgtcactctgttcccaccctcctctcgtagcactctgagcggctggcaaggcgcatagn

SEQ ID NO: 194517 - DNA, 119 bp, Homo sapiens; identical to SEQ ID NO: 194137
  misc_feature: GYAE6OF01E2K5Y.51.29.C07.1.454.CMB.1.raw
  modified_base (118)..(119): a, c, t, g, unknown or other
  misc_feature (118)..(119): n is a, c, g, or t

SEQ ID NO: 194518 - DNA, 119 bp, Homo sapiens; identical to SEQ ID NO: 194316
  misc_feature: GYAE6OF01DJGOW.51.29.C07.1.454.CMB.1.raw
  modified_base (117)..(119): a, c, t, g, unknown or other
  misc_feature (117)..(119): n is a, c, g, or t

SEQ ID NO: 194519 - DNA, 144 bp, Homo sapiens
  misc_feature: GYAE6OF01DEW9C.51.29.C07.1.454.CMB.1.raw
  modified_base (119)..(144): a, c, t, g, unknown or other
  misc_feature (119)..(144): n is a, c, g, or t
tcagcgatcgtatacacgaccggtgctcgatttagagtgctacgaagggaaagggcagcgtcactctgttcccaccctcctctcgtagctactctgagcgggctggcaaggcgcatagnnnnnnnnnnnnnnnnnnnnnnnnnn

SEQ ID NO: 194520 - DNA, 118 bp, Homo sapiens; identical to SEQ ID NO: 194481
  misc_feature: GYAE6OF01CP08A.51.29.C07.1.454.CMB.1.raw
  modified_base (117)..(118): a, c, t, g, unknown or other
  misc_feature (117)..(118): n is a, c, g, or t

SEQ ID NO: 194521 - DNA, 117 bp, Homo sapiens
  misc_feature: GYAE6OF01CNRET.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttccaccctcctctcgtagcactctgagcgggctggcaaggcgcatagn

SEQ ID NO: 194522 - DNA, 118 bp, Homo sapiens; identical to SEQ ID NO: 194139
  misc_feature: GYAE6OF01B65ZP.51.29.C07.1.454.CMB.1.raw
  modified_base (118)..(118): a, c, t, g, unknown or other
  misc_feature (118)..(118): n is a, c, g, or t

SEQ ID NO: 194523 - DNA, 136 bp, Homo sapiens
  misc_feature: GYAE6OF01AI4XT.51.29.C07.1.454.CMB.1.raw
  modified_base (119)..(136): a, c, t, g, unknown or other
  misc_feature (119)..(136): n is a, c, g, or t
tcagcgatcgtatacacgaccggtgctcgatttagagtgctacgaagggtaagggcagcgtcactctgttcccaccctcctctcgtaagcactctgagcgggctggcaaggcgcatagnnnnnnnnnnnnnnnnnn

SEQ ID NO: 194524 - DNA, 118 bp, Homo sapiens; identical to SEQ ID NO: 194139
  misc_feature: GYAE6OF01CJ2TB.51.29.C07.1.454.CMB.1.raw
  modified_base (118)..(118): a, c, t, g, unknown or other
  misc_feature (118)..(118): n is a, c, g, or t

SEQ ID NO: 194525 - DNA, 116 bp, Homo sapiens; identical to SEQ ID NO: 194100
  misc_feature: GYAE6OF01CYZYL.51.29.C07.1.454.CMB.1.raw
  modified_base (116)..(116): a, c, t, g, unknown or other
  misc_feature (116)..(116): n is a, c, g, or t

SEQ ID NO: 194526 - DNA, 142 bp, Homo sapiens
  misc_feature: GYAE6OF01DO4YS.51.29.C07.1.454.CMB.1.raw
  modified_base (119)..(142): a, c, t, g, unknown or other
  misc_feature (119)..(142): n is a, c, g, or t
tcagcgatcgtatacacgaccggtgctcgatttagagtgctacgaagggaaaggggcagcgtcactctgttcccgccctcctctcgtagcactctgagcgggctggcaaggcgcatagnnnnnnnnnnnnnnnnnnnnnnnn

SEQ ID NO: 194527 - DNA, 124 bp, Homo sapiens
  misc_feature: GYAE6OF01CSH5Y.51.29.C07.1.454.CMB.1.raw
  modified_base (117)..(124): a, c, t, g, unknown or other
  misc_feature (117)..(124): n is a, c, g, or t
tcagcgatcgtatacacgaccggtgctcgatttagagtgctacgaagggaagggcagcgtcactctgttcccaccctcctctcgtagcactctgagcgggctggcaaggctcatagnnnnnnnn

SEQ ID NO: 194528 - DNA, 118 bp, Homo sapiens; identical to SEQ ID NO: 194139
  misc_feature: GYAE6OF01BPDKP.51.29.C07.1.454.CMB.1.raw
  modified_base (118)..(118): a, c, t, g, unknown or other
  misc_feature (118)..(118): n is a, c, g, or t

SEQ ID NO: 194529 - DNA, 119 bp, Homo sapiens; identical to SEQ ID NO: 194160
  misc_feature: GYAE6OF01BEPGU.51.29.C07.1.454.CMB.1.raw
  modified_base (118)..(119): a, c, t, g, unknown or other
  misc_feature (118)..(119): n is a, c, g, or t

SEQ ID NO: 194530 - DNA, 118 bp, Homo sapiens; identical to SEQ ID NO: 194140
  misc_feature: GYAE6OF01BK10L.51.29.C07.1.454.CMB.1.raw
  modified_base (118)..(118): a, c, t, g, unknown or other
  misc_feature (118)..(118): n is a, c, g, or t

SEQ ID NO: 194531 - DNA, 171 bp, Homo sapiens
  misc_feature: GYAE6OF01BQD27.51.29.C07.1.454.CMB.1.raw
  modified_base (113)..(113): a, c, t, g, unknown or other
  misc_feature (113)..(113): n is a, c, g, or t
  modified_base (119)..(119): a, c, t, g, unknown or other
  misc_feature (119)..(119): n is a, c, g, or t
  modified_base (121)..(171): a, c, t, g, unknown or other
  misc_feature (121)..(171): n is a, c, g, or t
tcagcgatcgtatacacgaccggtgctcgatttagagtgctacgaagggaaaggggcagcgtcacttctgttcccaccctcctctcgtagcactctgagcggctggcaaggcncatagncnnnnnnnnnnnnnnnnnnnnnnnnnnnnnnnnnnnnnnnnnnnnnnnnnnn

SEQ ID NO: 194532 - DNA, 126 bp, Homo sapiens
  misc_feature: GYAE6OF01E59FF.51.29.C07.1.454.CMB.1.raw
  modified_base (116)..(126): a, c, t, g, unknown or other
  misc_feature (116)..(126): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnnnnnnnnn

SEQ ID NO: 194533 - DNA, 119 bp, Homo sapiens; identical to SEQ ID NO: 194316
  misc_feature: GYAE6OF01D6CCU.51.29.C07.1.454.CMB.1.raw
  modified_base (117)..(119): a, c, t, g, unknown or other
  misc_feature (117)..(119): n is a, c, g, or t

SEQ ID NO: 194534 - DNA, 117 bp, Homo sapiens; identical to SEQ ID NO: 194147
  misc_feature: GYAE6OF01C7U4D.51.29.C07.1.454.CMB.1.raw

SEQ ID NO: 194535 - DNA, 118 bp, Homo sapiens; identical to SEQ ID NO: 194140
  misc_feature: GYAE6OF01A19JA.51.29.C07.1.454.CMB.1.raw
  modified_base (118)..(118): a, c, t, g, unknown or other
  misc_feature (118)..(118): n is a, c, g, or t

SEQ ID NO: 194536 - DNA, 118 bp, Homo sapiens
  misc_feature: GYAE6OF01EKOKF.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccaccctcctctcatagcactctgagcgggctggcaaggcgcatagn

SEQ ID NO: 194537 - DNA, 159 bp, Homo sapiens
  misc_feature: GYAE6OF01CKJA0.51.29.C07.1.454.CMB.1.raw
  modified_base (159)..(159): a, c, t, g, unknown or other
  misc_feature (159)..(159): n is a, c, g, or t
tcagcgatcgtatacacgaccggtgctcgatttagagtgctacgaagggaaagggcacgaccggtgctcgatttagagtgctacgaagggaagggcagcgtcactctgttcccaccctcctcctcgtagcactctgagcgggctggcaaggcgcatagn

SEQ ID NO: 194538 - DNA, 118 bp, Homo sapiens; identical to SEQ ID NO: 194140
  misc_feature: GYAE6OF01CG85F.51.29.C07.1.454.CMB.1.raw
  modified_base (118)..(118): a, c, t, g, unknown or other
  misc_feature (118)..(118): n is a, c, g, or t

SEQ ID NO: 194539 - DNA, 119 bp, Homo sapiens; identical to SEQ ID NO: 194137
  misc_feature: GYAE6OF01CH8F7.51.29.C07.1.454.CMB.1.raw
  modified_base (118)..(119): a, c, t, g, unknown or other
  misc_feature (118)..(119): n is a, c, g, or t

SEQ ID NO: 194540 - DNA, 118 bp, Homo sapiens; identical to SEQ ID NO: 194139
  misc_feature: GYAE6OF01BRY7J.51.29.C07.1.454.CMB.1.raw
  modified_base (118)..(118): a, c, t, g, unknown or other
  misc_feature (118)..(118): n is a, c, g, or t

SEQ ID NO: 194541 - DNA, 118 bp, Homo sapiens; identical to SEQ ID NO: 194139
  misc_feature: GYAE6OF01APRMV.51.29.C07.1.454.CMB.1.raw
  modified_base (118)..(118): a, c, t, g, unknown or other
  misc_feature (118)..(118): n is a, c, g, or t

SEQ ID NO: 194542 - DNA, 118 bp, Homo sapiens; identical to SEQ ID NO: 194140
  misc_feature: GYAE6OF01CQQ18.51.29.C07.1.454.CMB.1.raw
  modified_base (118)..(118): a, c, t, g, unknown or other
  misc_feature (118)..(118): n is a, c, g, or t

SEQ ID NO: 194543 - DNA, 118 bp, Homo sapiens; identical to SEQ ID NO: 194139
  misc_feature: GYAE6OF01CRJ77.51.29.C07.1.454.CMB.1.raw
  modified_base (118)..(118): a, c, t, g, unknown or other
  misc_feature (118)..(118): n is a, c, g, or t

SEQ ID NO: 194544 - DNA, 118 bp, Homo sapiens
  misc_feature: GYAE6OF01DP7RR.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtaactctgttcccaccctcctctcgtagcactctgagcgggctggcaaggcgcatagn

SEQ ID NO: 194545 - DNA, 118 bp, Homo sapiens; identical to SEQ ID NO: 194140
  misc_feature: GYAE6OF01AF8JQ.51.29.C07.1.454.CMB.1.raw
  modified_base (118)..(118): a, c, t, g, unknown or other
  misc_feature (118)..(118): n is a, c, g, or t

SEQ ID NO: 194546 - DNA, 116 bp, Homo sapiens; identical to SEQ ID NO: 194261
  misc_feature: GYAE6OF01BC2W2.51.29.C07.1.454.CMB.1.raw

SEQ ID NO: 194547 - DNA, 117 bp, Homo sapiens; identical to SEQ ID NO: 194173
  misc_feature: GYAE6OF01CQ1R5.51.29.C07.1.454.CMB.1.raw
  modified_base (117)..(117): a, c, t, g, unknown or other
  misc_feature (117)..(117): n is a, c, g, or t

SEQ ID NO: 194548 - DNA, 118 bp, Homo sapiens; identical to SEQ ID NO: 194140
  misc_feature: GYAE6OF01A62AO.51.29.C07.1.454.CMB.1.raw
  modified_base (118)..(118): a, c, t, g, unknown or other
  misc_feature (118)..(118): n is a, c, g, or t

SEQ ID NO: 194549 - DNA, 161 bp, Homo sapiens
  misc_feature: GYAE6OF01BQOQT.51.29.C07.1.454.CMB.1.raw
  modified_base (159)..(161): a, c, t, g, unknown or other
  misc_feature (159)..(161): n is a, c, g, or t
tcagcgatcgtatacacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatagnnn

SEQ ID NO: 194550 - DNA, 118 bp, Homo sapiens; identical to SEQ ID NO: 194139
  misc_feature: GYAE6OF01DHL4V.51.29.C07.1.454.CMB.1.raw
  modified_base (118)..(118): a, c, t, g, unknown or other
  misc_feature (118)..(118): n is a, c, g, or t

SEQ ID NO: 194551 - DNA, 116 bp, Homo sapiens; identical to SEQ ID NO: 194218
  misc_feature: GYAE6OF01BCK7Q.51.29.C07.1.454.CMB.1.raw

SEQ ID NO: 194552 - DNA, 124 bp, Homo sapiens; identical to SEQ ID NO: 194227
  misc_feature: GYAE6OF01AQTQJ.51.29.C07.1.454.CMB.1.raw
  modified_base (118)..(124): a, c, t, g, unknown or other
  misc_feature (118)..(124): n is a, c, g, or t

SEQ ID NO: 194553 - DNA, 127 bp, Homo sapiens; identical to SEQ ID NO: 194501
  misc_feature: GYAE6OF01B5LS1.51.29.C07.1.454.CMB.1.raw
  modified_base (118)..(127): a, c, t, g, unknown or other
  misc_feature (118)..(127): n is a, c, g, or t

SEQ ID NO: 194554 - DNA, 121 bp, Homo sapiens; identical to SEQ ID NO: 194352
  misc_feature: GYAE6OF01C0XTC.51.29.C07.1.454.CMB.1.raw
  modified_base (118)..(121): a, c, t, g, unknown or other
  misc_feature (118)..(121): n is a, c, g, or t

SEQ ID NO: 194555 - DNA, 118 bp, Homo sapiens; identical to SEQ ID NO: 194481
  misc_feature: GYAE6OF01EBXTU.51.29.C07.1.454.CMB.1.raw
  modified_base (117)..(118): a, c, t, g, unknown or other
  misc_feature (117)..(118): n is a, c, g, or t

SEQ ID NO: 194556 - DNA, 118 bp, Homo sapiens; identical to SEQ ID NO: 194149
  misc_feature: GYAE6OF01C778Z.51.29.C07.1.454.CMB.1.raw
  modified_base (117)..(118): a, c, t, g, unknown or other
  misc_feature (117)..(118): n is a, c, g, or t

SEQ ID NO: 194557 - DNA, 118 bp, Homo sapiens; identical to SEQ ID NO: 194140
  misc_feature: GYAE6OF01DQKRO.51.29.C07.1.454.CMB.1.raw
  modified_base (118)..(118): a, c, t, g, unknown or other
  misc_feature (118)..(118): n is a, c, g, or t

SEQ ID NO: 194558 - DNA, 117 bp, Homo sapiens; identical to SEQ ID NO: 194470
  misc_feature: GYAE6OF01CYUOJ.51.29.C07.1.454.CMB.1.raw
  modified_base (117)..(117): a, c, t, g, unknown or other
  misc_feature (117)..(117): n is a, c, g, or t

SEQ ID NO: 194559 - DNA, 119 bp, Homo sapiens; identical to SEQ ID NO: 194316
  misc_feature: GYAE6OF01A3EGX.51.29.C07.1.454.CMB.1.raw
  modified_base (117)..(119): a, c, t, g, unknown or other
  misc_feature (117)..(119): n is a, c, g, or t

SEQ ID NO: 194560 - DNA, 167 bp, Homo sapiens
  misc_feature: GYAE6OF01EGYYH.51.29.C07.1.454.CMB.1.raw
  modified_base (165)..(167): a, c, t, g, unknown or other
  misc_feature (165)..(167): n is a, c, g, or t
tcagcgatcgtatacacgaccggtgctcgatttagagtgctacgaagggaaagggcacgaccggtgctcgatttacgacgtcgctacgaagggaaggcagcgtcacgtctggttcccaacccgtcctctacgtagcactctgagcgggctggcaaggcgcatagnnn

SEQ ID NO: 194561 - DNA, 117 bp, Homo sapiens; identical to SEQ ID NO: 194206
  misc_feature: GYAE6OF01ESKJV.51.29.C07.1.454.CMB.1.raw

SEQ ID NO: 194562 - DNA, 119 bp, Homo sapiens; identical to SEQ ID NO: 194316
  misc_feature: GYAE6OF01CKPMY.51.29.C07.1.454.CMB.1.raw
  modified_base (117)..(119): a, c, t, g, unknown or other
  misc_feature (117)..(119): n is a, c, g, or t

SEQ ID NO: 194563 - DNA, 158 bp, Homo sapiens
  misc_feature: GYAE6OF01CRXJO.51.29.C07.1.454.CMB.1.raw
  modified_base (158)..(158): a, c, t, g, unknown or other
  misc_feature (158)..(158): n is a, c, g, or t
tcagcgatcgtatacacgaccggtgctcgatttagagtgctacgaagggaaagggcacgaccggtgctcgatttagagtgctacgaagggaaaggcagcgtcactctgttcccaccctcctctcgtagcactctgagcgggctggcaaggcgcatagn

SEQ ID NO: 194564 - DNA, 118 bp, Homo sapiens; identical to SEQ ID NO: 194139
  misc_feature: GYAE6OF01AO37L.51.29.C07.1.454.CMB.1.raw
  modified_base (118)..(118): a, c, t, g, unknown or other
  misc_feature (118)..(118): n is a, c, g, or t

SEQ ID NO: 194565 - DNA, 118 bp, Homo sapiens; identical to SEQ ID NO: 194140
  misc_feature: GYAE6OF01BF8JB.51.29.C07.1.454.CMB.1.raw
  modified_base (118)..(118): a, c, t, g, unknown or other
  misc_feature (118)..(118): n is a, c, g, or t

SEQ ID NO: 194566 - DNA, 117 bp, Homo sapiens
  misc_feature: GYAE6OF01DGPZB.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccaccctcctctgtagcactctgagcgggctggcaaggcgcatagn

SEQ ID NO: 194567 - DNA, 118 bp, Homo sapiens; identical to SEQ ID NO: 194139
  misc_feature: GYAE6OF01AX3GT.51.29.C07.1.454.CMB.1.raw
  modified_base (118)..(118): a, c, t, g, unknown or other
  misc_feature (118)..(118): n is a, c, g, or t

SEQ ID NO: 194568 - DNA, 121 bp, Homo sapiens; identical to SEQ ID NO: 194352
  misc_feature: GYAE6OF01DWYPR.51.29.C07.1.454.CMB.1.raw
  modified_base (118)..(121): a, c, t, g, unknown or other
  misc_feature (118)..(121): n is a, c, g, or t

SEQ ID NO: 194569 - DNA, 130 bp, Homo sapiens
  misc_feature: GYAE6OF01EFYL6.51.29.C07.1.454.CMB.1.raw
  modified_base (117)..(130): a, c, t, g, unknown or other
  misc_feature (117)..(130): n is a, c, g, or t
tcagcgatcgtatacacgaccggtgctcgatttagagtgctacgaagggaagggcgagcgtcactctgttcccgcctcctctcgtagcatctgagcgggctggcaaggcgtcatagnnnnnnnnnnnnnn

SEQ ID NO: 194570 - DNA, 150 bp, Homo sapiens
  misc_feature: GYAE6OF01D447G.51.29.C07.1.454.CMB.1.raw
  modified_base (119)..(150): a, c, t, g, unknown or other
  misc_feature (119)..(150): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnnnnnnnnnnnnnnnnnnnnnnnnnnnnnn

SEQ ID NO: 194571 - DNA, 125 bp, Homo sapiens
  misc_feature: GYAE6OF01EN3QB.51.29.C07.1.454.CMB.1.raw
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnn

SEQ ID NO: 194572 - DNA, 117 bp, Homo sapiens; identical to SEQ ID NO: 194147
  misc_feature: GYAE6OF01CR0C9.51.29.C07.1.454.CMB.1.raw

SEQ ID NO: 194573 - DNA, 118 bp, Homo sapiens; identical to SEQ ID NO: 194139
  misc_feature: GYAE6OF01ECIB8.51.29.C07.1.454.CMB.1.raw
  modified_base (118)..(118): a, c, t, g, unknown or other
  misc_feature (118)..(118): n is a, c, g, or t

SEQ ID NO: 194574 - DNA, 118 bp, Homo sapiens; identical to SEQ ID NO: 194140
  misc_feature: GYAE6OF01DP79G.51.29.C07.1.454.CMB.1.raw
  modified_base (118)..(118): a, c, t, g, unknown or other
  misc_feature (118)..(118): n is a, c, g, or t

SEQ ID NO: 194575 - DNA, 123 bp, Homo sapiens
  misc_feature: GYAE6OF01CN9MQ.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnnn

SEQ ID NO: 194576 - DNA, 127 bp, Homo sapiens; identical to SEQ ID NO: 194501
  misc_feature: GYAE6OF01D6UPJ.51.29.C07.1.454.CMB.1.raw
  modified_base (118)..(127): a, c, t, g, unknown or other
  misc_feature (118)..(127): n is a, c, g, or t

SEQ ID NO: 194577 - DNA, 116 bp, Homo sapiens; identical to SEQ ID NO: 194131
  misc_feature: GYAE6OF01ACJO7.51.29.C07.1.454.CMB.1.raw
  modified_base (116)..(116): a, c, t, g, unknown or other
  misc_feature (116)..(116): n is a, c, g, or t

SEQ ID NO: 194578 - DNA, 118 bp, Homo sapiens; identical to SEQ ID NO: 194139
  misc_feature: GYAE6OF01CM4LU.51.29.C07.1.454.CMB.1.raw
  modified_base (118)..(118): a, c, t, g, unknown or other
  misc_feature (118)..(118): n is a, c, g, or t

SEQ ID NO: 194579 - DNA, 118 bp, Homo sapiens; identical to SEQ ID NO: 194139
  misc_feature: GYAE6OF01C2KIC.51.29.C07.1.454.CMB.1.raw
  modified_base (118)..(118): a, c, t, g, unknown or other
  misc_feature (118)..(118): n is a, c, g, or t

SEQ ID NO: 194580 - DNA, 127 bp, Homo sapiens
  misc_feature: GYAE6OF01BCW46.51.29.C07.1.454.CMB.1.raw
  modified_base (110)..(110): a, c, t, g, unknown or other
  misc_feature (110)..(110): n is a, c, g, or t
  modified_base (116)..(127): a, c, t, g, unknown or other
  misc_feature (116)..(127): n is a, c, g, or t
tcagcgatcgtatacacgaccggtgctcgatttagagtgctacgaagggaagggcagcgtcactctgttcccaccctcctctcgtagcactctgagcggctggcaaggcncatagnnnnnnnnnnnn

SEQ ID NO: 194581 - DNA, 192 bp, Homo sapiens
  misc_feature: GYAE6OF01DZ4PU.51.29.C07.1.454.CMB.1.raw
  modified_base (165)..(192): a, c, t, g, unknown or other
  misc_feature (165)..(192): n is a, c, g, or t
tcagcgatcgtatacacgaccggtgctcgatttagagtgctacgaagggaaagggcgacgaccggtgctcgatttagacgtgctacgaagggaagggcacgcgtcactctgttcccgccctcctcctcgtagcactctgacgcgggtctggcaaggcgcataagnnnnnnnnnnnnnnnnnnnnnnnnnnnn

SEQ ID NO: 194582 - DNA, 119 bp, Homo sapiens; identical to SEQ ID NO: 194160
  misc_feature: GYAE6OF01COP5X.51.29.C07.1.454.CMB.1.raw
  modified_base (118)..(119): a, c, t, g, unknown or other
  misc_feature (118)..(119): n is a, c, g, or t

SEQ ID NO: 194583 - DNA, 118 bp, Homo sapiens; identical to SEQ ID NO: 194139
  misc_feature: GYAE6OF01EJZPZ.51.29.C07.1.454.CMB.1.raw
  modified_base (118)..(118): a, c, t, g, unknown or other
  misc_feature (118)..(118): n is a, c, g, or t

SEQ ID NO: 194584 - DNA, 118 bp, Homo sapiens; identical to SEQ ID NO: 194140
  misc_feature: GYAE6OF01BJVWE.51.29.C07.1.454.CMB.1.raw
  modified_base (118)..(118): a, c, t, g, unknown or other
  misc_feature (118)..(118): n is a, c, g, or t

SEQ ID NO: 194585 - DNA, 128 bp, Homo sapiens
  misc_feature: GYAE6OF01CASKD.51.29.C07.1.454.CMB.1.raw
  modified_base (117)..(128): a, c, t, g, unknown or other
  misc_feature (117)..(128): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnnnnnnnn

SEQ ID NO: 194586 - DNA, 119 bp, Homo sapiens; identical to SEQ ID NO: 194160
  misc_feature: GYAE6OF01AR9S8.51.29.C07.1.454.CMB.1.raw
  modified_base (118)..(119): a, c, t, g, unknown or other
  misc_feature (118)..(119): n is a, c, g, or t

SEQ ID NO: 194587 - DNA, 117 bp, Homo sapiens; identical to SEQ ID NO: 194133
  misc_feature: GYAE6OF01EAJNF.51.29.C07.1.454.CMB.1.raw
  modified_base (117)..(117): a, c, t, g, unknown or other
  misc_feature (117)..(117): n is a, c, g, or t

SEQ ID NO: 194588 - DNA, 194 bp, Homo sapiens
  misc_feature: GYAE6OF01B9AL6.51.29.C07.1.454.CMB.1.raw
  modified_base (154)..(194): a, c, t, g, unknown or other
  misc_feature (154)..(194): n is a, c, g, or t
tcagcgatcgtatacacgaccggtgctcgatttagagtgctacgaagggaaagggcacgaccggtgctcgattagagtgctacgaaggaagggcagcgtcaccctgttcccacctctctcgtagcactctgagcggctggccaaggcgcatagnnnnnnnnnnnnnnnnnnnnnnnnnnnnnnnnnnnnnnnnn

SEQ ID NO: 194589 - DNA, 117 bp, Homo sapiens; identical to SEQ ID NO: 194133
  misc_feature: GYAE6OF01DQTL2.51.29.C07.1.454.CMB.1.raw
  modified_base (117)..(117): a, c, t, g, unknown or other
  misc_feature (117)..(117): n is a, c, g, or t

SEQ ID NO: 194590 - DNA, 117 bp, Homo sapiens; identical to SEQ ID NO: 194148
  misc_feature: GYAE6OF01CSADY.51.29.C07.1.454.CMB.1.raw
  modified_base (116)..(117): a, c, t, g, unknown or other
  misc_feature (116)..(117): n is a, c, g, or t

SEQ ID NO: 194591 - DNA, 118 bp, Homo sapiens; identical to SEQ ID NO: 194140
  misc_feature: GYAE6OF01AEQDV.51.29.C07.1.454.CMB.1.raw
  modified_base (118)..(118): a, c, t, g, unknown or other
  misc_feature (118)..(118): n is a, c, g, or t

SEQ ID NO: 194592 - DNA, 118 bp, Homo sapiens; identical to SEQ ID NO: 194140
  misc_feature: GYAE6OF01ECEQ1.51.29.C07.1.454.CMB.1.raw
  modified_base (118)..(118): a, c, t, g, unknown or other
  misc_feature (118)..(118): n is a, c, g, or t

SEQ ID NO: 194593 - DNA, 118 bp, Homo sapiens; identical to SEQ ID NO: 194139
  misc_feature: GYAE6OF01C17HH.51.29.C07.1.454.CMB.1.raw
  modified_base (118)..(118): a, c, t, g, unknown or other
  misc_feature (118)..(118): n is a, c, g, or t

SEQ ID NO: 194594 - DNA, 117 bp, Homo sapiens
  misc_feature: GYAE6OF01AB31G.51.29.C07.1.454.CMB.1.raw
  modified_base (109)..(109): a, c, t, g, unknown or other
  misc_feature (109)..(109): n is a, c, g, or t
  modified_base (114)..(117): a, c, t, g, unknown or other
  misc_feature (114)..(117): n is a, c, g, or t
tcagcgatcgtatacacgaccggtgctcgatttagagtgctacgaagggaaggcagcgtcactctgttcccgccctcctctcgtagcactctgagcggctggcaaggcncatgnnnn

SEQ ID NO: 194595 - DNA, 134 bp, Homo sapiens
  misc_feature: GYAE6OF01ARYDR.51.29.C07.1.454.CMB.1.raw
  modified_base (112)..(112): a, c, t, g, unknown or other
  misc_feature (112)..(112): n is a, c, g, or t
  modified_base (118)..(134): a, c, t, g, unknown or other
  misc_feature (118)..(134): n is a, c, g, or t
tcagcgatcgtatacacgaccggtgctcgatttagagtgctacgaagggaaagggcgagcgtcactctgttcccaccctcctctcgtagcactctgagcggctggcaaggcncatagnnnnnnnnnnnnnnnnn

SEQ ID NO: 194596 - DNA, 118 bp, Homo sapiens; identical to SEQ ID NO: 194139
  misc_feature: GYAE6OF01EK2R1.51.29.C07.1.454.CMB.1.raw
  modified_base (118)..(118): a, c, t, g, unknown or other
  misc_feature (118)..(118): n is a, c, g, or t

SEQ ID NO: 194597 - DNA, 118 bp, Homo sapiens; identical to SEQ ID NO: 194139
  misc_feature: GYAE6OF01BRV32.51.29.C07.1.454.CMB.1.raw
  modified_base (118)..(118): a, c, t, g, unknown or other
  misc_feature (118)..(118): n is a, c, g, or t

SEQ ID NO: 194598 - DNA, 140 bp, Homo sapiens
  misc_feature: GYAE6OF01C0PBX.51.29.C07.1.454.CMB.1.raw
  modified_base (117)..(140): a, c, t, g, unknown or other
  misc_feature (117)..(140): n is a, c, g, or t
tcagcgatcgtatacacgaccggtgctcgatttagagtgctacgaagggaagggcagcgtcactctgttcccaccctctctcgtagcactctgagcgggctggcaaggcgcattagnnnnnnnnnnnnnnnnnnnnnnnn

SEQ ID NO: 194599 - DNA, 118 bp, Homo sapiens; identical to SEQ ID NO: 194140
  misc_feature: GYAE6OF01DD0TA.51.29.C07.1.454.CMB.1.raw
  modified_base (118)..(118): a, c, t, g, unknown or other
  misc_feature (118)..(118): n is a, c, g, or t

SEQ ID NO: 194600 - DNA, 129 bp, Homo sapiens
  misc_feature: GYAE6OF01EGVEU.51.29.C07.1.454.CMB.1.raw
  modified_base (117)..(129): a, c, t, g, unknown or other
  misc_feature (117)..(129): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnn

SEQ ID NO: 194601 - DNA, 123 bp, Homo sapiens
  misc_feature: GYAE6OF01D0F6F.51.29.C07.1.454.CMB.1.raw
  modified_base (111)..(111): a, c, t, g, unknown or other
  misc_feature (111)..(111): n is a, c, g, or t
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnn

SEQ ID NO: 194602 - DNA, 118 bp, Homo sapiens; identical to SEQ ID NO: 194140
  misc_feature: GYAE6OF01D0DRO.51.29.C07.1.454.CMB.1.raw
  modified_base (118)..(118): a, c, t, g, unknown or other
  misc_feature (118)..(118): n is a, c, g, or t

SEQ ID NO: 194603 - DNA, 118 bp, Homo sapiens; identical to SEQ ID NO: 194140
  misc_feature: GYAE6OF01AJC06.51.29.C07.1.454.CMB.1.raw
  modified_base (118)..(118): a, c, t, g, unknown or other
  misc_feature (118)..(118): n is a, c, g, or t

SEQ ID NO: 194604 - DNA, 132 bp, Homo sapiens
  misc_feature: GYAE6OF01CZDUX.51.29.C07.1.454.CMB.1.raw
  modified_base (118)..(132): a, c, t, g, unknown or other
  misc_feature (118)..(132): n is a, c, g, or t
tcagcgatcgtatacacgaccggtgctcgatttagagtgctacgaagggaaagggcagcgtcactctgttcccaccctcctctcgtagcactctgagccggctggcaaggcgcatagnnnnnnnnnnnnnnn

SEQ ID NO: 194605 - DNA, 118 bp, Homo sapiens; identical to SEQ ID NO: 194140
  misc_feature: GYAE6OF01E20XM.51.29.C07.1.454.CMB.1.raw
  modified_base (118)..(118): a, c, t, g, unknown or other
  misc_feature (118)..(118): n is a, c, g, or t

SEQ ID NO: 194606 - DNA, 118 bp, Homo sapiens; identical to SEQ ID NO: 194140
  misc_feature: GYAE6OF01AZ3B1.51.29.C07.1.454.CMB.1.raw
  modified_base (118)..(118): a, c, t, g, unknown or other
  misc_feature (118)..(118): n is a, c, g, or t

SEQ ID NO: 194607 - DNA, 117 bp, Homo sapiens; identical to SEQ ID NO: 194133
  misc_feature: GYAE6OF01B7P0Q.51.29.C07.1.454.CMB.1.raw
  modified_base (117)..(117): a, c, t, g, unknown or other
  misc_feature (117)..(117): n is a, c, g, or t

SEQ ID NO: 194608 - DNA, 142 bp, Homo sapiens
  misc_feature: GYAE6OF01EX238.51.29.C07.1.454.CMB.1.raw
  modified_base (120)..(142): a, c, t, g, unknown or other
  misc_feature (120)..(142): n is a, c, g, or t
tcagcgatcgtatacacgaccggtgctcgatttagagtgctacgaagggaaagggcaggcgtcactctgttcccgccctcctctcgtagcactctgagcgggctggcaaggccgcatagnnnnnnnnnnnnnnnnnnnnnnn

SEQ ID NO: 194609 - DNA, 116 bp, Homo sapiens; identical to SEQ ID NO: 194218
  misc_feature: GYAE6OF01B51AK.51.29.C07.1.454.CMB.1.raw

SEQ ID NO: 194610 - DNA, 117 bp, Homo sapiens; identical to SEQ ID NO: 194147
  misc_feature: GYAE6OF01CB18B.51.29.C07.1.454.CMB.1.raw

SEQ ID NO: 194611 - DNA, 118 bp, Homo sapiens; identical to SEQ ID NO: 194139
  misc_feature: GYAE6OF01DH6PJ.51.29.C07.1.454.CMB.1.raw
  modified_base (118)..(118): a, c, t, g, unknown or other
  misc_feature (118)..(118): n is a, c, g, or t

SEQ ID NO: 194612 - DNA, 115 bp, Homo sapiens
  misc_feature: GYAE6OF01EDHI3.51.29.C07.1.454.CMB.1.raw
tcagcgatcgtatacacgaccggtgctcgatttagagtgctacgaagggaaagggcagcgtcactctgttccccctcctctcgtagcactctgagcgggctggcaaggcgcatag

SEQ ID NO: 194613 - DNA, 128 bp, Homo sapiens
  misc_feature: GYAE6OF01BXFLF.51.29.C07.1.454.CMB.1.raw
  modified_base (118)..(128): a, c, t, g, unknown or other
  misc_feature (118)..(128): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnn

SEQ ID NO: 194614 - DNA, 119 bp, Homo sapiens; identical to SEQ ID NO: 194160
  misc_feature: GYAE6OF01D3ZFD.51.29.C07.1.454.CMB.1.raw
  modified_base (118)..(119): a, c, t, g, unknown or other
  misc_feature (118)..(119): n is a, c, g, or t

SEQ ID NO: 194615 - DNA, 118 bp, Homo sapiens; identical to SEQ ID NO: 194140
  misc_feature: GYAE6OF01DQHEX.51.29.C07.1.454.CMB.1.raw
  modified_base (118)..(118): a, c, t, g, unknown or other
  misc_feature (118)..(118): n is a, c, g, or t

SEQ ID NO: 194616 - DNA, 118 bp, Homo sapiens; identical to SEQ ID NO: 194140
  misc_feature: GYAE6OF01CFU86.51.29.C07.1.454.CMB.1.raw
  modified_base (118)..(118): a, c, t, g, unknown or other
  misc_feature (118)..(118): n is a, c, g, or t

SEQ ID NO: 194617 - DNA, 116 bp, Homo sapiens
  misc_feature: GYAE6OF01DHL9C.51.29.C07.1.454.CMB.1.raw
tcagcgatcgtatacacgaccggtgctcgatttagagtgctacgaagggaaagggcagcgtcactctgttcccacctcctctcgtagcactctgagcgggctggcaaggcgcatag

SEQ ID NO: 194618 - DNA, 118 bp, Homo sapiens; identical to SEQ ID NO: 194139
  misc_feature: GYAE6OF01ES2CS.51.29.C07.1.454.CMB.1.raw
  modified_base (118)..(118): a, c, t, g, unknown or other
  misc_feature (118)..(118): n is a, c, g, or t

SEQ ID NO: 194619 - DNA, 144 bp, Homo sapiens
  misc_feature: GYAE6OF01COIVI.51.29.C07.1.454.CMB.1.raw
  modified_base (121)..(144): a, c, t, g, unknown or other
  misc_feature (121)..(144): n is a, c, g, or t
tcagcgatcgtatacacgaccggtgctcgatttagagtgctacgaagggaaagggcagcgtcgactcgtgttcccaccctcctctcgtagcactcgtgagcgggctggcaaggcgcatagnnnnnnnnnnnnnnnnnnnnnnnn

SEQ ID NO: 194620 - DNA, 147 bp, Homo sapiens
  misc_feature: GYAE6OF01DNNSG.51.29.C07.1.454.CMB.1.raw
  modified_base (112)..(112): a, c, t, g, unknown or other
  misc_feature (112)..(112): n is a, c, g, or t
  modified_base (118)..(147): a, c, t, g, unknown or other
  misc_feature (118)..(147): n is a, c, g, or t
tcagcgatcgtatacacgaccggtgctcgatttagagtgctacgaagggaaaggcagcgtcactctgttcccaccctcctctcgtagcactctgacgcgggctggcaaggcncatagnnnnnnnnnnnnnnnnnnnnnnnnnnnnnn

SEQ ID NO: 194621 - DNA, 118 bp, Homo sapiens; identical to SEQ ID NO: 194140
  misc_feature: GYAE6OF01EDJBU.51.29.C07.1.454.CMB.1.raw
  modified_base (118)..(118): a, c, t, g, unknown or other
  misc_feature (118)..(118): n is a, c, g, or t

SEQ ID NO: 194622 - DNA, 122 bp, Homo sapiens; identical to SEQ ID NO: 194417
  misc_feature: GYAE6OF01BKYZ9.51.29.C07.1.454.CMB.1.raw
  modified_base (117)..(122): a, c, t, g, unknown or other
  misc_feature (117)..(122): n is a, c, g, or t

SEQ ID NO: 194623 - DNA, 144 bp, Homo sapiens
  misc_feature: GYAE6OF01AQ5TT.51.29.C07.1.454.CMB.1.raw
  modified_base (121)..(144): a, c, t, g, unknown or other
  misc_feature (121)..(144): n is a, c, g, or t
tcagcgatcgtatacacgaccggtgctcgatttagagtgctacgaagggaaaggggcagcggtcactctgttcccgccctccgtctcgtagcactctgagcggctggcaaggcgccatagnnnnnnnnnnnnnnnnnnnnnnnn

SEQ ID NO: 194624 - DNA, 117 bp, Homo sapiens; identical to SEQ ID NO: 194147
  misc_feature: GYAE6OF01EBWKM.51.29.C07.1.454.CMB.1.raw

SEQ ID NO: 194625 - DNA, 118 bp, Homo sapiens; identical to SEQ ID NO: 194139
  misc_feature: GYAE6OF01DQZR4.51.29.C07.1.454.CMB.1.raw
  modified_base (118)..(118): a, c, t, g, unknown or other
  misc_feature (118)..(118): n is a, c, g, or t

SEQ ID NO: 194626 - DNA, 124 bp, Homo sapiens; identical to SEQ ID NO: 194227
  misc_feature: GYAE6OF01B6AGN.51.29.C07.1.454.CMB.1.raw
  modified_base (118)..(124): a, c, t, g, unknown or other
  misc_feature (118)..(124): n is a, c, g, or t

SEQ ID NO: 194627 - DNA, 118 bp, Homo sapiens; identical to SEQ ID NO: 194140
  misc_feature: GYAE6OF01A2R7X.51.29.C07.1.454.CMB.1.raw
  modified_base (118)..(118): a, c, t, g, unknown or other
  misc_feature (118)..(118): n is a, c, g, or t

SEQ ID NO: 194628 - DNA, 119 bp, Homo sapiens; identical to SEQ ID NO: 194160
  misc_feature: GYAE6OF01BCO96.51.29.C07.1.454.CMB.1.raw
  modified_base (118)..(119): a, c, t, g, unknown or other
  misc_feature (118)..(119): n is a, c, g, or t

SEQ ID NO: 194629 - DNA, 118 bp, Homo sapiens; identical to SEQ ID NO: 194140
  misc_feature: GYAE6OF01CY0YK.51.29.C07.1.454.CMB.1.raw
  modified_base (118)..(118): a, c, t, g, unknown or other
  misc_feature (118)..(118): n is a, c, g, or t

SEQ ID NO: 194630 - DNA, 118 bp, Homo sapiens; identical to SEQ ID NO: 194139
  misc_feature: GYAE6OF01CQBSW.51.29.C07.1.454.CMB.1.raw
  modified_base (118)..(118): a, c, t, g, unknown or other
  misc_feature (118)..(118): n is a, c, g, or t

SEQ ID NO: 194631 - DNA, 122 bp, Homo sapiens
  misc_feature: GYAE6OF01C9S2L.51.29.C07.1.454.CMB.1.raw
  modified_base (118)..(122): a, c, t, g, unknown or other
  misc_feature (118)..(122): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnn

SEQ ID NO: 194632 - DNA, 119 bp, Homo sapiens; identical to SEQ ID NO: 194316
  misc_feature: GYAE6OF01DZ4TR.51.29.C07.1.454.CMB.1.raw
  modified_base (117)..(119): a, c, t, g, unknown or other
  misc_feature (117)..(119): n is a, c, g, or t

SEQ ID NO: 194633 - DNA, 117 bp, Homo sapiens
  misc_feature: GYAE6OF01DRF2E.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctcctctcgtagactctgagcgggctggcaaggcgcatagn

SEQ ID NO: 194634 - DNA, 159 bp, Homo sapiens
  misc_feature: GYAE6OF01ARKI1.51.29.C07.1.454.CMB.1.raw
  modified_base (159)..(159): a, c, t, g, unknown or other
  misc_feature (159)..(159): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagn

SEQ ID NO: 194635 - DNA, 118 bp, Homo sapiens; identical to SEQ ID NO: 194139
  misc_feature: GYAE6OF01CBT7C.51.29.C07.1.454.CMB.1.raw
  modified_base (118)..(118): a, c, t, g, unknown or other
  misc_feature (118)..(118): n is a, c, g, or t

SEQ ID NO: 194636 - DNA, 118 bp, Homo sapiens; identical to SEQ ID NO: 194140
  misc_feature: GYAE6OF01ETXK7.51.29.C07.1.454.CMB.1.raw
  modified_base (118)..(118): a, c, t, g, unknown or other
  misc_feature (118)..(118): n is a, c, g, or t

SEQ ID NO: 194637 - DNA, 117 bp, Homo sapiens; identical to SEQ ID NO: 194206
  misc_feature: GYAE6OF01CPAC5.51.29.C07.1.454.CMB.1.raw

SEQ ID NO: 194638 - DNA, 123 bp, Homo sapiens
  misc_feature: GYAE6OF01BO9KJ.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnn

SEQ ID NO: 194639 - DNA, 119 bp, Homo sapiens; identical to SEQ ID NO: 194137
  misc_feature: GYAE6OF01BF3QV.51.29.C07.1.454.CMB.1.raw
  modified_base (118)..(119): a, c, t, g, unknown or other
  misc_feature (118)..(119): n is a, c, g, or t

SEQ ID NO: 194640 - DNA, 117 bp, Homo sapiens; identical to SEQ ID NO: 194133
  misc_feature: GYAE6OF01AW3J0.51.29.C07.1.454.CMB.1.raw
  modified_base (117)..(117): a, c, t, g, unknown or other
  misc_feature (117)..(117): n is a, c, g, or t

SEQ ID NO: 194641 - DNA, 118 bp, Homo sapiens; identical to SEQ ID NO: 194140
  misc_feature: GYAE6OF01CMMY0.51.29.C07.1.454.CMB.1.raw
  modified_base (118)..(118): a, c, t, g, unknown or other
  misc_feature (118)..(118): n is a, c, g, or t

SEQ ID NO: 194642 - DNA, 117 bp, Homo sapiens; identical to SEQ ID NO: 194133
  misc_feature: GYAE6OF01B3YQR.51.29.C07.1.454.CMB.1.raw
  modified_base (117)..(117): a, c, t, g, unknown or other
  misc_feature (117)..(117): n is a, c, g, or t

SEQ ID NO: 194643 - DNA, 118 bp, Homo sapiens
  misc_feature: GYAE6OF01DY9W3.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgtttccaccctcctctcgtagcactctgagcgggctggcaaggcgcatagn

SEQ ID NO: 194644 - DNA, 117 bp, Homo sapiens; identical to SEQ ID NO: 194133
  misc_feature: GYAE6OF01BSIRH.51.29.C07.1.454.CMB.1.raw
  modified_base (117)..(117): a, c, t, g, unknown or other
  misc_feature (117)..(117): n is a, c, g, or t

SEQ ID NO: 194645 - DNA, 119 bp, Homo sapiens; identical to SEQ ID NO: 194160
  misc_feature: GYAE6OF01AYZ7M.51.29.C07.1.454.CMB.1.raw
  modified_base (118)..(119): a, c, t, g, unknown or other
  misc_feature (118)..(119): n is a, c, g, or t

SEQ ID NO: 194646 - DNA, 117 bp, Homo sapiens; identical to SEQ ID NO: 194206
  misc_feature: GYAE6OF01CL0D9.51.29.C07.1.454.CMB.1.raw

SEQ ID NO: 194647 - DNA, 126 bp, Homo sapiens
  misc_feature: GYAE6OF01BX3H8.51.29.C07.1.454.CMB.1.raw
  modified_base (118)..(126): a, c, t, g, unknown or other
  misc_feature (118)..(126): n is a, c, g, or t
tcagcgatcgtatacacgaccggtgctcgatttagagtgctacgaagggaaagggcagcggtcactctgttcccgccctcctctcgtagcactctgagcggctggcaaggcgcatagnnnnnnnnn

SEQ ID NO: 194648 - DNA, 135 bp, Homo sapiens
  misc_feature: GYAE6OF01A8B56.51.29.C07.1.454.CMB.1.raw
  modified_base (113)..(113): a, c, t, g, unknown or other
  misc_feature (113)..(113): n is a, c, g, or t
  modified_base (119)..(135): a, c, t, g, unknown or other
  misc_feature (119)..(135): n is a, c, g, or t
tcagcgatcgtatacacgaccggtgctcgatttagagtgctacgaagggaaagggcagcgtcactctgttcccgccctcctctcgtagcactctgagcgggctggcaagggcncatagnnnnnnnnnnnnnnnnn

SEQ ID NO: 194649 - DNA, 118 bp, Homo sapiens; identical to SEQ ID NO: 194140
  misc_feature: GYAE6OF01CYUWA.51.29.C07.1.454.CMB.1.raw
  modified_base (118)..(118): a, c, t, g, unknown or other
  misc_feature (118)..(118): n is a, c, g, or t

SEQ ID NO: 194650 - DNA, 122 bp, Homo sapiens
  misc_feature: GYAE6OF01B3XL0.51.29.C07.1.454.CMB.1.raw
  modified_base (117)..(122): a, c, t, g, unknown or other
  misc_feature (117)..(122): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnn

SEQ ID NO: 194651 - DNA, 121 bp, Homo sapiens
  misc_feature: GYAE6OF01BC67T.51.29.C07.1.454.CMB.1.raw
  modified_base (118)..(121): a, c, t, g, unknown or other
  misc_feature (118)..(121): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnn

SEQ ID NO: 194652 - DNA, 118 bp, Homo sapiens; identical to SEQ ID NO: 194140
  misc_feature: GYAE6OF01AOG6T.51.29.C07.1.454.CMB.1.raw
  modified_base (118)..(118): a, c, t, g, unknown or other
  misc_feature (118)..(118): n is a, c, g, or t

SEQ ID NO: 194653 - DNA, 118 bp, Homo sapiens; identical to SEQ ID NO: 194139
  misc_feature: GYAE6OF01D1N5U.51.29.C07.1.454.CMB.1.raw
  modified_base (118)..(118): a, c, t, g, unknown or other
  misc_feature (118)..(118): n is a, c, g, or t

SEQ ID NO: 194654 - DNA, 117 bp, Homo sapiens; identical to SEQ ID NO: 194147
  misc_feature: GYAE6OF01CVJX3.51.29.C07.1.454.CMB.1.raw

SEQ ID NO: 194655 - DNA, 125 bp, Homo sapiens; identical to SEQ ID NO: 194571
  misc_feature: GYAE6OF01AO54F.51.29.C07.1.454.CMB.1.raw
  modified_base (117)..(125): a, c, t, g, unknown or other
  misc_feature (117)..(125): n is a, c, g, or t

SEQ ID NO: 194656 - DNA, 118 bp, Homo sapiens; identical to SEQ ID NO: 194140
  misc_feature: GYAE6OF01DB3NX.51.29.C07.1.454.CMB.1.raw
  modified_base (118)..(118): a, c, t, g, unknown or other
  misc_feature (118)..(118): n is a, c, g, or t

SEQ ID NO: 194657 - DNA, 118 bp, Homo sapiens; identical to SEQ ID NO: 194140
  misc_feature: GYAE6OF01BO53E.51.29.C07.1.454.CMB.1.raw
  modified_base (118)..(118): a, c, t, g, unknown or other
  misc_feature (118)..(118): n is a, c, g, or t

SEQ ID NO: 194658 - DNA, 127 bp, Homo sapiens; identical to SEQ ID NO: 194501
  misc_feature: GYAE6OF01COZWZ.51.29.C07.1.454.CMB.1.raw
  modified_base (118)..(127): a, c, t, g, unknown or other
  misc_feature (118)..(127): n is a, c, g, or t

SEQ ID NO: 194659 - DNA, 119 bp, Homo sapiens; identical to SEQ ID NO: 194137
  misc_feature: GYAE6OF01EF6GN.51.29.C07.1.454.CMB.1.raw
  modified_base (118)..(119): a, c, t, g, unknown or other
  misc_feature (118)..(119): n is a, c, g, or t

SEQ ID NO: 194660 - DNA, 119 bp, Homo sapiens; identical to SEQ ID NO: 194137
  misc_feature: GYAE6OF01BA9AL.51.29.C07.1.454.CMB.1.raw
  modified_base (118)..(119): a, c, t, g, unknown or other
  misc_feature (118)..(119): n is a, c, g, or t

SEQ ID NO: 194661 - DNA, 120 bp, Homo sapiens; identical to SEQ ID NO: 194312
  misc_feature: GYAE6OF01EVPDX.51.29.C07.1.454.CMB.1.raw
  modified_base (117)..(120): a, c, t, g, unknown or other
  misc_feature (117)..(120): n is a, c, g, or t

SEQ ID NO: 194662 - DNA, 120 bp, Homo sapiens; identical to SEQ ID NO: 194312
  misc_feature: GYAE6OF01A5OG2.51.29.C07.1.454.CMB.1.raw
  modified_base (117)..(120): a, c, t, g, unknown or other
  misc_feature (117)..(120): n is a, c, g, or t

SEQ ID NO: 194663 - DNA, 118 bp, Homo sapiens; identical to SEQ ID NO: 194139
  misc_feature: GYAE6OF01E1BWH.51.29.C07.1.454.CMB.1.raw
  modified_base (118)..(118): a, c, t, g, unknown or other
  misc_feature (118)..(118): n is a, c, g, or t

SEQ ID NO: 194664 - DNA, 122 bp, Homo sapiens; identical to SEQ ID NO: 194417
  misc_feature: GYAE6OF01A6BHU.51.29.C07.1.454.CMB.1.raw
  modified_base (117)..(122): a, c, t, g, unknown or other
  misc_feature (117)..(122): n is a, c, g, or t

SEQ ID NO: 194665 - DNA, 142 bp, Homo sapiens
  misc_feature: GYAE6OF01EJCUU.51.29.C07.1.454.CMB.1.raw
  modified_base (119)..(142): a, c, t, g, unknown or other
  misc_feature (119)..(142): n is a, c, g, or t
tcagcgatcgtatacacgaccggtgctcgatttagagtgctacgaagggaaagggcagcgtcactctgttcccgccctcctctcgtagcactctgagcgggctggcaaggcgcattagnnnnnnnnnnnnnnnnnnnnnnnn

SEQ ID NO: 194666 - DNA, 131 bp, Homo sapiens
  misc_feature: GYAE6OF01EBJA2.51.29.C07.1.454.CMB.1.raw
  modified_base (118)..(131): a, c, t, g, unknown or other
  misc_feature (118)..(131): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnn

SEQ ID NO: 194667 - DNA, 117 bp, Homo sapiens; identical to SEQ ID NO: 194147
  misc_feature: GYAE6OF01CKHHO.51.29.C07.1.454.CMB.1.raw

SEQ ID NO: 194668 - DNA, 126 bp, Homo sapiens
  misc_feature: GYAE6OF01D3W0Q.51.29.C07.1.454.CMB.1.raw
  modified_base (118)..(126): a, c, t, g, unknown or other
  misc_feature (118)..(126): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnn

SEQ ID NO: 194669 - DNA, 119 bp, Homo sapiens; identical to SEQ ID NO: 194137
  misc_feature: GYAE6OF01DZ1GB.51.29.C07.1.454.CMB.1.raw
  modified_base (118)..(119): a, c, t, g, unknown or other
  misc_feature (118)..(119): n is a, c, g, or t

SEQ ID NO: 194670 - DNA, 118 bp, Homo sapiens; identical to SEQ ID NO: 194140
  misc_feature: GYAE6OF01DAX01.51.29.C07.1.454.CMB.1.raw
  modified_base (118)..(118): a, c, t, g, unknown or other
  misc_feature (118)..(118): n is a, c, g, or t

SEQ ID NO: 194671 - DNA, 129 bp, Homo sapiens; identical to SEQ ID NO: 194159
  misc_feature: GYAE6OF01DYI6W.51.29.C07.1.454.CMB.1.raw
  modified_base (118)..(129): a, c, t, g, unknown or other
  misc_feature (118)..(129): n is a, c, g, or t

SEQ ID NO: 194672 - DNA, 118 bp, Homo sapiens; identical to SEQ ID NO: 194139
  misc_feature: GYAE6OF01E3D9Q.51.29.C07.1.454.CMB.1.raw
  modified_base (118)..(118): a, c, t, g, unknown or other
  misc_feature (118)..(118): n is a, c, g, or t

SEQ ID NO: 194673 - DNA, 122 bp, Homo sapiens; identical to SEQ ID NO: 194417
  misc_feature: GYAE6OF01BL7PQ.51.29.C07.1.454.CMB.1.raw
  modified_base (117)..(122): a, c, t, g, unknown or other
  misc_feature (117)..(122): n is a, c, g, or t

SEQ ID NO: 194674 - DNA, 133 bp, Homo sapiens
  misc_feature: GYAE6OF01D4NSA.51.29.C07.1.454.CMB.1.raw
  modified_base (119)..(133): a, c, t, g, unknown or other
  misc_feature (119)..(133): n is a, c, g, or t
tcagcgatcgtatacacgaccggtgctcgatttagagtgctacgaagggaaagggcacgcgtcactctgttcccgccctcctctcgtagcactctgagcgggctggcaaggcgcatagnnnnnnnnnnnnnnn

SEQ ID NO: 194675 - DNA, 123 bp, Homo sapiens; identical to SEQ ID NO: 194393
  misc_feature: GYAE6OF01BVQ1A.51.29.C07.1.454.CMB.1.raw
  modified_base (118)..(123): a, c, t, g, unknown or other
  misc_feature (118)..(123): n is a, c, g, or t

SEQ ID NO: 194676 - DNA, 118 bp, Homo sapiens; identical to SEQ ID NO: 194139
  misc_feature: GYAE6OF01CMFKH.51.29.C07.1.454.CMB.1.raw
  modified_base (118)..(118): a, c, t, g, unknown or other
  misc_feature (118)..(118): n is a, c, g, or t

SEQ ID NO: 194677 - DNA, 117 bp, Homo sapiens
  misc_feature: GYAE6OF01A2M17.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaaggcagcgtcactctgttcccaccctcctctcgtagcactctgagcgggctggcaaggcgcatagn

SEQ ID NO: 194678 - DNA, 118 bp, Homo sapiens; identical to SEQ ID NO: 194139
  misc_feature: GYAE6OF01B9HPP.51.29.C07.1.454.CMB.1.raw
  modified_base (118)..(118): a, c, t, g, unknown or other
  misc_feature (118)..(118): n is a, c, g, or t

SEQ ID NO: 194679 - DNA, 118 bp, Homo sapiens; identical to SEQ ID NO: 194139
  misc_feature: GYAE6OF01AM25K.51.29.C07.1.454.CMB.1.raw
  modified_base (118)..(118): a, c, t, g, unknown or other
  misc_feature (118)..(118): n is a, c, g, or t

SEQ ID NO: 194680 - DNA, 118 bp, Homo sapiens; identical to SEQ ID NO: 194139
  misc_feature: GYAE6OF01CWQX7.51.29.C07.1.454.CMB.1.raw
  modified_base (118)..(118): a, c, t, g, unknown or other
  misc_feature (118)..(118): n is a, c, g, or t

SEQ ID NO: 194681 - DNA, 117 bp, Homo sapiens; identical to SEQ ID NO: 194147
  misc_feature: GYAE6OF01B2F86.51.29.C07.1.454.CMB.1.raw

SEQ ID NO: 194682 - DNA, 118 bp, Homo sapiens; identical to SEQ ID NO: 194140
  misc_feature: GYAE6OF01BARHS.51.29.C07.1.454.CMB.1.raw
  modified_base (118)..(118): a, c, t, g, unknown or other
  misc_feature (118)..(118): n is a, c, g, or t

SEQ ID NO: 194683 - DNA, 160 bp, Homo sapiens; identical to SEQ ID NO: 194364
  misc_feature: GYAE6OF01AZAC9.51.29.C07.1.454.CMB.1.raw
  modified_base (159)..(160): a, c, t, g, unknown or other
  misc_feature (159)..(160): n is a, c, g, or t

SEQ ID NO: 194684 - DNA, 136 bp, Homo sapiens
  misc_feature: GYAE6OF01BQ8V4.51.29.C07.1.454.CMB.1.raw
  modified_base (118)..(136): a, c, t, g, unknown or other
  misc_feature (118)..(136): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnnnnnnnnn

SEQ ID NO: 194685 - DNA, 119 bp, Homo sapiens
  misc_feature: GYAE6OF01CIIFQ.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaagggcagcgtcactctgttcccaccctcctctcgtagcactcgagcgggctggcaaggcgcatagnnnn

SEQ ID NO: 194686 - DNA, 119 bp, Homo sapiens; identical to SEQ ID NO: 194160
  misc_feature: GYAE6OF01EN8VV.51.29.C07.1.454.CMB.1.raw
  modified_base (118)..(119): a, c, t, g, unknown or other
  misc_feature (118)..(119): n is a, c, g, or t

SEQ ID NO: 194687 - DNA, 121 bp, Homo sapiens; identical to SEQ ID NO: 194651
  misc_feature: GYAE6OF01DICR0.51.29.C07.1.454.CMB.1.raw
  modified_base (118)..(121): a, c, t, g, unknown or other
  misc_feature (118)..(121): n is a, c, g, or t

SEQ ID NO: 194688 - DNA, 117 bp, Homo sapiens; identical to SEQ ID NO: 194206
  misc_feature: GYAE6OF01ESQ3T.51.29.C07.1.454.CMB.1.raw

SEQ ID NO: 194689 - DNA, 120 bp, Homo sapiens
  misc_feature: GYAE6OF01BNTLL.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnn

SEQ ID NO: 194690 - DNA, 118 bp, Homo sapiens; identical to SEQ ID NO: 194140
  misc_feature: GYAE6OF01B9LR1.51.29.C07.1.454.CMB.1.raw
  modified_base (118)..(118): a, c, t, g, unknown or other
  misc_feature (118)..(118): n is a, c, g, or t

SEQ ID NO: 194691 - DNA, 118 bp, Homo sapiens; identical to SEQ ID NO: 194140
  misc_feature: GYAE6OF01BORTG.51.29.C07.1.454.CMB.1.raw
  modified_base (118)..(118): a, c, t, g, unknown or other
  misc_feature (118)..(118): n is a, c, g, or t

SEQ ID NO: 194692 - DNA, 118 bp, Homo sapiens; identical to SEQ ID NO: 194139
  misc_feature: GYAE6OF01ARQSA.51.29.C07.1.454.CMB.1.raw
  modified_base (118)..(118): a, c, t, g, unknown or other
  misc_feature (118)..(118): n is a, c, g, or t

SEQ ID NO: 194693 - DNA, 116 bp, Homo sapiens
  misc_feature: GYAE6OF01E53AL.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaggcagcgtcactctgttcccaccctcctctcgtagcactctgagcgggctggcaaggcgcatagn

SEQ ID NO: 194694 - DNA, 118 bp, Homo sapiens; identical to SEQ ID NO: 194139
  misc_feature: GYAE6OF01A6EKF.51.29.C07.1.454.CMB.1.raw
  modified_base (118)..(118): a, c, t, g, unknown or other
  misc_feature (118)..(118): n is a, c, g, or t

SEQ ID NO: 194695 - DNA, 126 bp, Homo sapiens
  misc_feature: GYAE6OF01CB7J3.51.29.C07.1.454.CMB.1.raw
  modified_base (109)..(109): a, c, t, g, unknown or other
  misc_feature (109)..(109): n is a, c, g, or t
  modified_base (115)..(126): a, c, t, g, unknown or other
  misc_feature (115)..(126): n is a, c, g, or t
tcagcgatcgtatacacgaccggtgctcgatttagagtgctacgaagggaagggcagcgtcactctgttcccaccctctctcgtagcactctgagcggctggcaaggcncatagnnnnnnnnnnnn

SEQ ID NO: 194696 - DNA, 118 bp, Homo sapiens; identical to SEQ ID NO: 194140
  misc_feature: GYAE6OF01E110Q.51.29.C07.1.454.CMB.1.raw
  modified_base (118)..(118): a, c, t, g, unknown or other
  misc_feature (118)..(118): n is a, c, g, or t

SEQ ID NO: 194697 - DNA, 127 bp, Homo sapiens; identical to SEQ ID NO: 194501
  misc_feature: GYAE6OF01A6LXS.51.29.C07.1.454.CMB.1.raw
  modified_base (118)..(127): a, c, t, g, unknown or other
  misc_feature (118)..(127): n is a, c, g, or t

SEQ ID NO: 194698 - DNA, 128 bp, Homo sapiens
  misc_feature: GYAE6OF01B4AFF.51.29.C07.1.454.CMB.1.raw
  modified_base (117)..(128): a, c, t, g, unknown or other
  misc_feature (117)..(128): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnn

SEQ ID NO: 194699 - DNA, 125 bp, Homo sapiens
  misc_feature: GYAE6OF01D50JG.51.29.C07.1.454.CMB.1.raw
  modified_base (118)..(125): a, c, t, g, unknown or other
  misc_feature (118)..(125): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnn

SEQ ID NO: 194700 - DNA, 172 bp, Homo sapiens
  misc_feature: GYAE6OF01A6QA6.51.29.C07.1.454.CMB.1.raw
  modified_base (159)..(172): a, c, t, g, unknown or other
  misc_feature (159)..(172): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnnnnnnnnnnnnn

SEQ ID NO: 194701 - DNA, 117 bp, Homo sapiens; identical to SEQ ID NO: 194147
  misc_feature: GYAE6OF01ETGXR.51.29.C07.1.454.CMB.1.raw

SEQ ID NO: 194702 - DNA, 121 bp, Homo sapiens
  misc_feature: GYAE6OF01BA3ZK.51.29.C07.1.454.CMB.1.raw
  modified_base (117)..(121): a, c, t, g, unknown or other
  misc_feature (117)..(121): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnn

SEQ ID NO: 194703 - DNA, 118 bp, Homo sapiens; identical to SEQ ID NO: 194149
  misc_feature: GYAE6OF01CDD46.51.29.C07.1.454.CMB.1.raw
  modified_base (117)..(118): a, c, t, g, unknown or other
  misc_feature (117)..(118): n is a, c, g, or t

SEQ ID NO: 194704 - DNA, 120 bp, Homo sapiens; identical to SEQ ID NO: 194312
  misc_feature: GYAE6OF01DO36R.51.29.C07.1.454.CMB.1.raw
  modified_base (117)..(120): a, c, t, g, unknown or other
  misc_feature (117)..(120): n is a, c, g, or t

SEQ ID NO: 194705 - DNA, 119 bp, Homo sapiens; identical to SEQ ID NO: 194137
  misc_feature: GYAE6OF01A62X1.51.29.C07.1.454.CMB.1.raw
  modified_base (118)..(119): a, c, t, g, unknown or other
  misc_feature (118)..(119): n is a, c, g, or t

SEQ ID NO: 194706 - DNA, 119 bp, Homo sapiens; identical to SEQ ID NO: 194160
  misc_feature: GYAE6OF01DDRCG.51.29.C07.1.454.CMB.1.raw
  modified_base (118)..(119): a, c, t, g, unknown or other
  misc_feature (118)..(119): n is a, c, g, or t

SEQ ID NO: 194707 - DNA, 119 bp, Homo sapiens; identical to SEQ ID NO: 194160
  misc_feature: GYAE6OF01A7S0W.51.29.C07.1.454.CMB.1.raw
  modified_base (118)..(119): a, c, t, g, unknown or other
  misc_feature (118)..(119): n is a, c, g, or t

SEQ ID NO: 194708 - DNA, 116 bp, Homo sapiens
  misc_feature: GYAE6OF01DFAHL.51.29.C07.1.454.CMB.1.raw
  modified_base (111)..(111): a, c, t, g, unknown or other
  misc_feature (111)..(111): n is a, c, g, or t
  modified_base (116)..(116): a, c, t, g, unknown or other
  misc_feature (116)..(116): n is a, c, g, or t
tcagcgatcgtatacacgaccggtgctcgatttagagtgctacgaagggaaagggcagcgtcactctgttcccaccctcctctcgtagcactctgagcggctggcaaggcncatgn

SEQ ID NO: 194709 - DNA, 122 bp, Homo sapiens
  misc_feature: GYAE6OF01EE2Y6.51.29.C07.1.454.CMB.1.raw
  modified_base (118)..(122): a, c, t, g, unknown or other
  misc_feature (118)..(122): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnn

SEQ ID NO: 194710 - DNA, 117 bp, Homo sapiens; identical to SEQ ID NO: 194677
  misc_feature: GYAE6OF01C9HUB.51.29.C07.1.454.CMB.1.raw
  modified_base (117)..(117): a, c, t, g, unknown or other
  misc_feature (117)..(117): n is a, c, g, or t

SEQ ID NO: 194711 - DNA, 119 bp, Homo sapiens; identical to SEQ ID NO: 194316
  misc_feature: GYAE6OF01CXKXZ.51.29.C07.1.454.CMB.1.raw
  modified_base (117)..(119): a, c, t, g, unknown or other
  misc_feature (117)..(119): n is a, c, g, or t

SEQ ID NO: 194712 - DNA, 160 bp, Homo sapiens; identical to SEQ ID NO: 194364
  misc_feature: GYAE6OF01EU16V.51.29.C07.1.454.CMB.1.raw
  modified_base (159)..(160): a, c, t, g, unknown or other
  misc_feature (159)..(160): n is a, c, g, or t

SEQ ID NO: 194713 - DNA, 121 bp, Homo sapiens; identical to SEQ ID NO: 194651
  misc_feature: GYAE6OF01EH5QX.51.29.C07.1.454.CMB.1.raw
  modified_base (118)..(121): a, c, t, g, unknown or other
  misc_feature (118)..(121): n is a, c, g, or t

SEQ ID NO: 194714 - DNA, 174 bp, Homo sapiens
  misc_feature: GYAE6OF01DBRU2.51.29.C07.1.454.CMB.1.raw
  modified_base (144)..(144): a, c, t, g, unknown or other
  misc_feature (144)..(144): n is a, c, g, or t
  modified_base (160)..(174): a, c, t, g, unknown or other
  misc_feature (160)..(174): n is a, c, g, or t
tcagcgatcgtatacacgaccggtgctcgatttagagtgctacgaagggaaagggcacgaccggtgctcgatttagagtgcctacgaagggaaaggcagcgtcactctgttcccgccctcctctcgtagctactctgagcgggntggcaaggcgcatagnnnnnnnnnnnnnnn

SEQ ID NO: 194715 - DNA, 135 bp, Homo sapiens
  misc_feature: GYAE6OF01BCJBC.51.29.C07.1.454.CMB.1.raw
  modified_base (117)..(135): a, c, t, g, unknown or other
  misc_feature (117)..(135): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnnnn

SEQ ID NO: 194716 - DNA, 115 bp, Homo sapiens; identical to SEQ ID NO: 194256
  misc_feature: GYAE6OF01BRVPQ.51.29.C07.1.454.CMB.1.raw

SEQ ID NO: 194717 - DNA, 125 bp, Homo sapiens
  misc_feature: GYAE6OF01EUMWN.51.29.C07.1.454.CMB.1.raw
  modified_base (111)..(111): a, c, t, g, unknown or other
  misc_feature (111)..(111): n is a, c, g, or t
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnn

SEQ ID NO: 194718 - DNA, 118 bp, Homo sapiens; identical to SEQ ID NO: 194139
  misc_feature: GYAE6OF01COZEU.51.29.C07.1.454.CMB.1.raw
  modified_base (118)..(118): a, c, t, g, unknown or other
  misc_feature (118)..(118): n is a, c, g, or t

SEQ ID NO: 194719 - DNA, 118 bp, Homo sapiens; identical to SEQ ID NO: 194140
  misc_feature: GYAE6OF01BT5FG.51.29.C07.1.454.CMB.1.raw
  modified_base (118)..(118): a, c, t, g, unknown or other
  misc_feature (118)..(118): n is a, c, g, or t

SEQ ID NO: 194720 - DNA, 118 bp, Homo sapiens; identical to SEQ ID NO: 194139
  misc_feature: GYAE6OF01D7F2H.51.29.C07.1.454.CMB.1.raw
  modified_base (118)..(118): a, c, t, g, unknown or other
  misc_feature (118)..(118): n is a, c, g, or t

SEQ ID NO: 194721 - DNA, 119 bp, Homo sapiens
  misc_feature: GYAE6OF01DLSGN.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaaagggcagcgtcactctgttcccacctcctctcgtagcactctgagcggctggcaaggcgcatagnnnn

SEQ ID NO: 194722 - DNA, 145 bp, Homo sapiens
  misc_feature: GYAE6OF01A0DRP.51.29.C07.1.454.CMB.1.raw
  modified_base (118)..(145): a, c, t, g, unknown or other
  misc_feature (118)..(145): n is a, c, g, or t
tcagcgatcgtatacacgaccggtgctcgatttagagtgctacgaagggaaagggcgagcgtcactctgttcccgcctcctctcgtagcactctgagcgggctggcaaggcgcatagnnnnnnnnnnnnnnnnnnnnnnnnnnnn

SEQ ID NO: 194723 - DNA, 117 bp, Homo sapiens; identical to SEQ ID NO: 194206
  misc_feature: GYAE6OF01AVP75.51.29.C07.1.454.CMB.1.raw

SEQ ID NO: 194724 - DNA, 208 bp, Homo sapiens
  misc_feature: GYAE6OF01BT28O.51.29.C07.1.454.CMB.1.raw
  modified_base (128)..(208): a, c, t, g, unknown or other
  misc_feature (128)..(208): n is a, c, g, or t
tcagcgatcgtatacacgaccggtgctcgatttagagtgctacgaagggaaagggcagtcggtcactctgttcccgccctcctctcgtagcactctggagcgggctgggccaagggcgcattacgggnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 194725 - DNA, 118 bp, Homo sapiens; identical to SEQ ID NO: 194140
  misc_feature: GYAE6OF01DX0WU.51.29.C07.1.454.CMB.1.raw
  modified_base (118)..(118): a, c, t, g, unknown or other
  misc_feature (118)..(118): n is a, c, g, or t

SEQ ID NO: 194726 - DNA, 117 bp, Homo sapiens
  misc_feature: GYAE6OF01CRN1P.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagn

SEQ ID NO: 194727 - DNA, 118 bp, Homo sapiens; identical to SEQ ID NO: 194140
  misc_feature: GYAE6OF01BC340.51.29.C07.1.454.CMB.1.raw
  modified_base (118)..(118): a, c, t, g, unknown or other
  misc_feature (118)..(118): n is a, c, g, or t

SEQ ID NO: 194728 - DNA, 122 bp, Homo sapiens; identical to SEQ ID NO: 194631
  misc_feature: GYAE6OF01A4L7J.51.29.C07.1.454.CMB.1.raw
  modified_base (118)..(122): a, c, t, g, unknown or other
  misc_feature (118)..(122): n is a, c, g, or t

SEQ ID NO: 194729 - DNA, 123 bp, Homo sapiens
  misc_feature: GYAE6OF01D75XT.51.29.C07.1.454.CMB.1.raw
  modified_base (110)..(110): a, c, t, g, unknown or other
  misc_feature (110)..(110): n is a, c, g, or t
  modified_base (116)..(123): a, c, t, g, unknown or other
  misc_feature (116)..(123): n is a, c, g, or t
tcagcgatcgtatacacgaccggtgctcgatttagagtgctacgaagggaagggcagcgtcactctgttcccaccctcctctcgtagcactctgagcggctggcaaggcncatagnnnnnnnn

SEQ ID NO: 194730 - DNA, 117 bp, Homo sapiens; identical to SEQ ID NO: 194147
  misc_feature: GYAE6OF01BPZQ7.51.29.C07.1.454.CMB.1.raw

SEQ ID NO: 194731 - DNA, 122 bp, Homo sapiens; identical to SEQ ID NO: 194631
  misc_feature: GYAE6OF01AKIDK.51.29.C07.1.454.CMB.1.raw
  modified_base (118)..(122): a, c, t, g, unknown or other
  misc_feature (118)..(122): n is a, c, g, or t

SEQ ID NO: 194732 - DNA, 134 bp, Homo sapiens
  misc_feature: GYAE6OF01B5T1X.51.29.C07.1.454.CMB.1.raw
  modified_base (117)..(134): a, c, t, g, unknown or other
  misc_feature (117)..(134): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnnn

SEQ ID NO: 194733 - DNA, 124 bp, Homo sapiens; identical to SEQ ID NO: 194372
  misc_feature: GYAE6OF01A8KQC.51.29.C07.1.454.CMB.1.raw
  modified_base (117)..(124): a, c, t, g, unknown or other
  misc_feature (117)..(124): n is a, c, g, or t

SEQ ID NO: 194734 - DNA, 123 bp, Homo sapiens; identical to SEQ ID NO: 194390
  misc_feature: GYAE6OF01BBVZB.51.29.C07.1.454.CMB.1.raw
  modified_base (118)..(123): a, c, t, g, unknown or other
  misc_feature (118)..(123): n is a, c, g, or t

SEQ ID NO: 194735 - DNA, 117 bp, Homo sapiens; identical to SEQ ID NO: 194206
  misc_feature: GYAE6OF01CZLZY.51.29.C07.1.454.CMB.1.raw

SEQ ID NO: 194736 - DNA, 162 bp, Homo sapiens
  misc_feature: GYAE6OF01A1CDO.51.29.C07.1.454.CMB.1.raw
  modified_base (159)..(162): a, c, t, g, unknown or other
  misc_feature (159)..(162): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnnn

SEQ ID NO: 194737 - DNA, 118 bp, Homo sapiens; identical to SEQ ID NO: 194139
  misc_feature: GYAE6OF01DCJ37.51.29.C07.1.454.CMB.1.raw
  modified_base (118)..(118): a, c, t, g, unknown or other
  misc_feature (118)..(118): n is a, c, g, or t

SEQ ID NO: 194738 - DNA, 118 bp, Homo sapiens; identical to SEQ ID NO: 194140
  misc_feature: GYAE6OF01BKUG5.51.29.C07.1.454.CMB.1.raw
  modified_base (118)..(118): a, c, t, g, unknown or other
  misc_feature (118)..(118): n is a, c, g, or t

SEQ ID NO: 194739 - DNA, 116 bp, Homo sapiens
  misc_feature: GYAE6OF01CV5R9.51.29.C07.1.454.CMB.1.raw
tcagcgatcgtatacacgaccggtgctcgatttagagtgctacgaagggaaagggcagcgtcactctgttcccaccctcctccgtagcactctgagcgggctggcaaggcgcatag

SEQ ID NO: 194740 - DNA, 124 bp, Homo sapiens
  misc_feature: GYAE6OF01CEN5J.51.29.C07.1.454.CMB.1.raw
  modified_base (115)..(124): a, c, t, g, unknown or other
  misc_feature (115)..(124): n is a, c, g, or t
tcagcgatcgtatacacgaccggtgctcgatttagagtgctacgaagggaagggcagcgtcactctgttcccaccctctctcgtagcactctgagcggctggcaaggcgcatagnnnnnnnnnn

SEQ ID NO: 194741 - DNA, 119 bp, Homo sapiens; identical to SEQ ID NO: 194160
  misc_feature: GYAE6OF01AK5CK.51.29.C07.1.454.CMB.1.raw
  modified_base (118)..(119): a, c, t, g, unknown or other
  misc_feature (118)..(119): n is a, c, g, or t

SEQ ID NO: 194742 - DNA, 118 bp, Homo sapiens; identical to SEQ ID NO: 194140
  misc_feature: GYAE6OF01A2VXL.51.29.C07.1.454.CMB.1.raw
  modified_base (118)..(118): a, c, t, g, unknown or other
  misc_feature (118)..(118): n is a, c, g, or t

SEQ ID NO: 194743 - DNA, 120 bp, Homo sapiens
  misc_feature: GYAE6OF01CVZCW.51.29.C07.1.454.CMB.1.raw
  modified_base (111)..(111): a, c, t, g, unknown or other
  misc_feature (111)..(111): n is a, c, g, or t
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnn

SEQ ID NO: 194744 - DNA, 117 bp, Homo sapiens; identical to SEQ ID NO: 194147
  misc_feature: GYAE6OF01CX9T9.51.29.C07.1.454.CMB.1.raw

SEQ ID NO: 194745 - DNA, 126 bp, Homo sapiens
  misc_feature: GYAE6OF01BCMX6.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaaggcagcgtcactctgttcccaccctcctctcgtagcactctgagcgggctggcaaggcgcatagnnnnnnnnnn

SEQ ID NO: 194746 - DNA, 164 bp, Homo sapiens
  misc_feature: GYAE6OF01CJOJN.51.29.C07.1.454.CMB.1.raw
  modified_base (121)..(121): a, c, t, g, unknown or other
  misc_feature (121)..(121): n is a, c, g, or t
  modified_base (129)..(131): a, c, t, g, unknown or other
  misc_feature (129)..(131): n is a, c, g, or t
  modified_base (133)..(164): a, c, t, g, unknown or other
  misc_feature (133)..(164): n is a, c, g, or t
tcagcgatcgtatacacgaccggtgctcgatttagagtgctacgaagggaaagggcagcgtcactctgttcccgccctcctctcgtagcaacgtcgtggagccgggctgggccaagggccncaagtagnnncnnnnnnnnnnnnnnnnnnnnnnnnnnnnnnnn

SEQ ID NO: 194747 - DNA, 140 bp, Homo sapiens
  misc_feature: GYAE6OF01BKWYM.51.29.C07.1.454.CMB.1.raw
  modified_base (117)..(140): a, c, t, g, unknown or other
  misc_feature (117)..(140): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnnnnnnnnn

SEQ ID NO: 194748 - DNA, 117 bp, Homo sapiens; identical to SEQ ID NO: 194133
  misc_feature: GYAE6OF01B7OT0.51.29.C07.1.454.CMB.1.raw
  modified_base (117)..(117): a, c, t, g, unknown or other
  misc_feature (117)..(117): n is a, c, g, or t

SEQ ID NO: 194749 - DNA, 132 bp, Homo sapiens
  misc_feature: GYAE6OF01AQOFY.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaaagggcagcgtcactctgttcccgccctcctctcgagcactctgagcgggctggcaaggcgcatagnnnnnnnnnnnnnnnn

SEQ ID NO: 194750 - DNA, 129 bp, Homo sapiens; identical to SEQ ID NO: 194600
  misc_feature: GYAE6OF01DMNXU.51.29.C07.1.454.CMB.1.raw
  modified_base (117)..(129): a, c, t, g, unknown or other
  misc_feature (117)..(129): n is a, c, g, or t

SEQ ID NO: 194751 - DNA, 118 bp, Homo sapiens; identical to SEQ ID NO: 194140
  misc_feature: GYAE6OF01B69WU.51.29.C07.1.454.CMB.1.raw
  modified_base (118)..(118): a, c, t, g, unknown or other
  misc_feature (118)..(118): n is a, c, g, or t

SEQ ID NO: 194752 - DNA, 119 bp, Homo sapiens; identical to SEQ ID NO: 194160
  misc_feature: GYAE6OF01D0WOV.51.29.C07.1.454.CMB.1.raw
  modified_base (118)..(119): a, c, t, g, unknown or other
  misc_feature (118)..(119): n is a, c, g, or t

SEQ ID NO: 194753 - DNA, 125 bp, Homo sapiens; identical to SEQ ID NO: 194571
  misc_feature: GYAE6OF01CYLVV.51.29.C07.1.454.CMB.1.raw
  modified_base (117)..(125): a, c, t, g, unknown or other
  misc_feature (117)..(125): n is a, c, g, or t

SEQ ID NO: 194754 - DNA, 121 bp, Homo sapiens; identical to SEQ ID NO: 194352
  misc_feature: GYAE6OF01ELV36.51.29.C07.1.454.CMB.1.raw
  modified_base (118)..(121): a, c, t, g, unknown or other
  misc_feature (118)..(121): n is a, c, g, or t

SEQ ID NO: 194755 - DNA, 120 bp, Homo sapiens; identical to SEQ ID NO: 194365
  misc_feature: GYAE6OF01DJM9C.51.29.C07.1.454.CMB.1.raw
  modified_base (118)..(120): a, c, t, g, unknown or other
  misc_feature (118)..(120): n is a, c, g, or t

SEQ ID NO: 194756 - DNA, 120 bp, Homo sapiens; identical to SEQ ID NO: 194319
  misc_feature: GYAE6OF01C2DJW.51.29.C07.1.454.CMB.1.raw
  modified_base (116)..(120): a, c, t, g, unknown or other
  misc_feature (116)..(120): n is a, c, g, or t

SEQ ID NO: 194757 - DNA, 116 bp, Homo sapiens
  misc_feature: GYAE6OF01DO8JA.51.29.C07.1.454.CMB.1.raw
  modified_base (110)..(110): a, c, t, g, unknown or other
  misc_feature (110)..(110): n is a, c, g, or t
  modified_base (115)..(116): a, c, t, g, unknown or other
  misc_feature (115)..(116): n is a, c, g, or t
tcagcgatcgtatacacgaccggtgctcgatttagagtgctacgaagggaagggcagcgtcactctgttcccaccctcctctcgtagcactctgagcggctggcaaggcncatgnn

SEQ ID NO: 194758 - DNA, 118 bp, Homo sapiens
  misc_feature: GYAE6OF01D9VC8.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccaccctccttcgtagcactctgagcgggctggcaaggcgcatagnn

SEQ ID NO: 194759 - DNA, 153 bp, Homo sapiens
  misc_feature: GYAE6OF01AWNWU.51.29.C07.1.454.CMB.1.raw
  modified_base (120)..(153): a, c, t, g, unknown or other
  misc_feature (120)..(153): n is a, c, g, or t
tcagcgatcgtatacacgaccggtgctcgatttagagtgctacgaagggaaagggcagcggtcactctgttcccgccctcctctcggtagcactctgagcgggctggcaaggcgcatagnnnnnnnnnnnnnnnnnnnnnnnnnnnnnnnnnn

SEQ ID NO: 194760 - DNA, 118 bp, Homo sapiens; identical to SEQ ID NO: 194140
  misc_feature: GYAE6OF01CVXHZ.51.29.C07.1.454.CMB.1.raw
  modified_base (118)..(118): a, c, t, g, unknown or other
  misc_feature (118)..(118): n is a, c, g, or t

SEQ ID NO: 194761 - DNA, 118 bp, Homo sapiens; identical to SEQ ID NO: 194139
  misc_feature: GYAE6OF01EU01B.51.29.C07.1.454.CMB.1.raw
  modified_base (118)..(118): a, c, t, g, unknown or other
  misc_feature (118)..(118): n is a, c, g, or t

SEQ ID NO: 194762 - DNA, 117 bp, Homo sapiens; identical to SEQ ID NO: 194133
  misc_feature: GYAE6OF01EH7YJ.51.29.C07.1.454.CMB.1.raw
  modified_base (117)..(117): a, c, t, g, unknown or other
  misc_feature (117)..(117): n is a, c, g, or t

SEQ ID NO: 194763 - DNA, 118 bp, Homo sapiens; identical to SEQ ID NO: 194140
  misc_feature: GYAE6OF01A894I.51.29.C07.1.454.CMB.1.raw
  modified_base (118)..(118): a, c, t, g, unknown or other
  misc_feature (118)..(118): n is a, c, g, or t

SEQ ID NO: 194764 - DNA, 120 bp, Homo sapiens
  misc_feature: GYAE6OF01C5V0O.51.29.C07.1.454.CMB.1.raw
  modified_base (112)..(112): a, c, t, g, unknown or other
  misc_feature (112)..(112): n is a, c, g, or t
  modified_base (118)..(120): a, c, t, g, unknown or other
  misc_feature (118)..(120): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnn

SEQ ID NO: 194765 - DNA, 131 bp, Homo sapiens
  misc_feature: GYAE6OF01DVBSI.51.29.C07.1.454.CMB.1.raw
  modified_base (116)..(131): a, c, t, g, unknown or other
  misc_feature (116)..(131): n is a, c, g, or t
tcagcgatcgtatacacgaccggtgctcgatttagagtgctacgaagggaaagggcagcgtcactctgttcccacctcctctcgtagcactctgagcggctggcaaggcgcatagnnnnnnnnnnnnnnnn

SEQ ID NO: 194766 - DNA, 118 bp, Homo sapiens; identical to SEQ ID NO: 194140
  misc_feature: GYAE6OF01EI2A5.51.29.C07.1.454.CMB.1.raw
  modified_base (118)..(118): a, c, t, g, unknown or other
  misc_feature (118)..(118): n is a, c, g, or t

SEQ ID NO: 194767 - DNA, 117 bp, Homo sapiens; identical to SEQ ID NO: 194110
  misc_feature: GYAE6OF01EDNAW.51.29.C07.1.454.CMB.1.raw
  modified_base (117)..(117): a, c, t, g, unknown or other
  misc_feature (117)..(117): n is a, c, g, or t

SEQ ID NO: 194768 - DNA, 123 bp, Homo sapiens; identical to SEQ ID NO: 194601
  misc_feature: GYAE6OF01AD1QU.51.29.C07.1.454.CMB.1.raw
  modified_base (111)..(111): a, c, t, g, unknown or other
  misc_feature (111)..(111): n is a, c, g, or t
  modified_base (117)..(123): a, c, t, g, unknown or other
  misc_feature (117)..(123): n is a, c, g, or t

SEQ ID NO: 194769 - DNA, 122 bp, Homo sapiens
  misc_feature: GYAE6OF01E3WTO.51.29.C07.1.454.CMB.1.raw
  modified_base (112)..(112): a, c, t, g, unknown or other
  misc_feature (112)..(112): n is a, c, g, or t
  modified_base (118)..(122): a, c, t, g, unknown or other
  misc_feature (118)..(122): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnn

SEQ ID NO: 194770 - DNA, 124 bp, Homo sapiens; identical to SEQ ID NO: 194227
  misc_feature: GYAE6OF01EGY8D.51.29.C07.1.454.CMB.1.raw
  modified_base (118)..(124): a, c, t, g, unknown or other
  misc_feature (118)..(124): n is a, c, g, or t

SEQ ID NO: 194771 - DNA, 126 bp, Homo sapiens
  misc_feature: GYAE6OF01DNF7O.51.29.C07.1.454.CMB.1.raw
  modified_base (111)..(111): a, c, t, g, unknown or other
  misc_feature (111)..(111): n is a, c, g, or t
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnnn

SEQ ID NO: 194772 - DNA, 134 bp, Homo sapiens
  misc_feature: GYAE6OF01DJW4C.51.29.C07.1.454.CMB.1.raw
  modified_base (118)..(134): a, c, t, g, unknown or other
  misc_feature (118)..(134): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnn

SEQ ID NO: 194773 - DNA, 117 bp, Homo sapiens; identical to SEQ ID NO: 194117
  misc_feature: GYAE6OF01CDGAR.51.29.C07.1.454.CMB.1.raw
  modified_base (117)..(117): a, c, t, g, unknown or other
  misc_feature (117)..(117): n is a, c, g, or t

SEQ ID NO: 194774 - DNA, 123 bp, Homo sapiens; identical to SEQ ID NO: 194390
  misc_feature: GYAE6OF01B8QDK.51.29.C07.1.454.CMB.1.raw
  modified_base (118)..(123): a, c, t, g, unknown or other
  misc_feature (118)..(123): n is a, c, g, or t

SEQ ID NO: 194775 - DNA, 117 bp, Homo sapiens; identical to SEQ ID NO: 194147
  misc_feature: GYAE6OF01C9ISZ.51.29.C07.1.454.CMB.1.raw

SEQ ID NO: 194776 - DNA, 117 bp, Homo sapiens; identical to SEQ ID NO: 194206
  misc_feature: GYAE6OF01C2SDB.51.29.C07.1.454.CMB.1.raw

SEQ ID NO: 194777 - DNA, 138 bp, Homo sapiens
  misc_feature: GYAE6OF01EDW66.51.29.C07.1.454.CMB.1.raw
  modified_base (112)..(112): a, c, t, g, unknown or other
  misc_feature (112)..(112): n is a, c, g, or t
  modified_base (118)..(138): a, c, t, g, unknown or other
  misc_feature (118)..(138): n is a, c, g, or t
tcagcgatcgtatacacgaccggtgctcgatttagagtgctacgaagggaaagggcagcggtcactctgttcccgccctcctctcgtagcactctgagcggctggcaaggcncatagnnnnnnnnnnnnnnnnnnnnn

SEQ ID NO: 194778 - DNA, 126 bp, Homo sapiens; identical to SEQ ID NO: 194771
  misc_feature: GYAE6OF01CV1ZO.51.29.C07.1.454.CMB.1.raw
  modified_base (111)..(111): a, c, t, g, unknown or other
  misc_feature (111)..(111): n is a, c, g, or t
  modified_base (117)..(126): a, c, t, g, unknown or other
  misc_feature (117)..(126): n is a, c, g, or t

SEQ ID NO: 194779 - DNA, 124 bp, Homo sapiens
  misc_feature: GYAE6OF01BLIYB.51.29.C07.1.454.CMB.1.raw
  modified_base (116)..(124): a, c, t, g, unknown or other
  misc_feature (116)..(124): n is a, c, g, or t
tcagcgatcgtatacacgaccggtgctcgatttagagtgctacgaagggaaagggcagcgtcactctgttcccaccctcctctcgtagcactctgagcggctggcaaggcgcatgnnnnnnnnn

SEQ ID NO: 194780 - DNA, 146 bp, Homo sapiens
  misc_feature: GYAE6OF01D429D.51.29.C07.1.454.CMB.1.raw
  modified_base (113)..(113): a, c, t, g, unknown or other
  misc_feature (113)..(113): n is a, c, g, or t
  modified_base (119)..(146): a, c, t, g, unknown or other
  misc_feature (119)..(146): n is a, c, g, or t
tcagcgatcgtatacacgaccggtgctcgatttagagtgctacgaagggaaagggcagcgtcactctgttcccaccctcctctcgtagcacgtctgagcgggctggcaaggcncatagnnnnnnnnnnnnnnnnnnnnnnnnnnnn

SEQ ID NO: 194781 - DNA, 127 bp, Homo sapiens
  misc_feature: GYAE6OF01B9XSB.51.29.C07.1.454.CMB.1.raw
  modified_base (116)..(127): a, c, t, g, unknown or other
  misc_feature (116)..(127): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnnnnnnnnnn

SEQ ID NO: 194782 - DNA, 118 bp, Homo sapiens; identical to SEQ ID NO: 194140
  misc_feature: GYAE6OF01EKRXQ.51.29.C07.1.454.CMB.1.raw
  modified_base (118)..(118): a, c, t, g, unknown or other
  misc_feature (118)..(118): n is a, c, g, or t

SEQ ID NO: 194783 - DNA, 118 bp, Homo sapiens; identical to SEQ ID NO: 194149
  misc_feature: GYAE6OF01BIC1O.51.29.C07.1.454.CMB.1.raw
  modified_base (117)..(118): a, c, t, g, unknown or other
  misc_feature (117)..(118): n is a, c, g, or t

SEQ ID NO: 194784 - DNA, 120 bp, Homo sapiens; identical to SEQ ID NO: 194312
  misc_feature: GYAE6OF01A8PRY.51.29.C07.1.454.CMB.1.raw
  modified_base (117)..(120): a, c, t, g, unknown or other
  misc_feature (117)..(120): n is a, c, g, or t

SEQ ID NO: 194785 - DNA, 122 bp, Homo sapiens; identical to SEQ ID NO: 194631
  misc_feature: GYAE6OF01DCBD2.51.29.C07.1.454.CMB.1.raw
  modified_base (118)..(122): a, c, t, g, unknown or other
  misc_feature (118)..(122): n is a, c, g, or t

SEQ ID NO: 194786 - DNA, 129 bp, Homo sapiens; identical to SEQ ID NO: 194159
  misc_feature: GYAE6OF01D6KER.51.29.C07.1.454.CMB.1.raw
  modified_base (118)..(129): a, c, t, g, unknown or other
  misc_feature (118)..(129): n is a, c, g, or t

SEQ ID NO: 194787 - DNA, 127 bp, Homo sapiens
  misc_feature: GYAE6OF01C4929.51.29.C07.1.454.CMB.1.raw
  modified_base (119)..(127): a, c, t, g, unknown or other
  misc_feature (119)..(127): n is a, c, g, or t
tcagcgatcgtatacacgaccggtgctcgatttagagtgctacgaagggaaagggcagcgtcgactctgttcccgccctcctctcgtagcactctgagcgggctggcaaggcgcatagnnnnnnnnn

SEQ ID NO: 194788 - DNA, 120 bp, Homo sapiens; identical to SEQ ID NO: 194365
  misc_feature: GYAE6OF01AGKF3.51.29.C07.1.454.CMB.1.raw
  modified_base (118)..(120): a, c, t, g, unknown or other
  misc_feature (118)..(120): n is a, c, g, or t

SEQ ID NO: 194789 - DNA, 120 bp, Homo sapiens; identical to SEQ ID NO: 194764
  misc_feature: GYAE6OF01CA6C6.51.29.C07.1.454.CMB.1.raw
  modified_base (112)..(112): a, c, t, g, unknown or other
  misc_feature (112)..(112): n is a, c, g, or t
  modified_base (118)..(120): a, c, t, g, unknown or other
  misc_feature (118)..(120): n is a, c, g, or t

SEQ ID NO: 194790 - DNA, 123 bp, Homo sapiens
  misc_feature: GYAE6OF01C3OPO.51.29.C07.1.454.CMB.1.raw
  modified_base (116)..(123): a, c, t, g, unknown or other
  misc_feature (116)..(123): n is a, c, g, or t
tcagcgatcgtatacacgaccggtgctcgatttagagtgctacgaagggaaagggcagcgtcactctgttcccaccctcctctcgtagcactctgagcggctggcaaggcgcatgnnnnnnnn

SEQ ID NO: 194791 - DNA, 116 bp, Homo sapiens
  misc_feature: GYAE6OF01DDURC.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaagggcagcgtcactctgttcccacctcctctcgtagcactctgagcggctggcaaggcgcatagn

SEQ ID NO: 194792 - DNA, 118 bp, Homo sapiens
  misc_feature: GYAE6OF01B2418.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccaccctcctctcgtagcactcgagcgggctggcaaggcgcatagnn

SEQ ID NO: 194793 - DNA, 124 bp, Homo sapiens
  misc_feature: GYAE6OF01DELU8.51.29.C07.1.454.CMB.1.raw
  modified_base (110)..(110): a, c, t, g, unknown or other
  misc_feature (110)..(110): n is a, c, g, or t
  modified_base (116)..(124): a, c, t, g, unknown or other
  misc_feature (116)..(124): n is a, c, g, or t
tcagcgatcgtatacacgaccggtgctcgatttagagtgctacgaagggaaagggcagcgtcactctgttcccaccctctctcgtagcactctgagcggctggcaaggcncatagnnnnnnnnn

SEQ ID NO: 194794 - DNA, 128 bp, Homo sapiens; identical to SEQ ID NO: 194698
  misc_feature: GYAE6OF01BLKOI.51.29.C07.1.454.CMB.1.raw
  modified_base (117)..(128): a, c, t, g, unknown or other
  misc_feature (117)..(128): n is a, c, g, or t

SEQ ID NO: 194795 - DNA, 122 bp, Homo sapiens; identical to SEQ ID NO: 194417
  misc_feature: GYAE6OF01A7S1G.51.29.C07.1.454.CMB.1.raw
  modified_base (117)..(122): a, c, t, g, unknown or other
  misc_feature (117)..(122): n is a, c, g, or t

SEQ ID NO: 194796 - DNA, 119 bp, Homo sapiens
  misc_feature: GYAE6OF01EW32I.51.29.C07.1.454.CMB.1.raw
  modified_base (111)..(111): a, c, t, g, unknown or other
  misc_feature (111)..(111): n is a, c, g, or t
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnn

SEQ ID NO: 194797 - DNA, 118 bp, Homo sapiens; identical to SEQ ID NO: 194140
  misc_feature: GYAE6OF01BMC64.51.29.C07.1.454.CMB.1.raw
  modified_base (118)..(118): a, c, t, g, unknown or other
  misc_feature (118)..(118): n is a, c, g, or t

SEQ ID NO: 194798 - DNA, 129 bp, Homo sapiens; identical to SEQ ID NO: 194600
  misc_feature: GYAE6OF01BGGXA.51.29.C07.1.454.CMB.1.raw
  modified_base (117)..(129): a, c, t, g, unknown or other
  misc_feature (117)..(129): n is a, c, g, or t

SEQ ID NO: 194799 - DNA, 117 bp, Homo sapiens; identical to SEQ ID NO: 194148
  misc_feature: GYAE6OF01CR1XZ.51.29.C07.1.454.CMB.1.raw
  modified_base (116)..(117): a, c, t, g, unknown or other
  misc_feature (116)..(117): n is a, c, g, or t

SEQ ID NO: 194800 - DNA, 119 bp, Homo sapiens
  misc_feature: GYAE6OF01AZL8F.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccgccctccttcgtagcactctgagcgggctggcaaggcgcatagnnn

SEQ ID NO: 194801 - DNA, 119 bp, Homo sapiens; identical to SEQ ID NO: 194160
  misc_feature: GYAE6OF01A8MP9.51.29.C07.1.454.CMB.1.raw
  modified_base (118)..(119): a, c, t, g, unknown or other
  misc_feature (118)..(119): n is a, c, g, or t

SEQ ID NO: 194802 - DNA, 121 bp, Homo sapiens
  misc_feature: GYAE6OF01CKCKR.51.29.C07.1.454.CMB.1.raw
  modified_base (110)..(110): a, c, t, g, unknown or other
  misc_feature (110)..(110): n is a, c, g, or t
  modified_base (116)..(121): a, c, t, g, unknown or other
  misc_feature (116)..(121): n is a, c, g, or t
tcagcgatcgtatacacgaccggtgctcgatttagagtgctacgaagggaaagggcagcgtcactctgttcccaccctctctcgtagcactctgagcggctggcaaggcncatagnnnnnn

SEQ ID NO: 194803 - DNA, 141 bp, Homo sapiens
  misc_feature: GYAE6OF01CJ3Q2.51.29.C07.1.454.CMB.1.raw
  modified_base (111)..(111): a, c, t, g, unknown or other
  misc_feature (111)..(111): n is a, c, g, or t
  modified_base (117)..(141): a, c, t, g, unknown or other
  misc_feature (117)..(141): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnnnnnnnnnnnnnnnnnn

SEQ ID NO: 194804 - DNA, 185 bp, Homo sapiens
  misc_feature: GYAE6OF01CXEJS.51.29.C07.1.454.CMB.1.raw
  modified_base (66)..(66): a, c, t, g, unknown or other
  misc_feature (66)..(66): n is a, c, g, or t
  modified_base (138)..(138): a, c, t, g, unknown or other
  misc_feature (138)..(138): n is a, c, g, or t
  modified_base (156)..(158): a, c, t, g, unknown or other
  misc_feature (156)..(158): n is a, c, g, or t
  modified_base (160)..(185): a, c, t, g, unknown or other
  misc_feature (160)..(185): n is a, c, g, or t
tcagcgatcgtatacacgaccggtgctcgatttagagtgctacgaagggaaagggcacgaccggtnctcgatttagagtgctacgagggaaggcagcgtcactctgttcccacctctctcgtagtcactctgagcggntcggcaagggcacaatgnnncnnnnnnnnnnnnnnnnnnnnnnnnnn

SEQ ID NO: 194805 - DNA, 119 bp, Homo sapiens; identical to SEQ ID NO: 194137
  misc_feature: GYAE6OF01A3EWF.51.29.C07.1.454.CMB.1.raw
  modified_base (118)..(119): a, c, t, g, unknown or other
  misc_feature (118)..(119): n is a, c, g, or t

SEQ ID NO: 194806 - DNA, 118 bp, Homo sapiens; identical to SEQ ID NO: 194149
  misc_feature: GYAE6OF01ECUWS.51.29.C07.1.454.CMB.1.raw
  modified_base (117)..(118): a, c, t, g, unknown or other
  misc_feature (117)..(118): n is a, c, g, or t

SEQ ID NO: 194807 - DNA, 121 bp, Homo sapiens
  misc_feature: GYAE6OF01CMBVN.51.29.C07.1.454.CMB.1.raw
  modified_base (116)..(121): a, c, t, g, unknown or other
  misc_feature (116)..(121): n is a, c, g, or t
tcagcgatcgtatacacgaccggtgctcgatttagagtgctacgaagggaaagggcagcgtcactctgttcccaccctctctcgtagcactctgagcggctggcaaggcgcatgcnnnnnn

SEQ ID NO: 194808 - DNA, 123 bp, Homo sapiens; identical to SEQ ID NO: 194390
  misc_feature: GYAE6OF01B4L6Z.51.29.C07.1.454.CMB.1.raw
  modified_base (118)..(123): a, c, t, g, unknown or other
  misc_feature (118)..(123): n is a, c, g, or t

SEQ ID NO: 194809 - DNA, 123 bp, Homo sapiens; identical to SEQ ID NO: 194729
  misc_feature: GYAE6OF01DNY07.51.29.C07.1.454.CMB.1.raw
  modified_base (110)..(110): a, c, t, g, unknown or other
  misc_feature (110)..(110): n is a, c, g, or t
  modified_base (116)..(123): a, c, t, g, unknown or other
  misc_feature (116)..(123): n is a, c, g, or t

SEQ ID NO: 194810 - DNA, 122 bp, Homo sapiens; identical to SEQ ID NO: 194709
  misc_feature: GYAE6OF01DQZTX.51.29.C07.1.454.CMB.1.raw
  modified_base (118)..(122): a, c, t, g, unknown or other
  misc_feature (118)..(122): n is a, c, g, or t

SEQ ID NO: 194811 - DNA, 117 bp, Homo sapiens; identical to SEQ ID NO: 194147
  misc_feature: GYAE6OF01C4CZR.51.29.C07.1.454.CMB.1.raw

SEQ ID NO: 194812 - DNA, 118 bp, Homo sapiens; identical to SEQ ID NO: 194140
  misc_feature: GYAE6OF01A73QZ.51.29.C07.1.454.CMB.1.raw
  modified_base (118)..(118): a, c, t, g, unknown or other
  misc_feature (118)..(118): n is a, c, g, or t

SEQ ID NO: 194813 - DNA, 135 bp, Homo sapiens; identical to SEQ ID NO: 194715
  misc_feature: GYAE6OF01E086T.51.29.C07.1.454.CMB.1.raw
  modified_base (117)..(135): a, c, t, g, unknown or other
  misc_feature (117)..(135): n is a, c, g, or t

SEQ ID NO: 194814 - DNA, 125 bp, Homo sapiens
  misc_feature: GYAE6OF01BWTNN.51.29.C07.1.454.CMB.1.raw
  modified_base (116)..(125): a, c, t, g, unknown or other
  misc_feature (116)..(125): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnnnnnnnn

SEQ ID NO: 194815 - DNA, 118 bp, Homo sapiens; identical to SEQ ID NO: 194140
  misc_feature: GYAE6OF01BY842.51.29.C07.1.454.CMB.1.raw
  modified_base (118)..(118): a, c, t, g, unknown or other
  misc_feature (118)..(118): n is a, c, g, or t

SEQ ID NO: 194816 - DNA, 127 bp, Homo sapiens
  misc_feature: GYAE6OF01EQ7OK.51.29.C07.1.454.CMB.1.raw
  modified_base (111)..(111): a, c, t, g, unknown or other
  misc_feature (111)..(111): n is a, c, g, or t
  modified_base (117)..(127): a, c, t, g, unknown or other
  misc_feature (117)..(127): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnnnn

SEQ ID NO: 194817 - DNA, 159 bp, Homo sapiens
  misc_feature: GYAE6OF01BL1YB.51.29.C07.1.454.CMB.1.raw
  modified_base (152)..(152): a, c, t, g, unknown or other
  misc_feature (152)..(152): n is a, c, g, or t
  modified_base (158)..(159): a, c, t, g, unknown or other
  misc_feature (158)..(159): n is a, c, g, or t
tcagcgatcgtatacacgaccggtgctcgatttagagtgctacgaagggaaagggcacgaccggtgctcgatttagagtgctacgaagggaaaggcagcgtcactctgttcccaccctcctctcgtagcactctgagcgggctggcaaggcncatagnn

SEQ ID NO: 194818 - DNA, 119 bp, Homo sapiens; identical to SEQ ID NO: 194160
  misc_feature: GYAE6OF01C0OMA.51.29.C07.1.454.CMB.1.raw
  modified_base (118)..(119): a, c, t, g, unknown or other
  misc_feature (118)..(119): n is a, c, g, or t

SEQ ID NO: 194819 - DNA, 122 bp, Homo sapiens; identical to SEQ ID NO: 194417
  misc_feature: GYAE6OF01CNODX.51.29.C07.1.454.CMB.1.raw
  modified_base (117)..(122): a, c, t, g, unknown or other
  misc_feature (117)..(122): n is a, c, g, or t

SEQ ID NO: 194820 - DNA, 126 bp, Homo sapiens
  misc_feature: GYAE6OF01ECSPF.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t
tcagcgatcgtatacacgaccggtgctcgatttagagtgctacgaagggtaaagggcagcgtcactctgttcccaccctcctctcgtagcactctgagcggctggcaaggcncatagnnnnnnnnn

SEQ ID NO: 194821 - DNA, 139 bp, Homo sapiens
  misc_feature: GYAE6OF01AN4S1.51.29.C07.1.454.CMB.1.raw
  modified_base (116)..(139): a, c, t, g, unknown or other
  misc_feature (116)..(139): n is a, c, g, or t
tcagcgatcgtatacacgaccggtgctcgatttagagtgctacgaagggaagggcagcgtcactctgttcccgccctcctctcgtagcactctgagcggctggcaaggcgcatagnnnnnnnnnnnnnnnnnnnnnnnn

SEQ ID NO: 194822 - DNA, 117 bp, Homo sapiens; identical to SEQ ID NO: 194206
  misc_feature: GYAE6OF01E4YY2.51.29.C07.1.454.CMB.1.raw

SEQ ID NO: 194823 - DNA, 119 bp, Homo sapiens; identical to SEQ ID NO: 194160
  misc_feature: GYAE6OF01CD00L.51.29.C07.1.454.CMB.1.raw
  modified_base (118)..(119): a, c, t, g, unknown or other
  misc_feature (118)..(119): n is a, c, g, or t

SEQ ID NO: 194824 - DNA, 133 bp, Homo sapiens; identical to SEQ ID NO: 194323
  misc_feature: GYAE6OF01EYS93.51.29.C07.1.454.CMB.1.raw
  modified_base (118)..(133): a, c, t, g, unknown or other
  misc_feature (118)..(133): n is a, c, g, or t

SEQ ID NO: 194825 - DNA, 121 bp, Homo sapiens
  misc_feature: GYAE6OF01C5BPV.51.29.C07.1.454.CMB.1.raw
  modified_base (111)..(111): a, c, t, g, unknown or other
  misc_feature (111)..(111): n is a, c, g, or t
  modified_base (117)..(121): a, c, t, g, unknown or other
  misc_feature (117)..(121): n is a, c, g, or t
tcagcgatcgtatacacgaccggtgctcgatttagagtgctacgaagggaaaggcagcgtcactctgttcccgccctcctctcgtagcactctgagcgggctggcaaggcncatagnnnnn

SEQ ID NO: 194826 - DNA, 118 bp, Homo sapiens; identical to SEQ ID NO: 194140
  misc_feature: GYAE6OF01D2WK1.51.29.C07.1.454.CMB.1.raw
  modified_base (118)..(118): a, c, t, g, unknown or other
  misc_feature (118)..(118): n is a, c, g, or t

SEQ ID NO: 194827 - DNA, 117 bp, Homo sapiens; identical to SEQ ID NO: 194206
  misc_feature: GYAE6OF01BVA8V.51.29.C07.1.454.CMB.1.raw

SEQ ID NO: 194828 - DNA, 120 bp, Homo sapiens; identical to SEQ ID NO: 194365
  misc_feature: GYAE6OF01D0UKA.51.29.C07.1.454.CMB.1.raw
  modified_base (118)..(120): a, c, t, g, unknown or other
  misc_feature (118)..(120): n is a, c, g, or t

SEQ ID NO: 194829 - DNA, 127 bp, Homo sapiens
  misc_feature: GYAE6OF01DCTF1.51.29.C07.1.454.CMB.1.raw
  modified_base (112)..(112): a, c, t, g, unknown or other
  misc_feature (112)..(112): n is a, c, g, or t
  modified_base (118)..(127): a, c, t, g, unknown or other
  misc_feature (118)..(127): n is a, c, g, or t
tcagcgatcgtatacacgaccggtgctcgatttagagtgctacgaagggaaaggcagcgtcactctgttcccaccctcctctcgtagcactctgagtcggctggacaaggcncatagnnnnnnnnnn

SEQ ID NO: 194830 - DNA, 129 bp, Homo sapiens
  misc_feature: GYAE6OF01AJZ5E.51.29.C07.1.454.CMB.1.raw
  modified_base (118)..(129): a, c, t, g, unknown or other
  misc_feature (118)..(129): n is a, c, g, or t
tcagcgatcgtatacacgaccggtgctcgatttagagtgctacgaagggaaagggcagcgtcactctgttcccaccctcctctcgtagcactctgagcggctggccaaggcgcatagnnnnnnnnnnnn

SEQ ID NO: 194831 - DNA, 120 bp, Homo sapiens
  misc_feature: GYAE6OF01B3NMO.51.29.C07.1.454.CMB.1.raw
  modified_base (110)..(110): a, c, t, g, unknown or other
  misc_feature (110)..(110): n is a, c, g, or t
  modified_base (116)..(120): a, c, t, g, unknown or other
  misc_feature (116)..(120): n is a, c, g, or t
tcagcgatcgtatacacgaccggtgctcgatttagagtgctacgaagggaaagggcagcgtcactctgttcccaccctctctcgtagcactctgagcggctggcaaggcncatagnnnnn

SEQ ID NO: 194832 - DNA, 118 bp, Homo sapiens
  misc_feature: GYAE6OF01CYQKK.51.29.C07.1.454.CMB.1.raw
  modified_base (107)..(107): a, c, t, g, unknown or other
  misc_feature (107)..(107): n is a, c, g, or t
  modified_base (113)..(118): a, c, t, g, unknown or other
  misc_feature (113)..(118): n is a, c, g, or t
tcagcgatcgtatacacgaccggtgctcgatttagagtgctacgagggaagggcagcgtcactctgttccacctcctctcgtagcactctgagcggctggcaaggcncatagnnnnnn

SEQ ID NO: 194833 - DNA, 119 bp, Homo sapiens; identical to SEQ ID NO: 194160
  misc_feature: GYAE6OF01BOTQW.51.29.C07.1.454.CMB.1.raw
  modified_base (118)..(119): a, c, t, g, unknown or other
  misc_feature (118)..(119): n is a, c, g, or t

SEQ ID NO: 194834 - DNA, 126 bp, Homo sapiens
  misc_feature: GYAE6OF01DOG99.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnnnnnn

SEQ ID NO: 194835 - DNA, 155 bp, Homo sapiens
  misc_feature: GYAE6OF01BV68R.51.29.C07.1.454.CMB.1.raw
  modified_base (113)..(113): a, c, t, g, unknown or other
  misc_feature (113)..(113): n is a, c, g, or t
  modified_base (119)..(124): a, c, t, g, unknown or other
  misc_feature (119)..(124): n is a, c, g, or t
  modified_base (126)..(155): a, c, t, g, unknown or other
  misc_feature (126)..(155): n is a, c, g, or t
tcagcgatcgtatacacgaccggtgctcgatttagagtgctacgaagggaaagggcagcgtcactctgttcccaccctcctctcgtagccactctgagcgggctggcaaggcncatagnnnnnncnnnnnnnnnnnnnnnnnnnnnnnnnnnnnn

SEQ ID NO: 194836 - DNA, 118 bp, Homo sapiens; identical to SEQ ID NO: 194149
  misc_feature: GYAE6OF01A9TV7.51.29.C07.1.454.CMB.1.raw
  modified_base (117)..(118): a, c, t, g, unknown or other
  misc_feature (117)..(118): n is a, c, g, or t

SEQ ID NO: 194837 - DNA, 129 bp, Homo sapiens
  misc_feature: GYAE6OF01CGCKF.51.29.C07.1.454.CMB.1.raw
  modified_base (119)..(129): a, c, t, g, unknown or other
  misc_feature (119)..(129): n is a, c, g, or t
tcagcgatcgtatacacgaccggtgctcgatttagagtgctacgaagggaaagggcagcgtcactctgttcccaccctcctctcgtagccactctgagcgggctggcaaggcgcatagnnnnnnnnnnn

SEQ ID NO: 194838 - DNA, 126 bp, Homo sapiens; identical to SEQ ID NO: 194834
  misc_feature: GYAE6OF01CE4RC.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t

SEQ ID NO: 194839 - DNA, 118 bp, Homo sapiens; identical to SEQ ID NO: 194149
  misc_feature: GYAE6OF01BPTR7.51.29.C07.1.454.CMB.1.raw
  modified_base (117)..(118): a, c, t, g, unknown or other
  misc_feature (117)..(118): n is a, c, g, or t

SEQ ID NO: 194840 - DNA, 117 bp, Homo sapiens; identical to SEQ ID NO: 194110
  misc_feature: GYAE6OF01D8XT1.51.29.C07.1.454.CMB.1.raw
  modified_base (117)..(117): a, c, t, g, unknown or other
  misc_feature (117)..(117): n is a, c, g, or t

SEQ ID NO: 194841 - DNA, 121 bp, Homo sapiens; identical to SEQ ID NO: 194651
  misc_feature: GYAE6OF01COI20.51.29.C07.1.454.CMB.1.raw
  modified_base (118)..(121): a, c, t, g, unknown or other
  misc_feature (118)..(121): n is a, c, g, or t

SEQ ID NO: 194842 - DNA, 117 bp, Homo sapiens; identical to SEQ ID NO: 194133
  misc_feature: GYAE6OF01DCR8P.51.29.C07.1.454.CMB.1.raw
  modified_base (117)..(117): a, c, t, g, unknown or other
  misc_feature (117)..(117): n is a, c, g, or t

SEQ ID NO: 194843 - DNA, 138 bp, Homo sapiens
  misc_feature: GYAE6OF01CDBA9.51.29.C07.1.454.CMB.1.raw
  modified_base (117)..(138): a, c, t, g, unknown or other
  misc_feature (117)..(138): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnnnnnnn

SEQ ID NO: 194844 - DNA, 134 bp, Homo sapiens; identical to SEQ ID NO: 194732
  misc_feature: GYAE6OF01EGMS7.51.29.C07.1.454.CMB.1.raw
  modified_base (117)..(134): a, c, t, g, unknown or other
  misc_feature (117)..(134): n is a, c, g, or t

SEQ ID NO: 194845 - DNA, 127 bp, Homo sapiens
  misc_feature: GYAE6OF01DU6IH.51.29.C07.1.454.CMB.1.raw
  modified_base (110)..(110): a, c, t, g, unknown or other
  misc_feature (110)..(110): n is a, c, g, or t
  modified_base (116)..(127): a, c, t, g, unknown or other
  misc_feature (116)..(127): n is a, c, g, or t
tcagcgatcgtatacacgaccggtgctcgatttagagtgctacgaagggaaagggcagcgtcactctgttcccaccctctctcgtagcactctgagcggctggcaaggcncatagnnnnnnnnnnnn

SEQ ID NO: 194846 - DNA, 121 bp, Homo sapiens
  misc_feature: GYAE6OF01A6IML.51.29.C07.1.454.CMB.1.raw
  modified_base (114)..(121): a, c, t, g, unknown or other
  misc_feature (114)..(121): n is a, c, g, or t
tcagcgatcgtatacacgaccggtgctcgatttagagtgctacgaaggaagggcagcgtcactctgttccgccctcctctcgtagcactctgagcggctggcaaggcgcatagnnnnnnnn

SEQ ID NO: 194847 - DNA, 123 bp, Homo sapiens
  misc_feature: GYAE6OF01D14TI.51.29.C07.1.454.CMB.1.raw
  modified_base (111)..(111): a, c, t, g, unknown or other
  misc_feature (111)..(111): n is a, c, g, or t
  modified_base (116)..(123): a, c, t, g, unknown or other
  misc_feature (116)..(123): n is a, c, g, or t
tcagcgatcgtatacacgaccggtgctcgatttagagtgctacgaagggaaagggcagcgtcactctgttcccaccctcctctcgtagcactctgagcggctggcaaggcncatgnnnnnnnn

SEQ ID NO: 194848 - DNA, 136 bp, Homo sapiens; identical to SEQ ID NO: 194240
  misc_feature: GYAE6OF01EL495.51.29.C07.1.454.CMB.1.raw
  modified_base (117)..(136): a, c, t, g, unknown or other
  misc_feature (117)..(136): n is a, c, g, or t

SEQ ID NO: 194849 - DNA, 125 bp, Homo sapiens; identical to SEQ ID NO: 194571
  misc_feature: GYAE6OF01B48FP.51.29.C07.1.454.CMB.1.raw
  modified_base (117)..(125): a, c, t, g, unknown or other
  misc_feature (117)..(125): n is a, c, g, or t

SEQ ID NO: 194850 - DNA, 133 bp, Homo sapiens
  misc_feature: GYAE6OF01AE2ZK.51.29.C07.1.454.CMB.1.raw
  modified_base (112)..(112): a, c, t, g, unknown or other
  misc_feature (112)..(112): n is a, c, g, or t
  modified_base (118)..(133): a, c, t, g, unknown or other
  misc_feature (118)..(133): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnnnnnnnnnnnnn

SEQ ID NO: 194851 - DNA, 128 bp, Homo sapiens
  misc_feature: GYAE6OF01EU7XM.51.29.C07.1.454.CMB.1.raw
  modified_base (116)..(128): a, c, t, g, unknown or other
  misc_feature (116)..(128): n is a, c, g, or t
tcagcgatcgtatacacgaccggtgctcgatttagagtgctacgaagggaagggcagcgtcactctgttcccaccctcctctcgtagcactctgagcggctggcaaggcgcatagnnnnnnnnnnnnn

SEQ ID NO: 194852 - DNA, 127 bp, Homo sapiens; identical to SEQ ID NO: 194501
  misc_feature: GYAE6OF01AJHEB.51.29.C07.1.454.CMB.1.raw
  modified_base (118)..(127): a, c, t, g, unknown or other
  misc_feature (118)..(127): n is a, c, g, or t

SEQ ID NO: 194853 - DNA, 118 bp, Homo sapiens; identical to SEQ ID NO: 194139
  misc_feature: GYAE6OF01AI3TA.51.29.C07.1.454.CMB.1.raw
  modified_base (118)..(118): a, c, t, g, unknown or other
  misc_feature (118)..(118): n is a, c, g, or t

SEQ ID NO: 194854 - DNA, 117 bp, Homo sapiens; identical to SEQ ID NO: 194206
  misc_feature: GYAE6OF01AQW77.51.29.C07.1.454.CMB.1.raw

SEQ ID NO: 194855 - DNA, 123 bp, Homo sapiens
  misc_feature: GYAE6OF01DZNWP.51.29.C07.1.454.CMB.1.raw
  modified_base (112)..(112): a, c, t, g, unknown or other
  misc_feature (112)..(112): n is a, c, g, or t
  modified_base (118)..(123): a, c, t, g, unknown or other
  misc_feature (118)..(123): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnnn

SEQ ID NO: 194856 - DNA, 117 bp, Homo sapiens
  misc_feature: GYAE6OF01EFRJF.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctcctctcgtagcactcgagcgggctggcaaggcgcatagn

SEQ ID NO: 194857 - DNA, 140 bp, Homo sapiens; identical to SEQ ID NO: 194747
  misc_feature: GYAE6OF01ENNXI.51.29.C07.1.454.CMB.1.raw
  modified_base (117)..(140): a, c, t, g, unknown or other
  misc_feature (117)..(140): n is a, c, g, or t

SEQ ID NO: 194858 - DNA, 120 bp, Homo sapiens; identical to SEQ ID NO: 194422
  misc_feature: GYAE6OF01CIMM6.51.29.C07.1.454.CMB.1.raw
  modified_base (117)..(120): a, c, t, g, unknown or other
  misc_feature (117)..(120): n is a, c, g, or t

SEQ ID NO: 194859 - DNA, 120 bp, Homo sapiens; identical to SEQ ID NO: 194289
  misc_feature: GYAE6OF01DSD85.51.29.C07.1.454.CMB.1.raw
  modified_base (118)..(120): a, c, t, g, unknown or other
  misc_feature (118)..(120): n is a, c, g, or t

SEQ ID NO: 194860 - DNA, 122 bp, Homo sapiens
  misc_feature: GYAE6OF01CZ6ML.51.29.C07.1.454.CMB.1.raw
  modified_base (111)..(111): a, c, t, g, unknown or other
  misc_feature (111)..(111): n is a, c, g, or t
  modified_base (116)..(122): a, c, t, g, unknown or other
  misc_feature (116)..(122): n is a, c, g, or t
tcagcgatcgtatacacgaccggtgctcgatttagagtgctacgaagggaaagggcagcgtcactctgttcccaccctcctctcgtagcactctgagcggctggcaaggcncatgnnnnnnn

SEQ ID NO: 194861 - DNA, 124 bp, Homo sapiens; identical to SEQ ID NO: 194372
  misc_feature: GYAE6OF01BYART.51.29.C07.1.454.CMB.1.raw
  modified_base (117)..(124): a, c, t, g, unknown or other
  misc_feature (117)..(124): n is a, c, g, or t

SEQ ID NO: 194862 - DNA, 128 bp, Homo sapiens
  misc_feature: GYAE6OF01BRE3P.51.29.C07.1.454.CMB.1.raw
  modified_base (111)..(111): a, c, t, g, unknown or other
  misc_feature (111)..(111): n is a, c, g, or t
  modified_base (117)..(128): a, c, t, g, unknown or other
  misc_feature (117)..(128): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnnnnn

SEQ ID NO: 194863 - DNA, 118 bp, Homo sapiens; identical to SEQ ID NO: 194139
  misc_feature: GYAE6OF01BGCME.51.29.C07.1.454.CMB.1.raw
  modified_base (118)..(118): a, c, t, g, unknown or other
  misc_feature (118)..(118): n is a, c, g, or t

SEQ ID NO: 194864 - DNA, 136 bp, Homo sapiens
  misc_feature: GYAE6OF01C91BU.51.29.C07.1.454.CMB.1.raw
  modified_base (118)..(136): a, c, t, g, unknown or other
  misc_feature (118)..(136): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnn

SEQ ID NO: 194865 - DNA, 117 bp, Homo sapiens
  misc_feature: GYAE6OF01A36B9.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaaggcagcgtcactctgttcccgccctcctctcgtagcactctgagcggctggcaaggcgcatagnn

SEQ ID NO: 194866 - DNA, 136 bp, Homo sapiens
  misc_feature: GYAE6OF01D7G5F.51.29.C07.1.454.CMB.1.raw
  modified_base (109)..(109): a, c, t, g, unknown or other
  misc_feature (109)..(109): n is a, c, g, or t
  modified_base (114)..(136): a, c, t, g, unknown or other
  misc_feature (114)..(136): n is a, c, g, or t
tcagcgatcgtatacacgaccggtgctcgatttagagtgctacgaagggaaagggcagcgtcactctgttcccaccctctctcgtagcactctgagcggctggcaggcncatgnnnnnnnnnnnnnnnnnnnnnnn

SEQ ID NO: 194867 - DNA, 132 bp, Homo sapiens
  misc_feature: GYAE6OF01AT3N0.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnnnnnnnnn

SEQ ID NO: 194868 - DNA, 136 bp, Homo sapiens
  misc_feature: GYAE6OF01D8WK7.51.29.C07.1.454.CMB.1.raw
  modified_base (116)..(136): a, c, t, g, unknown or other
  misc_feature (116)..(136): n is a, c, g, or t
tcagcgatcgtatacacgaccggtgctcgatttagagtgctacgaagggaaagggcagcgtcactctgttcccaccctctctcgtagcactctgagcggctggcaaggcgcatagnnnnnnnnnnnnnnnnnnnnn

SEQ ID NO: 194869 - DNA, 138 bp, Homo sapiens
  misc_feature: GYAE6OF01DSRBT.51.29.C07.1.454.CMB.1.raw
  modified_base (110)..(110): a, c, t, g, unknown or other
  misc_feature (110)..(110): n is a, c, g, or t
  modified_base (116)..(138): a, c, t, g, unknown or other
  misc_feature (116)..(138): n is a, c, g, or t
tcagcgatcgtatacacgaccggtgctcgatttagagtgctacgagggaaagggcagcgtcactctgttcccaccctcctctcgtagcactctgagcggctggcaaggcncatagnnnnnnnnnnnnnnnnnnnnnnn

SEQ ID NO: 194870 - DNA, 129 bp, Homo sapiens; identical to SEQ ID NO: 194600
  misc_feature: GYAE6OF01ATW0J.51.29.C07.1.454.CMB.1.raw
  modified_base (117)..(129): a, c, t, g, unknown or other
  misc_feature (117)..(129): n is a, c, g, or t

SEQ ID NO: 194871 - DNA, 123 bp, Homo sapiens; identical to SEQ ID NO: 194390
  misc_feature: GYAE6OF01C3H9M.51.29.C07.1.454.CMB.1.raw
  modified_base (118)..(123): a, c, t, g, unknown or other
  misc_feature (118)..(123): n is a, c, g, or t

SEQ ID NO: 194872 - DNA, 118 bp, Homo sapiens
  misc_feature: GYAE6OF01DPFQN.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnn

SEQ ID NO: 194873 - DNA, 165 bp, Homo sapiens
  misc_feature: GYAE6OF01CZKM2.51.29.C07.1.454.CMB.1.raw
  modified_base (115)..(115): a, c, t, g, unknown or other
  misc_feature (115)..(115): n is a, c, g, or t
  modified_base (121)..(165): a, c, t, g, unknown or other
  misc_feature (121)..(165): n is a, c, g, or t
tcagcgatcgtatacacgaccggtgctcgatttagagtgctacgaagggaaagggcagcgtcactctgttcccgccctcctcgtcgtagcactctggagcgggctggcaaaggcncatagnnnnnnnnnnnnnnnnnnnnnnnnnnnnnnnnnnnnnnnnnnnnn

SEQ ID NO: 194874 - DNA, 118 bp, Homo sapiens; identical to SEQ ID NO: 194140
  misc_feature: GYAE6OF01BJR3A.51.29.C07.1.454.CMB.1.raw
  modified_base (118)..(118): a, c, t, g, unknown or other
  misc_feature (118)..(118): n is a, c, g, or t

SEQ ID NO: 194875 - DNA, 138 bp, Homo sapiens
  misc_feature: GYAE6OF01CQ3N9.51.29.C07.1.454.CMB.1.raw
  modified_base (111)..(111): a, c, t, g, unknown or other
  misc_feature (111)..(111): n is a, c, g, or t
  modified_base (117)..(138): a, c, t, g, unknown or other
  misc_feature (117)..(138): n is a, c, g, or t
tcagcgatcgtatacacgaccggtgctcgatttagagtgctacgaagggaaagggcagcgtcactctgttcccaccctcctctcgtagcactctgagcggctggcaaggcncatagnnnnnnnnnnnnnnnnnnnnnn

SEQ ID NO: 194876 - DNA, 119 bp, Homo sapiens; identical to SEQ ID NO: 194796
  misc_feature: GYAE6OF01D103S.51.29.C07.1.454.CMB.1.raw
  modified_base (111)..(111): a, c, t, g, unknown or other
  misc_feature (111)..(111): n is a, c, g, or t
  modified_base (117)..(119): a, c, t, g, unknown or other
  misc_feature (117)..(119): n is a, c, g, or t

SEQ ID NO: 194877 - DNA, 123 bp, Homo sapiens; identical to SEQ ID NO: 194390
  misc_feature: GYAE6OF01CH3BQ.51.29.C07.1.454.CMB.1.raw
  modified_base (118)..(123): a, c, t, g, unknown or other
  misc_feature (118)..(123): n is a, c, g, or t

SEQ ID NO: 194878 - DNA, 177 bp, Homo sapiens
  misc_feature: GYAE6OF01B81VE.51.29.C07.1.454.CMB.1.raw
  modified_base (115)..(115): a, c, t, g, unknown or other
  misc_feature (115)..(115): n is a, c, g, or t
  modified_base (120)..(121): a, c, t, g, unknown or other
  misc_feature (120)..(121): n is a, c, g, or t
  modified_base (123)..(177): a, c, t, g, unknown or other
  misc_feature (123)..(177): n is a, c, g, or t
tcagcgatcgtatacacgaccggtgctcgatttagagtgctacgaagggaaaggggcaggcgtcactctgttcccaccctcctctcgtagcactcctgagcggtgcggcgaggcnatgcnncnnnnnnnnnnnnnnnnnnnnnnnnnnnnnnnnnnnnnnnnnnnnnnnnnnnnnnn

SEQ ID NO: 194879 - DNA, 171 bp, Homo sapiens
  misc_feature: GYAE6OF01C54D4.51.29.C07.1.454.CMB.1.raw
  modified_base (121)..(123): a, c, t, g, unknown or other
  misc_feature (121)..(123): n is a, c, g, or t
  modified_base (126)..(127): a, c, t, g, unknown or other
  misc_feature (126)..(127): n is a, c, g, or t
  modified_base (130)..(171): a, c, t, g, unknown or other
  misc_feature (130)..(171): n is a, c, g, or t
tcagcgatcgtatacacgaccggtgctcgatttagagtgctacgaagggaaagggcagcgtcactctgttcccaccctcctctcgtagcactctgagcgggtctggccaaggccgcatagnnntgnntgnnnnnnnnnnnnnnnnnnnnnnnnnnnnnnnnnnnnnnnnnn

SEQ ID NO: 194880 - DNA, 119 bp, Homo sapiens; identical to SEQ ID NO: 194160
  misc_feature: GYAE6OF01BH41R.51.29.C07.1.454.CMB.1.raw
  modified_base (118)..(119): a, c, t, g, unknown or other
  misc_feature (118)..(119): n is a, c, g, or t

SEQ ID NO: 194881 - DNA, 128 bp, Homo sapiens; identical to SEQ ID NO: 194862
  misc_feature: GYAE6OF01EJ5MZ.51.29.C07.1.454.CMB.1.raw
  modified_base (111)..(111): a, c, t, g, unknown or other
  misc_feature (111)..(111): n is a, c, g, or t
  modified_base (117)..(128): a, c, t, g, unknown or other
  misc_feature (117)..(128): n is a, c, g, or t

SEQ ID NO: 194882 - DNA, 120 bp, Homo sapiens
  misc_feature: GYAE6OF01EQVJI.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccgccctcctctcgtagcactctgagcgggctggcaaggcgcatgnnnn

SEQ ID NO: 194883 - DNA, 120 bp, Homo sapiens; identical to SEQ ID NO: 194289
  misc_feature: GYAE6OF01ETUGG.51.29.C07.1.454.CMB.1.raw
  modified_base (118)..(120): a, c, t, g, unknown or other
  misc_feature (118)..(120): n is a, c, g, or t

SEQ ID NO: 194884 - DNA, 127 bp, Homo sapiens; identical to SEQ ID NO: 194501
  misc_feature: GYAE6OF01BKK8R.51.29.C07.1.454.CMB.1.raw
  modified_base (118)..(127): a, c, t, g, unknown or other
  misc_feature (118)..(127): n is a, c, g, or t

SEQ ID NO: 194885 - DNA, 123 bp, Homo sapiens
  misc_feature: GYAE6OF01EAG5F.51.29.C07.1.454.CMB.1.raw
  modified_base (83)..(83): a, c, t, g, unknown or other
  misc_feature (83)..(83): n is a, c, g, or t
  modified_base (111)..(111): a, c, t, g, unknown or other
  misc_feature (111)..(111): n is a, c, g, or t
  modified_base (116)..(123): a, c, t, g, unknown or other
  misc_feature (116)..(123): n is a, c, g, or t
tcagcgatcgtatacacgaccggtgctcgatttagagtgctacgaagggaaagggcagcgtcactctgttcccaccctcctcncgtagcactctgagcggctggcaaggcncatgnnnnnnnn

SEQ ID NO: 194886 - DNA, 128 bp, Homo sapiens
  misc_feature: GYAE6OF01B358J.51.29.C07.1.454.CMB.1.raw
  modified_base (118)..(128): a, c, t, g, unknown or other
  misc_feature (118)..(128): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnn

SEQ ID NO: 194887 - DNA, 125 bp, Homo sapiens; identical to SEQ ID NO: 194717
  misc_feature: GYAE6OF01B533A.51.29.C07.1.454.CMB.1.raw
  modified_base (111)..(111): a, c, t, g, unknown or other
  misc_feature (111)..(111): n is a, c, g, or t
  modified_base (117)..(125): a, c, t, g, unknown or other
  misc_feature (117)..(125): n is a, c, g, or t

SEQ ID NO: 194888 - DNA, 126 bp, Homo sapiens; identical to SEQ ID NO: 194834
  misc_feature: GYAE6OF01AKSUO.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t

SEQ ID NO: 194889 - DNA, 123 bp, Homo sapiens; identical to SEQ ID NO: 194393
  misc_feature: GYAE6OF01EUP29.51.29.C07.1.454.CMB.1.raw
  modified_base (118)..(123): a, c, t, g, unknown or other
  misc_feature (118)..(123): n is a, c, g, or t

SEQ ID NO: 194890 - DNA, 119 bp, Homo sapiens
  misc_feature: GYAE6OF01C0M7U.51.29.C07.1.454.CMB.1.raw
  modified_base (112)..(112): a, c, t, g, unknown or other
  misc_feature (112)..(112): n is a, c, g, or t
  modified_base (118)..(119): a, c, t, g, unknown or other
  misc_feature (118)..(119): n is a, c, g, or t
tcagcgatcgtatacacgaccggtgctcgatttagagtgctacgaagggaaagggcagcgtcactctgttcccgccctcctctcgtagcactctgagcggctggacaaggcncatagnn

SEQ ID NO: 194891 - DNA, 133 bp, Homo sapiens; identical to SEQ ID NO: 194323
  misc_feature: GYAE6OF01C3D5O.51.29.C07.1.454.CMB.1.raw
  modified_base (118)..(133): a, c, t, g, unknown or other
  misc_feature (118)..(133): n is a, c, g, or t

SEQ ID NO: 194892 - DNA, 167 bp, Homo sapiens
  misc_feature: GYAE6OF01B9QT4.51.29.C07.1.454.CMB.1.raw
  modified_base (118)..(167): a, c, t, g, unknown or other
  misc_feature (118)..(167): n is a, c, g, or t
tcagcgatcgtatacacgaccggtgctcgatttagagtgctacgaagggaaagggcagcgtcactctgttcccaccctctctcgtagcactctgagcgggctggcaaggcgcagtagnnnnnnnnnnnnnnnnnnnnnnnnnnnnnnnnnnnnnnnnnnnnnnnnnn

SEQ ID NO: 194893 - DNA, 133 bp, Homo sapiens
  misc_feature: GYAE6OF01BUFQX.51.29.C07.1.454.CMB.1.raw
  modified_base (117)..(133): a, c, t, g, unknown or other
  misc_feature (117)..(133): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnnnnnnnn

SEQ ID NO: 194894 - DNA, 120 bp, Homo sapiens; identical to SEQ ID NO: 194289
  misc_feature: GYAE6OF01CXX7Q.51.29.C07.1.454.CMB.1.raw
  modified_base (118)..(120): a, c, t, g, unknown or other
  misc_feature (118)..(120): n is a, c, g, or t

SEQ ID NO: 194895 - DNA, 126 bp, Homo sapiens
  misc_feature: GYAE6OF01E3LFC.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaagggcagcgtcactctgttcccaccctcctctcgtagcactctgagcgggctggcaaggcgcaatgnnnnnnnnnn

SEQ ID NO: 194896 - DNA, 137 bp, Homo sapiens
  misc_feature: GYAE6OF01DJMW5.51.29.C07.1.454.CMB.1.raw
  modified_base (116)..(137): a, c, t, g, unknown or other
  misc_feature (116)..(137): n is a, c, g, or t
tcagcgatcgtatacacgaccggtgctcgatttagagtgctacgaagggaaagggcagcgtcactctgttcccacctcctctcgtagcactctgagcggctggcaaggcgcatagnnnnnnnnnnnnnnnnnnnnnn

SEQ ID NO: 194897 - DNA, 119 bp, Homo sapiens; identical to SEQ ID NO: 194137
  misc_feature: GYAE6OF01B8QTU.51.29.C07.1.454.CMB.1.raw
  modified_base (118)..(119): a, c, t, g, unknown or other
  misc_feature (118)..(119): n is a, c, g, or t

SEQ ID NO: 194898 - DNA, 120 bp, Homo sapiens
  misc_feature: GYAE6OF01BEP0G.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccaccctcctctcgtagcactcgagcgggctggcaaggcgcatagnnnn

SEQ ID NO: 194899 - DNA, 120 bp, Homo sapiens
  misc_feature: GYAE6OF01DA4QC.51.29.C07.1.454.CMB.1.raw
  modified_base (112)..(112): a, c, t, g, unknown or other
  misc_feature (112)..(112): n is a, c, g, or t
  modified_base (118)..(120): a, c, t, g, unknown or other
  misc_feature (118)..(120): n is a, c, g, or t
tcagcgatcgtatacacgaccggtgctcgatttagagtgctacgaagggaaagggcagcgtcactctgttcccgccctcctctcgtagcactctgagcgggctggcaaggcncatagnnn

SEQ ID NO: 194900 - DNA, 122 bp, Homo sapiens
  misc_feature: GYAE6OF01EADSV.51.29.C07.1.454.CMB.1.raw
  modified_base (102)..(102): a, c, t, g, unknown or other
  misc_feature (102)..(102): n is a, c, g, or t
  modified_base (118)..(122): a, c, t, g, unknown or other
  misc_feature (118)..(122): n is a, c, g, or t
tcagcgatcgtatacacgaccggtgctcgatttagagtgctacgaagggaaagggcagcgtcactctgttcccgccctcctctcgtagcactctgagcgggntggcaaggcgcatagnnnnn

SEQ ID NO: 194901 - DNA, 132 bp, Homo sapiens
  misc_feature: GYAE6OF01EW17O.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnnnnnnnnnnnn

SEQ ID NO: 194902 - DNA, 135 bp, Homo sapiens; identical to SEQ ID NO: 194715
  misc_feature: GYAE6OF01DMISJ.51.29.C07.1.454.CMB.1.raw
  modified_base (117)..(135): a, c, t, g, unknown or other
  misc_feature (117)..(135): n is a, c, g, or t

SEQ ID NO: 194903 - DNA, 127 bp, Homo sapiens
  misc_feature: GYAE6OF01DJDT1.51.29.C07.1.454.CMB.1.raw
  modified_base (117)..(127): a, c, t, g, unknown or other
  misc_feature (117)..(127): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnnn

SEQ ID NO: 194904 - DNA, 144 bp, Homo sapiens
  misc_feature: GYAE6OF01B2LYN.51.29.C07.1.454.CMB.1.raw
  modified_base (114)..(114): a, c, t, g, unknown or other
  misc_feature (114)..(114): n is a, c, g, or t
  modified_base (120)..(144): a, c, t, g, unknown or other
  misc_feature (120)..(144): n is a, c, g, or t
tcagcgatcgtatacacgaccggtgctcgatttagagtgctacgaagggaagggcagcgtcactctgttcccaccctcctctcgtacgcaactctgagcgggctaggcaaggcncatagnnnnnnnnnnnnnnnnnnnnnnnnn

SEQ ID NO: 194905 - DNA, 129 bp, Homo sapiens
  misc_feature: GYAE6OF01DBM75.51.29.C07.1.454.CMB.1.raw
  modified_base (117)..(129): a, c, t, g, unknown or other
  misc_feature (117)..(129): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnnnnnnnnnnnnn

SEQ ID NO: 194906 - DNA, 137 bp, Homo sapiens
  misc_feature: GYAE6OF01BWH3M.51.29.C07.1.454.CMB.1.raw
  modified_base (119)..(137): a, c, t, g, unknown or other
  misc_feature (119)..(137): n is a, c, g, or t
tcagcgatcgtatacacgaccggtgctcgatttagagtgctacgaagggaaagggtcagcgtcactctgttcccaccctcctctcgtagcactctgagcgggctggcaaggcgcatagnnnnnnnnnnnnnnnnnnn

SEQ ID NO: 194907 - DNA, 170 bp, Homo sapiens
  misc_feature: GYAE6OF01E4FCJ.51.29.C07.1.454.CMB.1.raw
  modified_base (158)..(170): a, c, t, g, unknown or other
  misc_feature (158)..(170): n is a, c, g, or t
tcagcgatcgtatacacgaccggtgctcgatttagagtgctacgaagggaaagggaacgaccggtgctcgatttagagtgctacgaagggaaagggcagcgtcactctgttcccgccctcctctcgtagcactctgagcggctggcaaggcgcatagnnnnnnnnnnnnn

SEQ ID NO: 194908 - DNA, 126 bp, Homo sapiens
  misc_feature: GYAE6OF01BNAD4.51.29.C07.1.454.CMB.1.raw
  modified_base (112)..(112): a, c, t, g, unknown or other
  misc_feature (112)..(112): n is a, c, g, or t
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttcccgccctcctctcgtagcactctgagcggctggacaaggcnatagnnnnnnnnnn

SEQ ID NO: 194909 - DNA, 124 bp, Homo sapiens
  misc_feature: GYAE6OF01DZB3K.51.29.C07.1.454.CMB.1.raw
  modified_base (120)..(124): a, c, t, g, unknown or other
  misc_feature (120)..(124): n is a, c, g, or t
tcagcgatcgtatacacgaccggtgctcgatttagagtgctacgaagggaaagggcagcgtcactctgttcccgccctcctctcgtagcactctgaccgcgggctggcaaggcgcatagnnnnn

SEQ ID NO: 194910 - DNA, 180 bp, Homo sapiens
  misc_feature: GYAE6OF01EAIMH.51.29.C07.1.454.CMB.1.raw
  modified_base (162)..(180): a, c, t, g, unknown or other
  misc_feature (162)..(180): n is a, c, g, or t
tcagcgatcgtatacacgaccggtgctcgatttagagtgctacgaagggaaggcacgaccggtgctcgatttagagtgctacgaagggaaaggcagcgtcactctgttcccaccctcctctcgtagcactctagaggcgggtctggcaacgggctacatagnnnnnnnnnnnnnnnnnnn

SEQ ID NO: 194911 - DNA, 119 bp, Homo sapiens; identical to SEQ ID NO: 194137
  misc_feature: GYAE6OF01ALN62.51.29.C07.1.454.CMB.1.raw
  modified_base (118)..(119): a, c, t, g, unknown or other
  misc_feature (118)..(119): n is a, c, g, or t

SEQ ID NO: 194912 - DNA, 121 bp, Homo sapiens
  misc_feature: GYAE6OF01BZGGR.51.29.C07.1.454.CMB.1.raw
  modified_base (116)..(121): a, c, t, g, unknown or other
  misc_feature (116)..(121): n is a, c, g, or t
tcagcgatcgtatacacgaccggtgctcgatttagagtgctacgaagggaaagggcagcgtcactctgttcccaccctctctcgtagcactctgagcggctggcaaggcgcatagnnnnnn

SEQ ID NO: 194913 - DNA, 250 bp, Homo sapiens
  misc_feature: GYAE6OF01ATNJ8.51.29.C07.1.454.CMB.1.raw
  modified_base (81)..(81): a, c, t, g, unknown or other
  misc_feature (81)..(81): n is a, c, g, or t
  modified_base (171)..(171): a, c, t, g, unknown or other
  misc_feature (171)..(171): n is a, c, g, or t
  modified_base (175)..(250): a, c, t, g, unknown or other
  misc_feature (175)..(250): n is a, c, g, or t
tcagcgatcgtatacacgaccggtgctcgatttagagtgctacgaaggggaaagggcacgaccggtgctcgatttagagtnctacgaagggaaagggcagcgtcactctgttccccgccctcgtctcgtacgcactctgaggccgggctggacaagggcctccaaagtgcngcannnnnnnnnnnnnnnnnnnnnnnnnnnnnnnnnnnnnnnnnnnnnnnnnnnnnnnnnnnnnnnnnnnnnnnnnnnn

SEQ ID NO: 194914 - DNA, 128 bp, Homo sapiens; identical to SEQ ID NO: 194886
  misc_feature: GYAE6OF01C090W.51.29.C07.1.454.CMB.1.raw
  modified_base (118)..(128): a, c, t, g, unknown or other
  misc_feature (118)..(128): n is a, c, g, or t

SEQ ID NO: 194915 - DNA, 139 bp, Homo sapiens
  misc_feature: GYAE6OF01BFJR4.51.29.C07.1.454.CMB.1.raw
  modified_base (117)..(139): a, c, t, g, unknown or other
  misc_feature (117)..(139): n is a, c, g, or t
tcagcgatcgtatacacgaccggtgctcgatttagagtgctacgaagggaaagggcagcgtcactctgttcccgccctcctctcgtagcactctgagcggctggcaaggcgcatagnnnnnnnnnnnnnnnnnnnnnnn

SEQ ID NO: 194916 - DNA, 129 bp, Homo sapiens
  misc_feature: GYAE6OF01A4I2T.51.29.C07.1.454.CMB.1.raw
  modified_base (112)..(112): a, c, t, g, unknown or other
  misc_feature (112)..(112): n is a, c, g, or t
  modified_base (118)..(129): a, c, t, g, unknown or other
  misc_feature (118)..(129): n is a, c, g, or t
tcagcgatcgtatacacgaccggtgctcgatttagagtgctacgaagggaaagggcggcgtcactctgttcccgccctcctctcgtagcactctgagcgggctggcaaggcncatagnnnnnnnnnnnn

SEQ ID NO: 194917 - DNA, 170 bp, Homo sapiens
  misc_feature: GYAE6OF01BG7Y9.51.29.C07.1.454.CMB.1.raw
  modified_base (102)..(102): a, c, t, g, unknown or other
  misc_feature (102)..(102): n is a, c, g, or t
  modified_base (156)..(156): a, c, t, g, unknown or other
  misc_feature (156)..(156): n is a, c, g, or t
  modified_base (159)..(159): a, c, t, g, unknown or other
  misc_feature (159)..(159): n is a, c, g, or t
  modified_base (162)..(170): a, c, t, g, unknown or other
  misc_feature (162)..(170): n is a, c, g, or t
tcagcgatcgtatacacgaccggtgctcgatttagagtgctacgaagggaaagggcacgaccggtgctcgatttagagtgctacggaagggaaggcagcgtnactctcgtcccaccctctctcgtacgcactcgtgaggcgggctggacgaaggcntanagnnnnnnnnn

SEQ ID NO: 194918 - DNA, 139 bp, Homo sapiens
  misc_feature: GYAE6OF02IZBDB.51.29.C07.1.454.CMB.1.raw
  modified_base (115)..(139): a, c, t, g, unknown or other
  misc_feature (115)..(139): n is a, c, g, or t
tcagcgatcgtatacacgaccggtgctcgatttagagtgctacgaaggaaggcgagcgtcactctgttcccgcctcctctcgtagccactctgagcggctggcaaggcgcatagnnnnnnnnnnnnnnnnnnnnnnnnn

SEQ ID NO: 194919 - DNA, 115 bp, Homo sapiens
  misc_feature: GYAE6OF02I9DX6.51.29.C07.1.454.CMB.1.raw
  modified_base (113)..(115): a, c, t, g, unknown or other
  misc_feature (113)..(115): n is a, c, g, or t
tcagcgatcgtatacacgaccggtgctcgatttagagtgctacgaaggaaggcagcgtcactctgttcccacctcctctcgtagcactctgagcggctggcaaggcgcatagnnn

SEQ ID NO: 194920 - DNA, 112 bp, Homo sapiens
  misc_feature: GYAE6OF02H67YP.51.29.C07.1.454.CMB.1.raw
  modified_base (112)..(112): a, c, t, g, unknown or other
  misc_feature (112)..(112): n is a, c, g, or t
tcagcgatcgtatacacgaccggtgctcgatttagagtgctacgaaggaaggcagcgtcactctgttccacctcctctcgtagcactatgagcggctggcaaggcgcatagn

SEQ ID NO: 194921 - DNA, 114 bp, Homo sapiens
  misc_feature: GYAE6OF02IWW36.51.29.C07.1.454.CMB.1.raw
  modified_base (113)..(114): a, c, t, g, unknown or other
  misc_feature (113)..(114): n is a, c, g, or t
tcagcgatcgtatacacgaccggtgctcgatttagagtgctacgaaggaaggcagcgtcactctgttcccacctcctctcgtagcactctgagcggctggcaaggcgcatagnn

SEQ ID NO: 194922 - DNA, 111 bp, Homo sapiens; identical to SEQ ID NO: 194096
  misc_feature: GYAE6OF02H08OK.51.29.C07.1.454.CMB.1.raw
  modified_base (111)..(111): a, c, t, g, unknown or other
  misc_feature (111)..(111): n is a, c, g, or t

SEQ ID NO: 194923 - DNA, 115 bp, Homo sapiens; identical to SEQ ID NO: 194126
  misc_feature: GYAE6OF02GQEBD.51.29.C07.1.454.CMB.1.raw
  modified_base (115)..(115): a, c, t, g, unknown or other
  misc_feature (115)..(115): n is a, c, g, or t

SEQ ID NO: 194924 - DNA, 116 bp, Homo sapiens
  misc_feature: GYAE6OF02IOEDQ.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaaggaaagggcagcgtcactctgttcccacctcctctcgtagcactctgagcgggctggcaaggcgcatagn

SEQ ID NO: 194925 - DNA, 158 bp, Homo sapiens
  misc_feature: GYAE6OF02IZ7K6.51.29.C07.1.454.CMB.1.raw
  modified_base (158)..(158): a, c, t, g, unknown or other
  misc_feature (158)..(158): n is a, c, g, or t
tcagcgatcgtatacacgaccggtgctcgatttagagtgctacgaagggaaagggcacgaccggtgctcgatttagagtgctacgaagggaaagggcagcgtcactctgttcccgcctcctctcgtagcactctgagcgggctggcaaggcgcatagn

SEQ ID NO: 194926 - DNA, 117 bp, Homo sapiens; identical to SEQ ID NO: 194123
  misc_feature: GYAE6OF02GAJLU.51.29.C07.1.454.CMB.1.raw
  modified_base (117)..(117): a, c, t, g, unknown or other
  misc_feature (117)..(117): n is a, c, g, or t

SEQ ID NO: 194927 - DNA, 119 bp, Homo sapiens
  misc_feature: GYAE6OF02HZJ9G.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnn

SEQ ID NO: 194928 - DNA, 136 bp, Homo sapiens; identical to SEQ ID NO: 194247
  misc_feature: GYAE6OF02IZNF5.51.29.C07.1.454.CMB.1.raw
  modified_base (118)..(136): a, c, t, g, unknown or other
  misc_feature (118)..(136): n is a, c, g, or t

SEQ ID NO: 194929 - DNA, 117 bp, Homo sapiens; identical to SEQ ID NO: 194726
  misc_feature: GYAE6OF02IQZT4.51.29.C07.1.454.CMB.1.raw
  modified_base (117)..(117): a, c, t, g, unknown or other
  misc_feature (117)..(117): n is a, c, g, or t

SEQ ID NO: 194930 - DNA, 118 bp, Homo sapiens; identical to SEQ ID NO: 194140
  misc_feature: GYAE6OF02HM0G0.51.29.C07.1.454.CMB.1.raw
  modified_base (118)..(118): a, c, t, g, unknown or other
  misc_feature (118)..(118): n is a, c, g, or t

SEQ ID NO: 194931 - DNA, 120 bp, Homo sapiens
  misc_feature: GYAE6OF02F1R5Z.51.29.C07.1.454.CMB.1.raw
  modified_base (116)..(120): a, c, t, g, unknown or other
  misc_feature (116)..(120): n is a, c, g, or t
tcagcgatcgtatacacgaccggtgctcgatttagagtgctacgaagggaagggcagcgtcactctgttccaccctcctctcgtagcactctgagcgggctggcaaggcgcatagnnnnn

SEQ ID NO: 194932 - DNA, 117 bp, Homo sapiens; identical to SEQ ID NO: 194123
  misc_feature: GYAE6OF02F89L1.51.29.C07.1.454.CMB.1.raw
  modified_base (117)..(117): a, c, t, g, unknown or other
  misc_feature (117)..(117): n is a, c, g, or t

SEQ ID NO: 194933 - DNA, 116 bp, Homo sapiens; identical to SEQ ID NO: 194127
  misc_feature: GYAE6OF02GFUA2.51.29.C07.1.454.CMB.1.raw
  modified_base (116)..(116): a, c, t, g, unknown or other
  misc_feature (116)..(116): n is a, c, g, or t

SEQ ID NO: 194934 - DNA, 116 bp, Homo sapiens; identical to SEQ ID NO: 194127
  misc_feature: GYAE6OF02HUKT7.51.29.C07.1.454.CMB.1.raw
  modified_base (116)..(116): a, c, t, g, unknown or other
  misc_feature (116)..(116): n is a, c, g, or t

SEQ ID NO: 194935 - DNA, 164 bp, Homo sapiens
  misc_feature: GYAE6OF02GOBT7.51.29.C07.1.454.CMB.1.raw
  modified_base (155)..(164): a, c, t, g, unknown or other
  misc_feature (155)..(164): n is a, c, g, or t
tcagcgatcgtatacacgaccggtgctcgatttagagtgctacgaagggaagggcgacgaccggtgctcgatttagagtgctacgaagggaaggcagcgtcactctgttcccacctcctctcgtagcatctgagcgggctggcaaggcgcatagnnnnnnnnnn

SEQ ID NO: 194936 - DNA, 115 bp, Homo sapiens; identical to SEQ ID NO: 194097
  misc_feature: GYAE6OF02GXBVM.51.29.C07.1.454.CMB.1.raw
  modified_base (115)..(115): a, c, t, g, unknown or other
  misc_feature (115)..(115): n is a, c, g, or t

SEQ ID NO: 194937 - DNA, 142 bp, Homo sapiens
  misc_feature: GYAE6OF02GV9R9.51.29.C07.1.454.CMB.1.raw
  modified_base (114)..(142): a, c, t, g, unknown or other
  misc_feature (114)..(142): n is a, c, g, or t
tcagcgatcgtatacacgaccggtgctcgatttagagtgctacgaagggaaggcagcgtcactctgttcccacctcctctcgtagcactctgagcggctggcaaggcgcatagnnnnnnnnnnnnnnnnnnnnnnnnnnnnn

SEQ ID NO: 194938 - DNA, 116 bp, Homo sapiens
  misc_feature: GYAE6OF02HJ9R3.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaagggcagcgtcactctgttcccgcctcctctcgtagcactctgagcgggctggcaaggcgcatagn

SEQ ID NO: 194939 - DNA, 117 bp, Homo sapiens; identical to SEQ ID NO: 194123
  misc_feature: GYAE6OF02F4W6T.51.29.C07.1.454.CMB.1.raw
  modified_base (117)..(117): a, c, t, g, unknown or other
  misc_feature (117)..(117): n is a, c, g, or t

SEQ ID NO: 194940 - DNA, 117 bp, Homo sapiens; identical to SEQ ID NO: 194726
  misc_feature: GYAE6OF02IMGYT.51.29.C07.1.454.CMB.1.raw
  modified_base (117)..(117): a, c, t, g, unknown or other
  misc_feature (117)..(117): n is a, c, g, or t

SEQ ID NO: 194941 - DNA, 116 bp, Homo sapiens; identical to SEQ ID NO: 194127
  misc_feature: GYAE6OF02G08OQ.51.29.C07.1.454.CMB.1.raw
  modified_base (116)..(116): a, c, t, g, unknown or other
  misc_feature (116)..(116): n is a, c, g, or t

SEQ ID NO: 194942 - DNA, 117 bp, Homo sapiens
  misc_feature: GYAE6OF02J0XJJ.51.29.C07.1.454.CMB.1.raw
  modified_base (114)..(117): a, c, t, g, unknown or other
  misc_feature (114)..(117): n is a, c, g, or t
tcagcgatcgtatacacgaccggtgctcgatttagagtgctacgaaggaagggcagcgtcactctgttccacctcctctcgtagcactctgagcgggctggcaaggcgcatagnnnn

SEQ ID NO: 194943 - DNA, 149 bp, Homo sapiens
  misc_feature: GYAE6OF02F5ZWM.51.29.C07.1.454.CMB.1.raw
  modified_base (117)..(149): a, c, t, g, unknown or other
  misc_feature (117)..(149): n is a, c, g, or t
tcagcgatcgtatacacgaccggtgctcgatttagagtgctacgaagggaagggcagcgtcactctgttcccgcctcctctcgtagcactctgagcgggctggcaaggcgcatacgnnnnnnnnnnnnnnnnnnnnnnnnnnnnnnnnn

SEQ ID NO: 194944 - DNA, 115 bp, Homo sapiens
  misc_feature: GYAE6OF02H64O4.51.29.C07.1.454.CMB.1.raw
  modified_base (93)..(93): a, c, t, g, unknown or other
  misc_feature (93)..(93): n is a, c, g, or t
  modified_base (114)..(115): a, c, t, g, unknown or other
  misc_feature (114)..(115): n is a, c, g, or t
tcagcgatcgtatacacgaccggtgctcgatttagagtgctacgaaggaagggcagcgtcactctgttccacctcctctcgtagcactctgancgggctggcaaggcgcatagnn

SEQ ID NO: 194945 - DNA, 123 bp, Homo sapiens
  misc_feature: GYAE6OF02IMWU3.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttccgcctcctctcgtagcactctgagcgggctggcaaggcgccatagnnnnnnn

SEQ ID NO: 194946 - DNA, 119 bp, Homo sapiens; identical to SEQ ID NO: 194927
  misc_feature: GYAE6OF02I9UO1.51.29.C07.1.454.CMB.1.raw
  modified_base (117)..(119): a, c, t, g, unknown or other
  misc_feature (117)..(119): n is a, c, g, or t

SEQ ID NO: 194947 - DNA, 117 bp, Homo sapiens
  misc_feature: GYAE6OF02IOVF8.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccacctcctctcgtagcactctgagcgggctggcaaggcgcatagn

SEQ ID NO: 194948 - DNA, 118 bp, Homo sapiens; identical to SEQ ID NO: 194140
  misc_feature: GYAE6OF02GP99M.51.29.C07.1.454.CMB.1.raw
  modified_base (118)..(118): a, c, t, g, unknown or other
  misc_feature (118)..(118): n is a, c, g, or t

SEQ ID NO: 194949 - DNA, 115 bp, Homo sapiens; identical to SEQ ID NO: 194097
  misc_feature: GYAE6OF02F056A.51.29.C07.1.454.CMB.1.raw
  modified_base (115)..(115): a, c, t, g, unknown or other
  misc_feature (115)..(115): n is a, c, g, or t

SEQ ID NO: 194950 - DNA, 117 bp, Homo sapiens; identical to SEQ ID NO: 194123
  misc_feature: GYAE6OF02HXST8.51.29.C07.1.454.CMB.1.raw
  modified_base (117)..(117): a, c, t, g, unknown or other
  misc_feature (117)..(117): n is a, c, g, or t

SEQ ID NO: 194951 - DNA, 115 bp, Homo sapiens
  misc_feature: GYAE6OF02GMFQL.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaaggcagcgtaactctgttcccacctcctctcgtagcactctgagcgggctggcaaggcgcatagn

SEQ ID NO: 194952 - DNA, 114 bp, Homo sapiens
  misc_feature: GYAE6OF02GYFMI.51.29.C07.1.454.CMB.1.raw
  modified_base (114)..(114): a, c, t, g, unknown or other
  misc_feature (114)..(114): n is a, c, g, or t
tcagcgatcgtatacacgaccggtgctcgatttagagtgctacgaaggaaggcagcgtcactctgttcccacctcctctcgtagcactctgagcgggctggcaaggcgcatagn

SEQ ID NO: 194953 - DNA, 136 bp, Homo sapiens
  misc_feature: GYAE6OF02FO0JS.51.29.C07.1.454.CMB.1.raw
  modified_base (117)..(136): a, c, t, g, unknown or other
  misc_feature (117)..(136): n is a, c, g, or t
tcagcgatcgtatacacgaccggtgctcgatttagagtgctacgaagggaagggcgagcgtcactctgtccaccctcctctcgtagcactcctgagcgggctggcaaggcgcatagnnnnnnnnnnnnnnnnnnnn

SEQ ID NO: 194954 - DNA, 117 bp, Homo sapiens; identical to SEQ ID NO: 194173
  misc_feature: GYAE6OF02IJVW5.51.29.C07.1.454.CMB.1.raw
  modified_base (117)..(117): a, c, t, g, unknown or other
  misc_feature (117)..(117): n is a, c, g, or t

SEQ ID NO: 194955 - DNA, 114 bp, Homo sapiens; identical to SEQ ID NO: 194111
  misc_feature: GYAE6OF02HDQJ4.51.29.C07.1.454.CMB.1.raw
  modified_base (114)..(114): a, c, t, g, unknown or other
  misc_feature (114)..(114): n is a, c, g, or t

SEQ ID NO: 194956 - DNA, 131 bp, Homo sapiens
  misc_feature: GYAE6OF02F1BUI.51.29.C07.1.454.CMB.1.raw
  modified_base (117)..(131): a, c, t, g, unknown or other
  misc_feature (117)..(131): n is a, c, g, or t
tcagcgatcgtatacacgaccggtgctcgatttagagtgctacgaagggaagggcagcgtcactctgttcccacctcctctcgtagcactctgagcgggctggcaaggcgccatagnnnnnnnnnnnnnnn

SEQ ID NO: 194957 - DNA, 119 bp, Homo sapiens
  misc_feature: GYAE6OF02F55VR.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnnn

SEQ ID NO: 194958 - DNA, 118 bp, Homo sapiens; identical to SEQ ID NO: 194139
  misc_feature: GYAE6OF02HCH2I.51.29.C07.1.454.CMB.1.raw
  modified_base (118)..(118): a, c, t, g, unknown or other
  misc_feature (118)..(118): n is a, c, g, or t

SEQ ID NO: 194959 - DNA, 117 bp, Homo sapiens; identical to SEQ ID NO: 194173
  misc_feature: GYAE6OF02IH2QR.51.29.C07.1.454.CMB.1.raw
  modified_base (117)..(117): a, c, t, g, unknown or other
  misc_feature (117)..(117): n is a, c, g, or t

SEQ ID NO: 194960 - DNA, 118 bp, Homo sapiens
  misc_feature: GYAE6OF02GF32T.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaaggcagcgtcactctgttcccgccctcctctcgtagcactctgagcgggctggcaaggcgcatagnn

SEQ ID NO: 194961 - DNA, 114 bp, Homo sapiens; identical to SEQ ID NO: 194107
  misc_feature: GYAE6OF02I7TGJ.51.29.C07.1.454.CMB.1.raw
  modified_base (113)..(114): a, c, t, g, unknown or other
  misc_feature (113)..(114): n is a, c, g, or t

SEQ ID NO: 194962 - DNA, 116 bp, Homo sapiens; identical to SEQ ID NO: 194938
  misc_feature: GYAE6OF02IYJTD.51.29.C07.1.454.CMB.1.raw
  modified_base (116)..(116): a, c, t, g, unknown or other
  misc_feature (116)..(116): n is a, c, g, or t

SEQ ID NO: 194963 - DNA, 117 bp, Homo sapiens; identical to SEQ ID NO: 194123
  misc_feature: GYAE6OF02FS7A3.51.29.C07.1.454.CMB.1.raw
  modified_base (117)..(117): a, c, t, g, unknown or other
  misc_feature (117)..(117): n is a, c, g, or t

SEQ ID NO: 194964 - DNA, 130 bp, Homo sapiens
  misc_feature: GYAE6OF02GXOWD.51.29.C07.1.454.CMB.1.raw
  modified_base (119)..(130): a, c, t, g, unknown or other
  misc_feature (119)..(130): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnnnnnnnnnn

SEQ ID NO: 194965 - DNA, 119 bp, Homo sapiens; identical to SEQ ID NO: 194160
  misc_feature: GYAE6OF02HT2EI.51.29.C07.1.454.CMB.1.raw
  modified_base (118)..(119): a, c, t, g, unknown or other
  misc_feature (118)..(119): n is a, c, g, or t

SEQ ID NO: 194966 - DNA, 119 bp, Homo sapiens; identical to SEQ ID NO: 194137
  misc_feature: GYAE6OF02G6RE9.51.29.C07.1.454.CMB.1.raw
  modified_base (118)..(119): a, c, t, g, unknown or other
  misc_feature (118)..(119): n is a, c, g, or t

SEQ ID NO: 194967 - DNA, 118 bp, Homo sapiens; identical to SEQ ID NO: 194139
  misc_feature: GYAE6OF02G7TE1.51.29.C07.1.454.CMB.1.raw
  modified_base (118)..(118): a, c, t, g, unknown or other
  misc_feature (118)..(118): n is a, c, g, or t

SEQ ID NO: 194968 - DNA, 116 bp, Homo sapiens; identical to SEQ ID NO: 194127
  misc_feature: GYAE6OF02GIA57.51.29.C07.1.454.CMB.1.raw
  modified_base (116)..(116): a, c, t, g, unknown or other
  misc_feature (116)..(116): n is a, c, g, or t

SEQ ID NO: 194969 - DNA, 116 bp, Homo sapiens; identical to SEQ ID NO: 194938
  misc_feature: GYAE6OF02GWSHN.51.29.C07.1.454.CMB.1.raw
  modified_base (116)..(116): a, c, t, g, unknown or other
  misc_feature (116)..(116): n is a, c, g, or t

SEQ ID NO: 194970 - DNA, 117 bp, Homo sapiens; identical to SEQ ID NO: 194123
  misc_feature: GYAE6OF02HI5AR.51.29.C07.1.454.CMB.1.raw
  modified_base (117)..(117): a, c, t, g, unknown or other
  misc_feature (117)..(117): n is a, c, g, or t

SEQ ID NO: 194971 - DNA, 116 bp, Homo sapiens
  misc_feature: GYAE6OF02HL4YQ.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaagggcagcgtcactctgttcccacctcctctcgtagcactctgagcgggctggcaaggcgcatagn

SEQ ID NO: 194972 - DNA, 117 bp, Homo sapiens; identical to SEQ ID NO: 194173
  misc_feature: GYAE6OF02IM5XR.51.29.C07.1.454.CMB.1.raw
  modified_base (117)..(117): a, c, t, g, unknown or other
  misc_feature (117)..(117): n is a, c, g, or t

SEQ ID NO: 194973 - DNA, 121 bp, Homo sapiens
  misc_feature: GYAE6OF02H05O1.51.29.C07.1.454.CMB.1.raw
  modified_base (116)..(121): a, c, t, g, unknown or other
  misc_feature (116)..(121): n is a, c, g, or t
tcagcgatcgtatacacgaccggtgctcgatttagagtgctacgaagggaaagggcagcgtcactctgttccgcctcctctcgtagcactctgagcgggctggcaaggcgcatagnnnnnn

SEQ ID NO: 194974 - DNA, 118 bp, Homo sapiens; identical to SEQ ID NO: 194140
  misc_feature: GYAE6OF02G3H67.51.29.C07.1.454.CMB.1.raw
  modified_base (118)..(118): a, c, t, g, unknown or other
  misc_feature (118)..(118): n is a, c, g, or t

SEQ ID NO: 194975 - DNA, 117 bp, Homo sapiens; identical to SEQ ID NO: 194123
  misc_feature: GYAE6OF02GAZU4.51.29.C07.1.454.CMB.1.raw
  modified_base (117)..(117): a, c, t, g, unknown or other
  misc_feature (117)..(117): n is a, c, g, or t

SEQ ID NO: 194976 - DNA, 117 bp, Homo sapiens; identical to SEQ ID NO: 194726
  misc_feature: GYAE6OF02I0GPB.51.29.C07.1.454.CMB.1.raw
  modified_base (117)..(117): a, c, t, g, unknown or other
  misc_feature (117)..(117): n is a, c, g, or t

SEQ ID NO: 194977 - DNA, 117 bp, Homo sapiens; identical to SEQ ID NO: 194173
  misc_feature: GYAE6OF02GPT25.51.29.C07.1.454.CMB.1.raw
  modified_base (117)..(117): a, c, t, g, unknown or other
  misc_feature (117)..(117): n is a, c, g, or t

SEQ ID NO: 194978 - DNA, 119 bp, Homo sapiens; identical to SEQ ID NO: 194137
  misc_feature: GYAE6OF02I7IOK.51.29.C07.1.454.CMB.1.raw
  modified_base (118)..(119): a, c, t, g, unknown or other
  misc_feature (118)..(119): n is a, c, g, or t

SEQ ID NO: 194979 - DNA, 118 bp, Homo sapiens; identical to SEQ ID NO: 194139
  misc_feature: GYAE6OF02GMT7A.51.29.C07.1.454.CMB.1.raw
  modified_base (118)..(118): a, c, t, g, unknown or other
  misc_feature (118)..(118): n is a, c, g, or t

SEQ ID NO: 194980 - DNA, 117 bp, Homo sapiens; identical to SEQ ID NO: 194947
  misc_feature: GYAE6OF02IYFUY.51.29.C07.1.454.CMB.1.raw
  modified_base (117)..(117): a, c, t, g, unknown or other
  misc_feature (117)..(117): n is a, c, g, or t

SEQ ID NO: 194981 - DNA, 122 bp, Homo sapiens
  misc_feature: GYAE6OF02H6SOP.51.29.C07.1.454.CMB.1.raw
  modified_base (119)..(122): a, c, t, g, unknown or other
  misc_feature (119)..(122): n is a, c, g, or t
tcagcgatcgtatacacgaccggtgctcgatttagagtgctacgaagggaaagggcgagcgtcactctgttcccgccctcctctcgtagcactctgagcgggctggcaaggcgcatagnnnn

SEQ ID NO: 194982 - DNA, 114 bp, Homo sapiens; identical to SEQ ID NO: 194484
  misc_feature: GYAE6OF02G0KSC.51.29.C07.1.454.CMB.1.raw

SEQ ID NO: 194983 - DNA, 115 bp, Homo sapiens; identical to SEQ ID NO: 194126
  misc_feature: GYAE6OF02FTAKR.51.29.C07.1.454.CMB.1.raw
  modified_base (115)..(115): a, c, t, g, unknown or other
  misc_feature (115)..(115): n is a, c, g, or t

SEQ ID NO: 194984 - DNA, 118 bp, Homo sapiens; identical to SEQ ID NO: 194140
  misc_feature: GYAE6OF02HCWIM.51.29.C07.1.454.CMB.1.raw
  modified_base (118)..(118): a, c, t, g, unknown or other
  misc_feature (118)..(118): n is a, c, g, or t

SEQ ID NO: 194985 - DNA, 118 bp, Homo sapiens; identical to SEQ ID NO: 194139
  misc_feature: GYAE6OF02F5CRD.51.29.C07.1.454.CMB.1.raw
  modified_base (118)..(118): a, c, t, g, unknown or other
  misc_feature (118)..(118): n is a, c, g, or t

SEQ ID NO: 194986 - DNA, 116 bp, Homo sapiens; identical to SEQ ID NO: 194791
  misc_feature: GYAE6OF02ILL7D.51.29.C07.1.454.CMB.1.raw
  modified_base (116)..(116): a, c, t, g, unknown or other
  misc_feature (116)..(116): n is a, c, g, or t

SEQ ID NO: 194987 - DNA, 117 bp, Homo sapiens; identical to SEQ ID NO: 194123
  misc_feature: GYAE6OF02GI3HW.51.29.C07.1.454.CMB.1.raw
  modified_base (117)..(117): a, c, t, g, unknown or other
  misc_feature (117)..(117): n is a, c, g, or t

SEQ ID NO: 194988 - DNA, 119 bp, Homo sapiens; identical to SEQ ID NO: 194160
  misc_feature: GYAE6OF02F81EH.51.29.C07.1.454.CMB.1.raw
  modified_base (118)..(119): a, c, t, g, unknown or other
  misc_feature (118)..(119): n is a, c, g, or t

SEQ ID NO: 194989 - DNA, 117 bp, Homo sapiens
  misc_feature: GYAE6OF02IZEZT.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctcctctcgagcactctgagcgggctggcaaggcgcatagn

SEQ ID NO: 194990 - DNA, 118 bp, Homo sapiens; identical to SEQ ID NO: 194140
  misc_feature: GYAE6OF02GQ2UD.51.29.C07.1.454.CMB.1.raw
  modified_base (118)..(118): a, c, t, g, unknown or other
  misc_feature (118)..(118): n is a, c, g, or t

SEQ ID NO: 194991 - DNA, 118 bp, Homo sapiens; identical to SEQ ID NO: 194140
  misc_feature: GYAE6OF02HGSZ5.51.29.C07.1.454.CMB.1.raw
  modified_base (118)..(118): a, c, t, g, unknown or other
  misc_feature (118)..(118): n is a, c, g, or t

SEQ ID NO: 194992 - DNA, 118 bp, Homo sapiens; identical to SEQ ID NO: 194140
  misc_feature: GYAE6OF02IKTIG.51.29.C07.1.454.CMB.1.raw
  modified_base (118)..(118): a, c, t, g, unknown or other
  misc_feature (118)..(118): n is a, c, g, or t

SEQ ID NO: 194993 - DNA, 122 bp, Homo sapiens
  misc_feature: GYAE6OF02H4HQO.51.29.C07.1.454.CMB.1.raw
  modified_base (117)..(122): a, c, t, g, unknown or other
  misc_feature (117)..(122): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnnnnn

SEQ ID NO: 194994 - DNA, 119 bp, Homo sapiens; identical to SEQ ID NO: 194160
  misc_feature: GYAE6OF02H127I.51.29.C07.1.454.CMB.1.raw
  modified_base (118)..(119): a, c, t, g, unknown or other
  misc_feature (118)..(119): n is a, c, g, or t

SEQ ID NO: 194995 - DNA, 115 bp, Homo sapiens
  misc_feature: GYAE6OF02GIG7C.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaaggcagcgtcactctgttcccgcctcctctcgtagcactctgagcgggctggcaaggcgcatagn

SEQ ID NO: 194996 - DNA, 117 bp, Homo sapiens; identical to SEQ ID NO: 194947
  misc_feature: GYAE6OF02H7P47.51.29.C07.1.454.CMB.1.raw
  modified_base (117)..(117): a, c, t, g, unknown or other
  misc_feature (117)..(117): n is a, c, g, or t

SEQ ID NO: 194997 - DNA, 117 bp, Homo sapiens; identical to SEQ ID NO: 194123
  misc_feature: GYAE6OF02F2008.51.29.C07.1.454.CMB.1.raw
  modified_base (117)..(117): a, c, t, g, unknown or other
  misc_feature (117)..(117): n is a, c, g, or t

SEQ ID NO: 194998 - DNA, 117 bp, Homo sapiens; identical to SEQ ID NO: 194123
  misc_feature: GYAE6OF02FMPFX.51.29.C07.1.454.CMB.1.raw
  modified_base (117)..(117): a, c, t, g, unknown or other
  misc_feature (117)..(117): n is a, c, g, or t

SEQ ID NO: 194999 - DNA, 116 bp, Homo sapiens; identical to SEQ ID NO: 194127
  misc_feature: GYAE6OF02JFKEO.51.29.C07.1.454.CMB.1.raw
  modified_base (116)..(116): a, c, t, g, unknown or other
  misc_feature (116)..(116): n is a, c, g, or t

SEQ ID NO: 195000 - DNA, 118 bp, Homo sapiens
  misc_feature: GYAE6OF02IGH94.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnn

SEQ ID NO: 195001 - DNA, 119 bp, Homo sapiens
  misc_feature: GYAE6OF02G97GE.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnn

SEQ ID NO: 195002 - DNA, 117 bp, Homo sapiens
  misc_feature: GYAE6OF02JDM7C.51.29.C07.1.454.CMB.1.raw
  modified_base (115)..(117): a, c, t, g, unknown or other
  misc_feature (115)..(117): n is a, c, g, or t
tcagcgatcgtatacacgaccggtgctcgatttagagtgctacgaaggaaagggcagcgtcactctgttccacctcctctcgtagcactctgagcgggctggcaaggcgcatagnnn

SEQ ID NO: 195003 - DNA, 117 bp, Homo sapiens; identical to SEQ ID NO: 194173
  misc_feature: GYAE6OF02G5ZWJ.51.29.C07.1.454.CMB.1.raw
  modified_base (117)..(117): a, c, t, g, unknown or other
  misc_feature (117)..(117): n is a, c, g, or t

SEQ ID NO: 195004 - DNA, 118 bp, Homo sapiens; identical to SEQ ID NO: 194140
  misc_feature: GYAE6OF02I2MJQ.51.29.C07.1.454.CMB.1.raw
  modified_base (118)..(118): a, c, t, g, unknown or other
  misc_feature (118)..(118): n is a, c, g, or t

SEQ ID NO: 195005 - DNA, 116 bp, Homo sapiens; identical to SEQ ID NO: 194693
  misc_feature: GYAE6OF02GW9WC.51.29.C07.1.454.CMB.1.raw
  modified_base (116)..(116): a, c, t, g, unknown or other
  misc_feature (116)..(116): n is a, c, g, or t

SEQ ID NO: 195006 - DNA, 165 bp, Homo sapiens
  misc_feature: GYAE6OF02FMGXY.51.29.C07.1.454.CMB.1.raw
  modified_base (158)..(165): a, c, t, g, unknown or other
  misc_feature (158)..(165): n is a, c, g, or t
tcagcgatcgtatacacgaccggtgctcgatttagagtgctacgaagggaaagggcacgaccggtgctcgatttagagtgctacgaagggaagggcagcgtcactctgttcccaccctcctctcgtagcactctgagcgggctggcaaggcgcatagnnnnnnnn

SEQ ID NO: 195007 - DNA, 119 bp, Homo sapiens
  misc_feature: GYAE6OF02JTJ2Q.51.29.C07.1.454.CMB.1.raw
  modified_base (112)..(119): a, c, t, g, unknown or other
  misc_feature (112)..(119): n is a, c, g, or t
tcagcgatcgtatacacgaccggtgctcgatttagagtgctacgaaggaaggcagcgtcactctgttccgcctcctctcgtagcactctgagcggctggcaaggcgcatagnnnnnnnn

SEQ ID NO: 195008 - DNA, 118 bp, Homo sapiens; identical to SEQ ID NO: 194140
  misc_feature: GYAE6OF02IUN14.51.29.C07.1.454.CMB.1.raw
  modified_base (118)..(118): a, c, t, g, unknown or other
  misc_feature (118)..(118): n is a, c, g, or t

SEQ ID NO: 195009 - DNA, 117 bp, Homo sapiens; identical to SEQ ID NO: 194173
  misc_feature: GYAE6OF02GXSJL.51.29.C07.1.454.CMB.1.raw
  modified_base (117)..(117): a, c, t, g, unknown or other
  misc_feature (117)..(117): n is a, c, g, or t

SEQ ID NO: 195010 - DNA, 117 bp, Homo sapiens; identical to SEQ ID NO: 194206
  misc_feature: GYAE6OF02GIK5J.51.29.C07.1.454.CMB.1.raw

SEQ ID NO: 195011 - DNA, 118 bp, Homo sapiens; identical to SEQ ID NO: 194140
  misc_feature: GYAE6OF02HXPVU.51.29.C07.1.454.CMB.1.raw
  modified_base (118)..(118): a, c, t, g, unknown or other
  misc_feature (118)..(118): n is a, c, g, or t

SEQ ID NO: 195012 - DNA, 190 bp, Homo sapiens
  misc_feature: GYAE6OF02G1RNF.51.29.C07.1.454.CMB.1.raw
  modified_base (159)..(190): a, c, t, g, unknown or other
  misc_feature (159)..(190): n is a, c, g, or t
tcagcgatcgtatacacgaccggtgctcgatttagagtgctacgaagggaaagggcacgaccggtgctcgatttagagtgctacgagggaagggcagcgtcactctgttccaccctctctcgtagtcactcgtgagcgggactggcaaggccgcatagnnnnnnnnnnnnnnnnnnnnnnnnnnnnnnnn

SEQ ID NO: 195013 - DNA, 118 bp, Homo sapiens; identical to SEQ ID NO: 194481
  misc_feature: GYAE6OF02GQRLH.51.29.C07.1.454.CMB.1.raw
  modified_base (117)..(118): a, c, t, g, unknown or other
  misc_feature (117)..(118): n is a, c, g, or t

SEQ ID NO: 195014 - DNA, 118 bp, Homo sapiens; identical to SEQ ID NO: 194140
  misc_feature: GYAE6OF02HWHDS.51.29.C07.1.454.CMB.1.raw
  modified_base (118)..(118): a, c, t, g, unknown or other
  misc_feature (118)..(118): n is a, c, g, or t

SEQ ID NO: 195015 - DNA, 117 bp, Homo sapiens; identical to SEQ ID NO: 194147
  misc_feature: GYAE6OF02I2Z1A.51.29.C07.1.454.CMB.1.raw

SEQ ID NO: 195016 - DNA, 116 bp, Homo sapiens; identical to SEQ ID NO: 194269
  misc_feature: GYAE6OF02FO94V.51.29.C07.1.454.CMB.1.raw

SEQ ID NO: 195017 - DNA, 122 bp, Homo sapiens
  misc_feature: GYAE6OF02FUCMV.51.29.C07.1.454.CMB.1.raw
  modified_base (117)..(122): a, c, t, g, unknown or other
  misc_feature (117)..(122): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnn

SEQ ID NO: 195018 - DNA, 117 bp, Homo sapiens
  misc_feature: GYAE6OF02HQOOX.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaagggcagcgtcactctgttcccgcctcctctcgtagcactctgagcgggctggcaaggcgcatagnn

SEQ ID NO: 195019 - DNA, 119 bp, Homo sapiens; identical to SEQ ID NO: 194927
  misc_feature: GYAE6OF02HH0RK.51.29.C07.1.454.CMB.1.raw
  modified_base (117)..(119): a, c, t, g, unknown or other
  misc_feature (117)..(119): n is a, c, g, or t

SEQ ID NO: 195020 - DNA, 118 bp, Homo sapiens; identical to SEQ ID NO: 194139
  misc_feature: GYAE6OF02H3PSK.51.29.C07.1.454.CMB.1.raw
  modified_base (118)..(118): a, c, t, g, unknown or other
  misc_feature (118)..(118): n is a, c, g, or t

SEQ ID NO: 195021 - DNA, 118 bp, Homo sapiens; identical to SEQ ID NO: 194140
  misc_feature: GYAE6OF02HZB5A.51.29.C07.1.454.CMB.1.raw
  modified_base (118)..(118): a, c, t, g, unknown or other
  misc_feature (118)..(118): n is a, c, g, or t

SEQ ID NO: 195022 - DNA, 132 bp, Homo sapiens
  misc_feature: GYAE6OF02F9O5I.51.29.C07.1.454.CMB.1.raw
  modified_base (97)..(97): a, c, t, g, unknown or other
  misc_feature (97)..(97): n is a, c, g, or t
  modified_base (118)..(132): a, c, t, g, unknown or other
  misc_feature (118)..(132): n is a, c, g, or t
tcagcgatcgtatacacgaccggtgctcgatttagagtgctacgaagggaaagggcagcgtcactctgttcccaccctcctctcgtagcactctgancgggctggcaaggcgcatagnnnnnnnnnnnnnnn

SEQ ID NO: 195023 - DNA, 117 bp, Homo sapiens; identical to SEQ ID NO: 194173
  misc_feature: GYAE6OF02FUCVK.51.29.C07.1.454.CMB.1.raw
  modified_base (117)..(117): a, c, t, g, unknown or other
  misc_feature (117)..(117): n is a, c, g, or t

SEQ ID NO: 195024 - DNA, 118 bp, Homo sapiens
  misc_feature: GYAE6OF02IKL7C.51.29.C07.1.454.CMB.1.raw
  modified_base (115)..(118): a, c, t, g, unknown or other
  misc_feature (115)..(118): n is a, c, g, or t
tcagcgatcgtatacacgaccggtgctcgatttagagtgctacgaaggaagggacgagcgtcactctgttccgcctcctctcgtagcactctgagcggctggcaaggcgcatagnnnn

SEQ ID NO: 195025 - DNA, 116 bp, Homo sapiens; identical to SEQ ID NO: 194269
  misc_feature: GYAE6OF02HKNRI.51.29.C07.1.454.CMB.1.raw

SEQ ID NO: 195026 - DNA, 192 bp, Homo sapiens
  misc_feature: GYAE6OF02HEFLW.51.29.C07.1.454.CMB.1.raw
  modified_base (165)..(192): a, c, t, g, unknown or other
  misc_feature (165)..(192): n is a, c, g, or t
tcagcgatcgtatacacgaccggtgctcgatttagagtgctacgaagggaaagggcacgaccgggtgtctcgatttagaggtgcgtacgaagggaagggcagcgtcactctgttcccacctccgtctcgtagcacctctgagcgggctaggcaaggcgcagtagnnnnnnnnnnnnnnnnnnnnnnnnnnnn

SEQ ID NO: 195027 - DNA, 116 bp, Homo sapiens; identical to SEQ ID NO: 194285
  misc_feature: GYAE6OF02JDM4N.51.29.C07.1.454.CMB.1.raw
  modified_base (115)..(116): a, c, t, g, unknown or other
  misc_feature (115)..(116): n is a, c, g, or t

SEQ ID NO: 195028 - DNA, 118 bp, Homo sapiens
  misc_feature: GYAE6OF02F66QY.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnn

SEQ ID NO: 195029 - DNA, 118 bp, Homo sapiens; identical to SEQ ID NO: 194140
  misc_feature: GYAE6OF02H922D.51.29.C07.1.454.CMB.1.raw
  modified_base (118)..(118): a, c, t, g, unknown or other
  misc_feature (118)..(118): n is a, c, g, or t

SEQ ID NO: 195030 - DNA, 136 bp, Homo sapiens
  misc_feature: GYAE6OF02IH3VK.51.29.C07.1.454.CMB.1.raw
  modified_base (119)..(136): a, c, t, g, unknown or other
  misc_feature (119)..(136): n is a, c, g, or t
tcagcgatcgtatacacgaccggtgctcgatttagagtgctacgaagggaaagggcagcgtcactctgttcccaccctcctctcgtagcactctgagccgggctggcaaggcgcatagnnnnnnnnnnnnnnnnnn

SEQ ID NO: 195031 - DNA, 118 bp, Homo sapiens; identical to SEQ ID NO: 194139
  misc_feature: GYAE6OF02IITI8.51.29.C07.1.454.CMB.1.raw
  modified_base (118)..(118): a, c, t, g, unknown or other
  misc_feature (118)..(118): n is a, c, g, or t

SEQ ID NO: 195032 - DNA, 117 bp, Homo sapiens; identical to SEQ ID NO: 194173
  misc_feature: GYAE6OF02H9TVA.51.29.C07.1.454.CMB.1.raw
  modified_base (117)..(117): a, c, t, g, unknown or other
  misc_feature (117)..(117): n is a, c, g, or t

SEQ ID NO: 195033 - DNA, 117 bp, Homo sapiens; identical to SEQ ID NO: 194147
  misc_feature: GYAE6OF02HPNVA.51.29.C07.1.454.CMB.1.raw

SEQ ID NO: 195034 - DNA, 117 bp, Homo sapiens; identical to SEQ ID NO: 194947
  misc_feature: GYAE6OF02HQUWR.51.29.C07.1.454.CMB.1.raw
  modified_base (117)..(117): a, c, t, g, unknown or other
  misc_feature (117)..(117): n is a, c, g, or t

SEQ ID NO: 195035 - DNA, 118 bp, Homo sapiens; identical to SEQ ID NO: 194140
  misc_feature: GYAE6OF02GJYHB.51.29.C07.1.454.CMB.1.raw
  modified_base (118)..(118): a, c, t, g, unknown or other
  misc_feature (118)..(118): n is a, c, g, or t

SEQ ID NO: 195036 - DNA, 117 bp, Homo sapiens; identical to SEQ ID NO: 194123
  misc_feature: GYAE6OF02H7ZJC.51.29.C07.1.454.CMB.1.raw
  modified_base (117)..(117): a, c, t, g, unknown or other
  misc_feature (117)..(117): n is a, c, g, or t

SEQ ID NO: 195037 - DNA, 118 bp, Homo sapiens; identical to SEQ ID NO: 194139
  misc_feature: GYAE6OF02GQU3J.51.29.C07.1.454.CMB.1.raw
  modified_base (118)..(118): a, c, t, g, unknown or other
  misc_feature (118)..(118): n is a, c, g, or t

SEQ ID NO: 195038 - DNA, 116 bp, Homo sapiens; identical to SEQ ID NO: 194100
  misc_feature: GYAE6OF02F4I50.51.29.C07.1.454.CMB.1.raw
  modified_base (116)..(116): a, c, t, g, unknown or other
  misc_feature (116)..(116): n is a, c, g, or t

SEQ ID NO: 195039 - DNA, 116 bp, Homo sapiens; identical to SEQ ID NO: 194938
  misc_feature: GYAE6OF02GSJID.51.29.C07.1.454.CMB.1.raw
  modified_base (116)..(116): a, c, t, g, unknown or other
  misc_feature (116)..(116): n is a, c, g, or t

SEQ ID NO: 195040 - DNA, 117 bp, Homo sapiens
  misc_feature: GYAE6OF02GSIDD.51.29.C07.1.454.CMB.1.raw
  modified_base (115)..(117): a, c, t, g, unknown or other
  misc_feature (115)..(117): n is a, c, g, or t
tcagcgatcgtatacacgaccggtgctcgatttagagtgctacgaagggaaggcagcgtcactctgttcccaccctcctctcgtagcactctgagcggctggcaaggcgcatagnnn

SEQ ID NO: 195041 - DNA, 118 bp, Homo sapiens; identical to SEQ ID NO: 194140
  misc_feature: GYAE6OF02GC6AG.51.29.C07.1.454.CMB.1.raw
  modified_base (118)..(118): a, c, t, g, unknown or other
  misc_feature (118)..(118): n is a, c, g, or t

SEQ ID NO: 195042 - DNA, 121 bp, Homo sapiens; identical to SEQ ID NO: 194651
  misc_feature: GYAE6OF02GKKV2.51.29.C07.1.454.CMB.1.raw
  modified_base (118)..(121): a, c, t, g, unknown or other
  misc_feature (118)..(121): n is a, c, g, or t

SEQ ID NO: 195043 - DNA, 117 bp, Homo sapiens; identical to SEQ ID NO: 194206
  misc_feature: GYAE6OF02IST7U.51.29.C07.1.454.CMB.1.raw

SEQ ID NO: 195044 - DNA, 117 bp, Homo sapiens; identical to SEQ ID NO: 194173
  misc_feature: GYAE6OF02H9HCX.51.29.C07.1.454.CMB.1.raw
  modified_base (117)..(117): a, c, t, g, unknown or other
  misc_feature (117)..(117): n is a, c, g, or t

SEQ ID NO: 195045 - DNA, 126 bp, Homo sapiens
  misc_feature: GYAE6OF02HNL9J.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaagggcagcgtcactctgttcccgccctcctctcgtagcactctgagcgggctggcaaggcgcatagnnnnnnnnnn

SEQ ID NO: 195046 - DNA, 119 bp, Homo sapiens
  misc_feature: GYAE6OF02HQD0L.51.29.C07.1.454.CMB.1.raw
  modified_base (117)..(119): a, c, t, g, unknown or other
  misc_feature (117)..(119): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnn

SEQ ID NO: 195047 - DNA, 117 bp, Homo sapiens; identical to SEQ ID NO: 194206
  misc_feature: GYAE6OF02GKUDC.51.29.C07.1.454.CMB.1.raw

SEQ ID NO: 195048 - DNA, 118 bp, Homo sapiens; identical to SEQ ID NO: 194139
  misc_feature: GYAE6OF02I9A71.51.29.C07.1.454.CMB.1.raw
  modified_base (118)..(118): a, c, t, g, unknown or other
  misc_feature (118)..(118): n is a, c, g, or t

SEQ ID NO: 195049 - DNA, 119 bp, Homo sapiens; identical to SEQ ID NO: 195046
  misc_feature: GYAE6OF02IOK46.51.29.C07.1.454.CMB.1.raw
  modified_base (117)..(119): a, c, t, g, unknown or other
  misc_feature (117)..(119): n is a, c, g, or t

SEQ ID NO: 195050 - DNA, 188 bp, Homo sapiens
  misc_feature: GYAE6OF02IAQT3.51.29.C07.1.454.CMB.1.raw
  modified_base (125)..(125): a, c, t, g, unknown or other
  misc_feature (125)..(125): n is a, c, g, or t
  modified_base (127)..(129): a, c, t, g, unknown or other
  misc_feature (127)..(129): n is a, c, g, or t
  modified_base (131)..(188): a, c, t, g, unknown or other
  misc_feature (131)..(188): n is a, c, g, or t
tcagcgatcgtatacacgaccggtgctcgatttagagtgctacgaagggaaagggcgaggcgtacactactgttcccgcccgtcctctcggtagcactcctgagcgggctggcaaggcgcatagnannngnnnnnnnnnnnnnnnnnnnnnnnnnnnnnnnnnnnnnnnnnnnnnnnnnnnnnnnnnn

SEQ ID NO: 195051 - DNA, 117 bp, Homo sapiens; identical to SEQ ID NO: 194173
  misc_feature: GYAE6OF02HG1GB.51.29.C07.1.454.CMB.1.raw
  modified_base (117)..(117): a, c, t, g, unknown or other
  misc_feature (117)..(117): n is a, c, g, or t

SEQ ID NO: 195052 - DNA, 118 bp, Homo sapiens; identical to SEQ ID NO: 194140
  misc_feature: GYAE6OF02HUU0D.51.29.C07.1.454.CMB.1.raw
  modified_base (118)..(118): a, c, t, g, unknown or other
  misc_feature (118)..(118): n is a, c, g, or t

SEQ ID NO: 195053 - DNA, 118 bp, Homo sapiens; identical to SEQ ID NO: 194140
  misc_feature: GYAE6OF02H6FK2.51.29.C07.1.454.CMB.1.raw
  modified_base (118)..(118): a, c, t, g, unknown or other
  misc_feature (118)..(118): n is a, c, g, or t

SEQ ID NO: 195054 - DNA, 118 bp, Homo sapiens; identical to SEQ ID NO: 194139
  misc_feature: GYAE6OF02G1U2E.51.29.C07.1.454.CMB.1.raw
  modified_base (118)..(118): a, c, t, g, unknown or other
  misc_feature (118)..(118): n is a, c, g, or t

SEQ ID NO: 195055 - DNA, 118 bp, Homo sapiens; identical to SEQ ID NO: 194140
  misc_feature: GYAE6OF02HCU84.51.29.C07.1.454.CMB.1.raw
  modified_base (118)..(118): a, c, t, g, unknown or other
  misc_feature (118)..(118): n is a, c, g, or t

SEQ ID NO: 195056 - DNA, 148 bp, Homo sapiens
  misc_feature: GYAE6OF02GMCBM.51.29.C07.1.454.CMB.1.raw
  modified_base (117)..(119): a, c, t, g, unknown or other
  misc_feature (117)..(119): n is a, c, g, or t
  modified_base (121)..(148): a, c, t, g, unknown or other
  misc_feature (121)..(148): n is a, c, g, or t
tcagcgatcgtatacacgaccggtgctcgatttagagtgctacgaagggaaagggcagcgtcactctgttcccacctcgtctcgtagcactctgagcgggctggcaaggcgcatagnnntnnnnnnnnnnnnnnnnnnnnnnnnnnnn

SEQ ID NO: 195057 - DNA, 117 bp, Homo sapiens; identical to SEQ ID NO: 194123
  misc_feature: GYAE6OF02F1MGI.51.29.C07.1.454.CMB.1.raw
  modified_base (117)..(117): a, c, t, g, unknown or other
  misc_feature (117)..(117): n is a, c, g, or t

SEQ ID NO: 195058 - DNA, 142 bp, Homo sapiens
  misc_feature: GYAE6OF02GX1A2.51.29.C07.1.454.CMB.1.raw
  modified_base (119)..(142): a, c, t, g, unknown or other
  misc_feature (119)..(142): n is a, c, g, or t
tcagcgatcgtatacacgaccggtgctcgatttagagtgctacgaagggaaagggcgagcgtcactctgttcccgccctcctctcgtagcactctgagcgggctggcaaggcgcatagnnnnnnnnnnnnnnnnnnnnnnnn

SEQ ID NO: 195059 - DNA, 118 bp, Homo sapiens; identical to SEQ ID NO: 194481
  misc_feature: GYAE6OF02GAOBB.51.29.C07.1.454.CMB.1.raw
  modified_base (117)..(118): a, c, t, g, unknown or other
  misc_feature (117)..(118): n is a, c, g, or t

SEQ ID NO: 195060 - DNA, 117 bp, Homo sapiens; identical to SEQ ID NO: 194726
  misc_feature: GYAE6OF02I4TPR.51.29.C07.1.454.CMB.1.raw
  modified_base (117)..(117): a, c, t, g, unknown or other
  misc_feature (117)..(117): n is a, c, g, or t

SEQ ID NO: 195061 - DNA, 118 bp, Homo sapiens; identical to SEQ ID NO: 194139
  misc_feature: GYAE6OF02I3U9F.51.29.C07.1.454.CMB.1.raw
  modified_base (118)..(118): a, c, t, g, unknown or other
  misc_feature (118)..(118): n is a, c, g, or t

SEQ ID NO: 195062 - DNA, 116 bp, Homo sapiens; identical to SEQ ID NO: 194693
  misc_feature: GYAE6OF02HDHN0.51.29.C07.1.454.CMB.1.raw
  modified_base (116)..(116): a, c, t, g, unknown or other
  misc_feature (116)..(116): n is a, c, g, or t

SEQ ID NO: 195063 - DNA, 118 bp, Homo sapiens; identical to SEQ ID NO: 194140
  misc_feature: GYAE6OF02HYZW7.51.29.C07.1.454.CMB.1.raw
  modified_base (118)..(118): a, c, t, g, unknown or other
  misc_feature (118)..(118): n is a, c, g, or t

SEQ ID NO: 195064 - DNA, 118 bp, Homo sapiens; identical to SEQ ID NO: 194140
  misc_feature: GYAE6OF02GB4C7.51.29.C07.1.454.CMB.1.raw
  modified_base (118)..(118): a, c, t, g, unknown or other
  misc_feature (118)..(118): n is a, c, g, or t

SEQ ID NO: 195065 - DNA, 114 bp, Homo sapiens
  misc_feature: GYAE6OF02FZHM4.51.29.C07.1.454.CMB.1.raw
tcagcgatcgtatacacgaccggtgctcgatttagagtgctacgaaggaagggcagcgtcactctgttccgccctcctctcgtagcactctgagcgggctggcaaggcgcatag

SEQ ID NO: 195066 - DNA, 128 bp, Homo sapiens; identical to SEQ ID NO: 194886
  misc_feature: GYAE6OF02IRZW4.51.29.C07.1.454.CMB.1.raw
  modified_base (118)..(128): a, c, t, g, unknown or other
  misc_feature (118)..(128): n is a, c, g, or t

SEQ ID NO: 195067 - DNA, 118 bp, Homo sapiens; identical to SEQ ID NO: 194139
  misc_feature: GYAE6OF02GDY9G.51.29.C07.1.454.CMB.1.raw
  modified_base (118)..(118): a, c, t, g, unknown or other
  misc_feature (118)..(118): n is a, c, g, or t

SEQ ID NO: 195068 - DNA, 116 bp, Homo sapiens; identical to SEQ ID NO: 194617
  misc_feature: GYAE6OF02GOU0G.51.29.C07.1.454.CMB.1.raw

SEQ ID NO: 195069 - DNA, 118 bp, Homo sapiens; identical to SEQ ID NO: 194140
  misc_feature: GYAE6OF02G15ZA.51.29.C07.1.454.CMB.1.raw
  modified_base (118)..(118): a, c, t, g, unknown or other
  misc_feature (118)..(118): n is a, c, g, or t

SEQ ID NO: 195070 - DNA, 117 bp, Homo sapiens; identical to SEQ ID NO: 194147
  misc_feature: GYAE6OF02F8HEB.51.29.C07.1.454.CMB.1.raw

SEQ ID NO: 195071 - DNA, 116 bp, Homo sapiens; identical to SEQ ID NO: 194693
  misc_feature: GYAE6OF02HSQVK.51.29.C07.1.454.CMB.1.raw
  modified_base (116)..(116): a, c, t, g, unknown or other
  misc_feature (116)..(116): n is a, c, g, or t

SEQ ID NO: 195072 - DNA, 119 bp, Homo sapiens; identical to SEQ ID NO: 194137
  misc_feature: GYAE6OF02HV8YL.51.29.C07.1.454.CMB.1.raw
  modified_base (118)..(119): a, c, t, g, unknown or other
  misc_feature (118)..(119): n is a, c, g, or t

SEQ ID NO: 195073 - DNA, 116 bp, Homo sapiens; identical to SEQ ID NO: 194693
  misc_feature: GYAE6OF02GUBAQ.51.29.C07.1.454.CMB.1.raw
  modified_base (116)..(116): a, c, t, g, unknown or other
  misc_feature (116)..(116): n is a, c, g, or t

SEQ ID NO: 195074 - DNA, 132 bp, Homo sapiens
  misc_feature: GYAE6OF02GOODS.51.29.C07.1.454.CMB.1.raw
  modified_base (118)..(132): a, c, t, g, unknown or other
  misc_feature (118)..(132): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnnnnn

SEQ ID NO: 195075 - DNA, 117 bp, Homo sapiens; identical to SEQ ID NO: 194173
  misc_feature: GYAE6OF02G5TA1.51.29.C07.1.454.CMB.1.raw
  modified_base (117)..(117): a, c, t, g, unknown or other
  misc_feature (117)..(117): n is a, c, g, or t

SEQ ID NO: 195076 - DNA, 118 bp, Homo sapiens; identical to SEQ ID NO: 194481
  misc_feature: GYAE6OF02HFFRU.51.29.C07.1.454.CMB.1.raw
  modified_base (117)..(118): a, c, t, g, unknown or other
  misc_feature (117)..(118): n is a, c, g, or t

SEQ ID NO: 195077 - DNA, 159 bp, Homo sapiens
  misc_feature: GYAE6OF02HXQC6.51.29.C07.1.454.CMB.1.raw
  modified_base (119)..(159): a, c, t, g, unknown or other
  misc_feature (119)..(159): n is a, c, g, or t
tcagcgatcgtatacacgaccggtgctcgatttagagtgctacgaagggaaagggcgagcgtcactctgttcccgcctccgtctcgtagcactctgagcgggctggcaaggcgcatagnnnnnnnnnnnnnnnnnnnnnnnnnnnnnnnnnnnnnnnnn

SEQ ID NO: 195078 - DNA, 119 bp, Homo sapiens; identical to SEQ ID NO: 195001
  misc_feature: GYAE6OF02FE0S4.51.29.C07.1.454.CMB.1.raw
  modified_base (117)..(119): a, c, t, g, unknown or other
  misc_feature (117)..(119): n is a, c, g, or t

SEQ ID NO: 195079 - DNA, 150 bp, Homo sapiens
  misc_feature: GYAE6OF02IT8FK.51.29.C07.1.454.CMB.1.raw
  modified_base (120)..(150): a, c, t, g, unknown or other
  misc_feature (120)..(150): n is a, c, g, or t
tcagcgatcgtatacacgaccggtgctcgatttagagtgctacgaagggaaagggtcgagcgtcactctgttcccaccctcctctcgtagcactctgagcggctggcaaggcgcataggnnnnnnnnnnnnnnnnnnnnnnnnnnnnnnn

SEQ ID NO: 195080 - DNA, 118 bp, Homo sapiens; identical to SEQ ID NO: 194481
  misc_feature: GYAE6OF02FT55G.51.29.C07.1.454.CMB.1.raw
  modified_base (117)..(118): a, c, t, g, unknown or other
  misc_feature (117)..(118): n is a, c, g, or t

SEQ ID NO: 195081 - DNA, 118 bp, Homo sapiens; identical to SEQ ID NO: 194139
  misc_feature: GYAE6OF02FMSFF.51.29.C07.1.454.CMB.1.raw
  modified_base (118)..(118): a, c, t, g, unknown or other
  misc_feature (118)..(118): n is a, c, g, or t

SEQ ID NO: 195082 - DNA, 118 bp, Homo sapiens; identical to SEQ ID NO: 194140
  misc_feature: GYAE6OF02JDIFR.51.29.C07.1.454.CMB.1.raw
  modified_base (118)..(118): a, c, t, g, unknown or other
  misc_feature (118)..(118): n is a, c, g, or t

SEQ ID NO: 195083 - DNA, 118 bp, Homo sapiens; identical to SEQ ID NO: 194140
  misc_feature: GYAE6OF02HET9M.51.29.C07.1.454.CMB.1.raw
  modified_base (118)..(118): a, c, t, g, unknown or other
  misc_feature (118)..(118): n is a, c, g, or t

SEQ ID NO: 195084 - DNA, 124 bp, Homo sapiens
  misc_feature: GYAE6OF02HVPH6.51.29.C07.1.454.CMB.1.raw
  modified_base (117)..(124): a, c, t, g, unknown or other
  misc_feature (117)..(124): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnn

SEQ ID NO: 195085 - DNA, 117 bp, Homo sapiens
  misc_feature: GYAE6OF02ID2DK.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctcctctcgtagcacctgagcgggctggcaaggcgcatagn

SEQ ID NO: 195086 - DNA, 118 bp, Homo sapiens; identical to SEQ ID NO: 194140
  misc_feature: GYAE6OF02INGU9.51.29.C07.1.454.CMB.1.raw
  modified_base (118)..(118): a, c, t, g, unknown or other
  misc_feature (118)..(118): n is a, c, g, or t

SEQ ID NO: 195087 - DNA, 117 bp, Homo sapiens; identical to SEQ ID NO: 194173
  misc_feature: GYAE6OF02GFHEU.51.29.C07.1.454.CMB.1.raw
  modified_base (117)..(117): a, c, t, g, unknown or other
  misc_feature (117)..(117): n is a, c, g, or t

SEQ ID NO: 195088 - DNA, 119 bp, Homo sapiens; identical to SEQ ID NO: 195001
  misc_feature: GYAE6OF02JF9E6.51.29.C07.1.454.CMB.1.raw
  modified_base (117)..(119): a, c, t, g, unknown or other
  misc_feature (117)..(119): n is a, c, g, or t

SEQ ID NO: 195089 - DNA, 117 bp, Homo sapiens; identical to SEQ ID NO: 194123
  misc_feature: GYAE6OF02FOP6J.51.29.C07.1.454.CMB.1.raw
  modified_base (117)..(117): a, c, t, g, unknown or other
  misc_feature (117)..(117): n is a, c, g, or t

SEQ ID NO: 195090 - DNA, 118 bp, Homo sapiens; identical to SEQ ID NO: 194139
  misc_feature: GYAE6OF02HPDOW.51.29.C07.1.454.CMB.1.raw
  modified_base (118)..(118): a, c, t, g, unknown or other
  misc_feature (118)..(118): n is a, c, g, or t

SEQ ID NO: 195091 - DNA, 120 bp, Homo sapiens
  misc_feature: GYAE6OF02FTDU7.51.29.C07.1.454.CMB.1.raw
  modified_base (116)..(120): a, c, t, g, unknown or other
  misc_feature (116)..(120): n is a, c, g, or t
tcagcgatcgtatacacgaccggtgctcgatttagagtgctacgaagggaaggcagcgtcactctgttcccgccctcctctcgtagcactctgagcgggctggcaaggcgcatagnnnnn

SEQ ID NO: 195092 - DNA, 122 bp, Homo sapiens; identical to SEQ ID NO: 194353
  misc_feature: GYAE6OF02HN7QJ.51.29.C07.1.454.CMB.1.raw
  modified_base (119)..(122): a, c, t, g, unknown or other
  misc_feature (119)..(122): n is a, c, g, or t

SEQ ID NO: 195093 - DNA, 118 bp, Homo sapiens; identical to SEQ ID NO: 194139
  misc_feature: GYAE6OF02IVIND.51.29.C07.1.454.CMB.1.raw
  modified_base (118)..(118): a, c, t, g, unknown or other
  misc_feature (118)..(118): n is a, c, g, or t

SEQ ID NO: 195094 - DNA, 119 bp, Homo sapiens; identical to SEQ ID NO: 194137
  misc_feature: GYAE6OF02G2QJ5.51.29.C07.1.454.CMB.1.raw
  modified_base (118)..(119): a, c, t, g, unknown or other
  misc_feature (118)..(119): n is a, c, g, or t

SEQ ID NO: 195095 - DNA, 119 bp, Homo sapiens; identical to SEQ ID NO: 194137
  misc_feature: GYAE6OF02JCM4O.51.29.C07.1.454.CMB.1.raw
  modified_base (118)..(119): a, c, t, g, unknown or other
  misc_feature (118)..(119): n is a, c, g, or t

SEQ ID NO: 195096 - DNA, 116 bp, Homo sapiens; identical to SEQ ID NO: 194127
  misc_feature: GYAE6OF02GD26D.51.29.C07.1.454.CMB.1.raw
  modified_base (116)..(116): a, c, t, g, unknown or other
  misc_feature (116)..(116): n is a, c, g, or t

SEQ ID NO: 195097 - DNA, 117 bp, Homo sapiens; identical to SEQ ID NO: 194206
  misc_feature: GYAE6OF02F6I8E.51.29.C07.1.454.CMB.1.raw

SEQ ID NO: 195098 - DNA, 160 bp, Homo sapiens
  misc_feature: GYAE6OF02GJ6M5.51.29.C07.1.454.CMB.1.raw
  modified_base (158)..(160): a, c, t, g, unknown or other
  misc_feature (158)..(160): n is a, c, g, or t
tcagcgatcgtatacacgaccggtgctcgatttagagtgctacgaagggaaagggcacgaccggtgctcgatttagagtgctacgaagggaaaggcagcgtcactctgttcccaccctcctctcgtagcactctgagcgggctggcaaggcgcatagnnn

SEQ ID NO: 195099 - DNA, 120 bp, Homo sapiens; identical to SEQ ID NO: 194365
  misc_feature: GYAE6OF02H6VWI.51.29.C07.1.454.CMB.1.raw
  modified_base (118)..(120): a, c, t, g, unknown or other
  misc_feature (118)..(120): n is a, c, g, or t

SEQ ID NO: 195100 - DNA, 121 bp, Homo sapiens
  misc_feature: GYAE6OF02HGQ86.51.29.C07.1.454.CMB.1.raw
  modified_base (117)..(121): a, c, t, g, unknown or other
  misc_feature (117)..(121): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnn

SEQ ID NO: 195101 - DNA, 117 bp, Homo sapiens; identical to SEQ ID NO: 194173
  misc_feature: GYAE6OF02HT96V.51.29.C07.1.454.CMB.1.raw
  modified_base (117)..(117): a, c, t, g, unknown or other
  misc_feature (117)..(117): n is a, c, g, or t

SEQ ID NO: 195102 - DNA, 118 bp, Homo sapiens; identical to SEQ ID NO: 194140
  misc_feature: GYAE6OF02G0DTE.51.29.C07.1.454.CMB.1.raw
  modified_base (118)..(118): a, c, t, g, unknown or other
  misc_feature (118)..(118): n is a, c, g, or t

SEQ ID NO: 195103 - DNA, 118 bp, Homo sapiens; identical to SEQ ID NO: 194139
  misc_feature: GYAE6OF02HOYJI.51.29.C07.1.454.CMB.1.raw
  modified_base (118)..(118): a, c, t, g, unknown or other
  misc_feature (118)..(118): n is a, c, g, or t

SEQ ID NO: 195104 - DNA, 117 bp, Homo sapiens; identical to SEQ ID NO: 194147
  misc_feature: GYAE6OF02IEVKM.51.29.C07.1.454.CMB.1.raw

SEQ ID NO: 195105 - DNA, 132 bp, Homo sapiens
  misc_feature: GYAE6OF02FNG8U.51.29.C07.1.454.CMB.1.raw
  modified_base (119)..(132): a, c, t, g, unknown or other
  misc_feature (119)..(132): n is a, c, g, or t
tcagcgatcgtatacacgaccggtgctcgatttagagtgctacgaagggaaagggcagcgtcaactctgttcccgccctcctctcgtagcactctgagcgggctggcaaggcgcatagnnnnnnnnnnnnnn

SEQ ID NO: 195106 - DNA, 118 bp, Homo sapiens; identical to SEQ ID NO: 194140
  misc_feature: GYAE6OF02FQTU4.51.29.C07.1.454.CMB.1.raw
  modified_base (118)..(118): a, c, t, g, unknown or other
  misc_feature (118)..(118): n is a, c, g, or t

SEQ ID NO: 195107 - DNA, 142 bp, Homo sapiens
  misc_feature: GYAE6OF02FNCV4.51.29.C07.1.454.CMB.1.raw
  modified_base (119)..(142): a, c, t, g, unknown or other
  misc_feature (119)..(142): n is a, c, g, or t
tcagcgatcgtatacacgaccggtgctcgatttagagtgctacgaagggtaagggcgagcgtcactctgttcccgccctcctctcgtagcactctgagcgggctggcaaggcgcatagnnnnnnnnnnnnnnnnnnnnnnnn

SEQ ID NO: 195108 - DNA, 117 bp, Homo sapiens
  misc_feature: GYAE6OF02HTF5X.51.29.C07.1.454.CMB.1.raw
tcagcgatcgtatacacgaccggtgctcgatttagagtgctacgaagggaaaggtcagcgtcactctgttcccgccctcctctcgtagcactctgagcgggctggcaaggcgcatag

SEQ ID NO: 195109 - DNA, 117 bp, Homo sapiens; identical to SEQ ID NO: 194206
  misc_feature: GYAE6OF02HRN8T.51.29.C07.1.454.CMB.1.raw

SEQ ID NO: 195110 - DNA, 119 bp, Homo sapiens; identical to SEQ ID NO: 194160
  misc_feature: GYAE6OF02HR0W7.51.29.C07.1.454.CMB.1.raw
  modified_base (118)..(119): a, c, t, g, unknown or other
  misc_feature (118)..(119): n is a, c, g, or t

SEQ ID NO: 195111 - DNA, 118 bp, Homo sapiens
  misc_feature: GYAE6OF02JNRF6.51.29.C07.1.454.CMB.1.raw
  modified_base (113)..(118): a, c, t, g, unknown or other
  misc_feature (113)..(118): n is a, c, g, or t
tcagcgatcgtatacacgaccggtgctcgatttagagtgctacgaaggaaggcagcgtcactctgttcccacctcctctcgtagcactctgagcggctggcaaggcgcatagnnnnnn

SEQ ID NO: 195112 - DNA, 117 bp, Homo sapiens; identical to SEQ ID NO: 194206
  misc_feature: GYAE6OF02GCOSQ.51.29.C07.1.454.CMB.1.raw

SEQ ID NO: 195113 - DNA, 123 bp, Homo sapiens; identical to SEQ ID NO: 194390
  misc_feature: GYAE6OF02GJ9YL.51.29.C07.1.454.CMB.1.raw
  modified_base (118)..(123): a, c, t, g, unknown or other
  misc_feature (118)..(123): n is a, c, g, or t

SEQ ID NO: 195114 - DNA, 126 bp, Homo sapiens
  misc_feature: GYAE6OF02F3PXV.51.29.C07.1.454.CMB.1.raw
  modified_base (118)..(126): a, c, t, g, unknown or other
  misc_feature (118)..(126): n is a, c, g, or t
tcagcgatcgtatacacgaccggtgctcgatttagagtgctacgaagggaaagggcagcgtcactctgttcccaccctctctcgtagcactcctgagcgggctggcaaggcgcatagnnnnnnnnn

SEQ ID NO: 195115 - DNA, 116 bp, Homo sapiens
  misc_feature: GYAE6OF02GKR1T.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaagggaaagggcagcgtcactctgttcccacccctctcgtagcactctgagcgggctggcaaggcgcatagn

SEQ ID NO: 195116 - DNA, 118 bp, Homo sapiens; identical to SEQ ID NO: 194139
  misc_feature: GYAE6OF02GX09X.51.29.C07.1.454.CMB.1.raw
  modified_base (118)..(118): a, c, t, g, unknown or other
  misc_feature (118)..(118): n is a, c, g, or t

SEQ ID NO: 195117 - DNA, 126 bp, Homo sapiens
  misc_feature: GYAE6OF02IOL67.51.29.C07.1.454.CMB.1.raw
  modified_base (118)..(126): a, c, t, g, unknown or other
  misc_feature (118)..(126): n is a, c, g, or t
tcagcgatcgtatacacgaccggtgctcgatttagagtgctacgaagggaaagggcgagcgtcactctgttcccacctcctctcgtagcactctgagcgggctggcaaggcgcatagnnnnnnnnn

SEQ ID NO: 195118 - DNA, 118 bp, Homo sapiens; identical to SEQ ID NO: 194139
  misc_feature: GYAE6OF02IC005.51.29.C07.1.454.CMB.1.raw
  modified_base (118)..(118): a, c, t, g, unknown or other
  misc_feature (118)..(118): n is a, c, g, or t

SEQ ID NO: 195119 - DNA, 118 bp, Homo sapiens; identical to SEQ ID NO: 194140
  misc_feature: GYAE6OF02IP8MO.51.29.C07.1.454.CMB.1.raw
  modified_base (118)..(118): a, c, t, g, unknown or other
  misc_feature (118)..(118): n is a, c, g, or t

SEQ ID NO: 195120 - DNA, 117 bp, Homo sapiens; identical to SEQ ID NO: 194947
  misc_feature: GYAE6OF02ITIUH.51.29.C07.1.454.CMB.1.raw
  modified_base (117)..(117): a, c, t, g, unknown or other
  misc_feature (117)..(117): n is a, c, g, or t

SEQ ID NO: 195121 - DNA, 124 bp, Homo sapiens
  misc_feature: GYAE6OF02IKTC4.51.29.C07.1.454.CMB.1.raw
  modified_base (116)..(124): a, c, t, g, unknown or other
  misc_feature (116)..(124): n is a, c, g, or t
tcagcgatcgtatacacgaccggtgctcgatttagagtgctacgaagggaaagggcagcgtcactctgttccacctcctctcgtagcactctgagcgggctggcaaggcgcatagnnnnnnnnn

SEQ ID NO: 195122 - DNA, 118 bp, Homo sapiens; identical to SEQ ID NO: 194140
  misc_feature: GYAE6OF02G7BDK.51.29.C07.1.454.CMB.1.raw
  modified_base (118)..(118): a, c, t, g, unknown or other
  misc_feature (118)..(118): n is a, c, g, or t

SEQ ID NO: 195123 - DNA, 116 bp, Homo sapiens
  misc_feature: GYAE6OF02FNOJ4.51.29.C07.1.454.CMB.1.raw
  modified_base (115)..(116): a, c, t, g, unknown or other
  misc_feature (115)..(116): n is a, c, g, or t
tcagcgatcgtatacacgaccggtgctcgatttagagtgctacgaagggaaggcagcgtcactctgttcccgccctcctctcgtagcactctgagcggctggcaaggcgcatagnn

SEQ ID NO: 195124 - DNA, 115 bp, Homo sapiens
  misc_feature: GYAE6OF02F8ZKA.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaagggcagcgtcactctgttccccctcctctcgtagcactctgagcgggctggcaaggcgcatagn

SEQ ID NO: 195125 - DNA, 118 bp, Homo sapiens
  misc_feature: GYAE6OF02I9HVC.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccgccctcctctcgtagtactctgagcgggctggcaaggcgcatagn

SEQ ID NO: 195126 - DNA, 116 bp, Homo sapiens; identical to SEQ ID NO: 194201
  misc_feature: GYAE6OF02HIT5X.51.29.C07.1.454.CMB.1.raw

SEQ ID NO: 195127 - DNA, 118 bp, Homo sapiens; identical to SEQ ID NO: 194139
  misc_feature: GYAE6OF02IM5UG.51.29.C07.1.454.CMB.1.raw
  modified_base (118)..(118): a, c, t, g, unknown or other
  misc_feature (118)..(118): n is a, c, g, or t

SEQ ID NO: 195128 - DNA, 118 bp, Homo sapiens; identical to SEQ ID NO: 194140
  misc_feature: GYAE6OF02HJYMR.51.29.C07.1.454.CMB.1.raw
  modified_base (118)..(118): a, c, t, g, unknown or other
  misc_feature (118)..(118): n is a, c, g, or t

SEQ ID NO: 195129 - DNA, 138 bp, Homo sapiens
  misc_feature: GYAE6OF02G9KS3.51.29.C07.1.454.CMB.1.raw
  modified_base (116)..(138): a, c, t, g, unknown or other
  misc_feature (116)..(138): n is a, c, g, or t
tcagcgatcgtatacacgaccggtgctcgatttagagtgctacgaagggaaagggcagcgtcactctgttcccacctctctcgtagcactctgagcgggctggcaaggcgcatagnnnnnnnnnnnnnnnnnnnnnnn

SEQ ID NO: 195130 - DNA, 117 bp, Homo sapiens; identical to SEQ ID NO: 194206
  misc_feature: GYAE6OF02IDTE5.51.29.C07.1.454.CMB.1.raw

SEQ ID NO: 195131 - DNA, 117 bp, Homo sapiens; identical to SEQ ID NO: 194173
  misc_feature: GYAE6OF02GPWFU.51.29.C07.1.454.CMB.1.raw
  modified_base (117)..(117): a, c, t, g, unknown or other
  misc_feature (117)..(117): n is a, c, g, or t

SEQ ID NO: 195132 - DNA, 118 bp, Homo sapiens; identical to SEQ ID NO: 194139
  misc_feature: GYAE6OF02GHQN1.51.29.C07.1.454.CMB.1.raw
  modified_base (118)..(118): a, c, t, g, unknown or other
  misc_feature (118)..(118): n is a, c, g, or t

SEQ ID NO: 195133 - DNA, 118 bp, Homo sapiens; identical to SEQ ID NO: 194139
  misc_feature: GYAE6OF02JCEY6.51.29.C07.1.454.CMB.1.raw
  modified_base (118)..(118): a, c, t, g, unknown or other
  misc_feature (118)..(118): n is a, c, g, or t

SEQ ID NO: 195134 - DNA, 118 bp, Homo sapiens; identical to SEQ ID NO: 194139
  misc_feature: GYAE6OF02HCJK9.51.29.C07.1.454.CMB.1.raw
  modified_base (118)..(118): a, c, t, g, unknown or other
  misc_feature (118)..(118): n is a, c, g, or t

SEQ ID NO: 195135 - DNA, 117 bp, Homo sapiens
  misc_feature: GYAE6OF02I2NAB.51.29.C07.1.454.CMB.1.raw
tcagcgatcgtatacacgaccggtgctcgatttagagtgctacgaagggaaagggcagcgtaactctgttcccaccctcctctcgtagcactctgagcgggctggcaaggcgcatag

SEQ ID NO: 195136 - DNA, 118 bp, Homo sapiens; identical to SEQ ID NO: 194140
  misc_feature: GYAE6OF02GI2Q7.51.29.C07.1.454.CMB.1.raw
  modified_base (118)..(118): a, c, t, g, unknown or other
  misc_feature (118)..(118): n is a, c, g, or t

SEQ ID NO: 195137 - DNA, 118 bp, Homo sapiens; identical to SEQ ID NO: 194140
  misc_feature: GYAE6OF02HH299.51.29.C07.1.454.CMB.1.raw
  modified_base (118)..(118): a, c, t, g, unknown or other
  misc_feature (118)..(118): n is a, c, g, or t

SEQ ID NO: 195138 - DNA, 118 bp, Homo sapiens; identical to SEQ ID NO: 194139
  misc_feature: GYAE6OF02HBAJU.51.29.C07.1.454.CMB.1.raw
  modified_base (118)..(118): a, c, t, g, unknown or other
  misc_feature (118)..(118): n is a, c, g, or t

SEQ ID NO: 195139 - DNA, 118 bp, Homo sapiens; identical to SEQ ID NO: 194140
  misc_feature: GYAE6OF02F9NDS.51.29.C07.1.454.CMB.1.raw
  modified_base (118)..(118): a, c, t, g, unknown or other
  misc_feature (118)..(118): n is a, c, g, or t

SEQ ID NO: 195140 - DNA, 119 bp, Homo sapiens; identical to SEQ ID NO: 194160
  misc_feature: GYAE6OF02HZMSW.51.29.C07.1.454.CMB.1.raw
  modified_base (118)..(119): a, c, t, g, unknown or other
  misc_feature (118)..(119): n is a, c, g, or t

SEQ ID NO: 195141 - DNA, 118 bp, Homo sapiens; identical to SEQ ID NO: 194139
  misc_feature: GYAE6OF02IZUJD.51.29.C07.1.454.CMB.1.raw
  modified_base (118)..(118): a, c, t, g, unknown or other
  misc_feature (118)..(118): n is a, c, g, or t

SEQ ID NO: 195142 - DNA, 118 bp, Homo sapiens; identical to SEQ ID NO: 194140
  misc_feature: GYAE6OF02HA700.51.29.C07.1.454.CMB.1.raw
  modified_base (118)..(118): a, c, t, g, unknown or other
  misc_feature (118)..(118): n is a, c, g, or t

SEQ ID NO: 195143 - DNA, 118 bp, Homo sapiens; identical to SEQ ID NO: 194140
  misc_feature: GYAE6OF02HJ4U2.51.29.C07.1.454.CMB.1.raw
  modified_base (118)..(118): a, c, t, g, unknown or other
  misc_feature (118)..(118): n is a, c, g, or t

SEQ ID NO: 195144 - DNA, 118 bp, Homo sapiens; identical to SEQ ID NO: 194140
  misc_feature: GYAE6OF02ICTAX.51.29.C07.1.454.CMB.1.raw
  modified_base (118)..(118): a, c, t, g, unknown or other
  misc_feature (118)..(118): n is a, c, g, or t

SEQ ID NO: 195145 - DNA, 117 bp, Homo sapiens; identical to SEQ ID NO: 194360
  misc_feature: GYAE6OF02JHWS1.51.29.C07.1.454.CMB.1.raw
  modified_base (116)..(117): a, c, t, g, unknown or other
  misc_feature (116)..(117): n is a, c, g, or t

SEQ ID NO: 195146 - DNA, 118 bp, Homo sapiens; identical to SEQ ID NO: 194140
  misc_feature: GYAE6OF02H238F.51.29.C07.1.454.CMB.1.raw
  modified_base (118)..(118): a, c, t, g, unknown or other
  misc_feature (118)..(118): n is a, c, g, or t

SEQ ID NO: 195147 - DNA, 133 bp, Homo sapiens
  misc_feature: GYAE6OF02IZ9YJ.51.29.C07.1.454.CMB.1.raw
  modified_base (117)..(133): a, c, t, g, unknown or other
  misc_feature (117)..(133): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnnnnnnnnnnn

SEQ ID NO: 195148 - DNA, 118 bp, Homo sapiens; identical to SEQ ID NO: 194140
  misc_feature: GYAE6OF02HRFQE.51.29.C07.1.454.CMB.1.raw
  modified_base (118)..(118): a, c, t, g, unknown or other
  misc_feature (118)..(118): n is a, c, g, or t

SEQ ID NO: 195149 - DNA, 117 bp, Homo sapiens; identical to SEQ ID NO: 194123
  misc_feature: GYAE6OF02GJE7L.51.29.C07.1.454.CMB.1.raw
  modified_base (117)..(117): a, c, t, g, unknown or other
  misc_feature (117)..(117): n is a, c, g, or t

SEQ ID NO: 195150 - DNA, 118 bp, Homo sapiens; identical to SEQ ID NO: 194140
  misc_feature: GYAE6OF02ICNXM.51.29.C07.1.454.CMB.1.raw
  modified_base (118)..(118): a, c, t, g, unknown or other
  misc_feature (118)..(118): n is a, c, g, or t

SEQ ID NO: 195151 - DNA, 147 bp, Homo sapiens
  misc_feature: GYAE6OF02FJHBU.51.29.C07.1.454.CMB.1.raw
  modified_base (119)..(147): a, c, t, g, unknown or other
  misc_feature (119)..(147): n is a, c, g, or t
tcagcgatcgtatacacgaccggtgctcgatttagagtgctacgaagggaagggcgagcgtcactctgttcccgccctcctctcgtagtcactctgagcgggctggcaaggcgcatagnnnnnnnnnnnnnnnnnnnnnnnnnnnnn

SEQ ID NO: 195152 - DNA, 128 bp, Homo sapiens
  misc_feature: GYAE6OF02JWZE7.51.29.C07.1.454.CMB.1.raw
  modified_base (111)..(128): a, c, t, g, unknown or other
  misc_feature (111)..(128): n is a, c, g, or t
tcagcgatcgtatacacgaccggtgctcgatttagagtgctacgaaggaaggcagcgtcactctgttccacctctctcgtagcactctgagcggctggcaaggcgcatagnnnnnnnnnnnnnnnnnn

SEQ ID NO: 195153 - DNA, 144 bp, Homo sapiens
  misc_feature: GYAE6OF02IDXZS.51.29.C07.1.454.CMB.1.raw
  modified_base (116)..(143): a, c, t, g, unknown or other
  misc_feature (116)..(143): n is a, c, g, or t
tcagcgatcgtatacacgaccggtgctcgatttagagtgctacgaagggaagggcagcgtcactctgttcccacctcctctcgtagcactctgagcgggctggcaaggcgcatagnnnnnnnnnnnnnnnnnnnnnnnnnnnng

SEQ ID NO: 195154 - DNA, 117 bp, Homo sapiens; identical to SEQ ID NO: 194123
  misc_feature: GYAE6OF02GEZ33.51.29.C07.1.454.CMB.1.raw
  modified_base (117)..(117): a, c, t, g, unknown or other
  misc_feature (117)..(117): n is a, c, g, or t

SEQ ID NO: 195155 - DNA, 153 bp, Homo sapiens
  misc_feature: GYAE6OF02GLSU1.51.29.C07.1.454.CMB.1.raw
  modified_base (121)..(153): a, c, t, g, unknown or other
  misc_feature (121)..(153): n is a, c, g, or t
tcagcgatcgtatacacgaccggtgctcgatttagagtgctacgaagggaaagggcgagcgtcaactctgttcccaccctcctctccgtagcactctgagcgggctggcaaggcgcatagnnnnnnnnnnnnnnnnnnnnnnnnnnnnnnnnn

SEQ ID NO: 195156 - DNA, 118 bp, Homo sapiens; identical to SEQ ID NO: 194139
  misc_feature: GYAE6OF02F53O1.51.29.C07.1.454.CMB.1.raw
  modified_base (118)..(118): a, c, t, g, unknown or other
  misc_feature (118)..(118): n is a, c, g, or t

SEQ ID NO: 195157 - DNA, 118 bp, Homo sapiens; identical to SEQ ID NO: 194140
  misc_feature: GYAE6OF02HYPMJ.51.29.C07.1.454.CMB.1.raw
  modified_base (118)..(118): a, c, t, g, unknown or other
  misc_feature (118)..(118): n is a, c, g, or t

SEQ ID NO: 195158 - DNA, 118 bp, Homo sapiens; identical to SEQ ID NO: 194139
  misc_feature: GYAE6OF02HSWUO.51.29.C07.1.454.CMB.1.raw
  modified_base (118)..(118): a, c, t, g, unknown or other
  misc_feature (118)..(118): n is a, c, g, or t

SEQ ID NO: 195159 - DNA, 119 bp, Homo sapiens; identical to SEQ ID NO: 195001
  misc_feature: GYAE6OF02F690V.51.29.C07.1.454.CMB.1.raw
  modified_base (117)..(119): a, c, t, g, unknown or other
  misc_feature (117)..(119): n is a, c, g, or t

SEQ ID NO: 195160 - DNA, 118 bp, Homo sapiens; identical to SEQ ID NO: 194140
  misc_feature: GYAE6OF02I510E.51.29.C07.1.454.CMB.1.raw
  modified_base (118)..(118): a, c, t, g, unknown or other
  misc_feature (118)..(118): n is a, c, g, or t

SEQ ID NO: 195161 - DNA, 136 bp, Homo sapiens
  misc_feature: GYAE6OF02HGRUN.51.29.C07.1.454.CMB.1.raw
  modified_base (119)..(136): a, c, t, g, unknown or other
  misc_feature (119)..(136): n is a, c, g, or t
tcagcgatcgtatacacgaccggtgctcgatttagagtgctacgaagggaaagggcagcgtcactctgttcccgccctcctctcgtagcactctgagcgggctggcaaggcgcactagnnnnnnnnnnnnnnnnnn

SEQ ID NO: 195162 - DNA, 161 bp, Homo sapiens; identical to SEQ ID NO: 194549
  misc_feature: GYAE6OF02JI5UZ.51.29.C07.1.454.CMB.1.raw
  modified_base (159)..(161): a, c, t, g, unknown or other
  misc_feature (159)..(161): n is a, c, g, or t

SEQ ID NO: 195163 - DNA, 117 bp, Homo sapiens; identical to SEQ ID NO: 194123
  misc_feature: GYAE6OF02F7AES.51.29.C07.1.454.CMB.1.raw
  modified_base (117)..(117): a, c, t, g, unknown or other
  misc_feature (117)..(117): n is a, c, g, or t

SEQ ID NO: 195164 - DNA, 117 bp, Homo sapiens; identical to SEQ ID NO: 194173
  misc_feature: GYAE6OF02F2BEZ.51.29.C07.1.454.CMB.1.raw
  modified_base (117)..(117): a, c, t, g, unknown or other
  misc_feature (117)..(117): n is a, c, g, or t

SEQ ID NO: 195165 - DNA, 153 bp, Homo sapiens
  misc_feature: GYAE6OF02I3IEV.51.29.C07.1.454.CMB.1.raw
  modified_base (121)..(153): a, c, t, g, unknown or other
  misc_feature (121)..(153): n is a, c, g, or t
tcagcgatcgtatacacgaccggtgctcgatttagagtgctacgaagggaaagggcgagcgtcactctgttcccaccctcctctcgtagcactctgagccgggctggcaaggcgcatacgnnnnnnnnnnnnnnnnnnnnnnnnnnnnnnnnn

SEQ ID NO: 195166 - DNA, 118 bp, Homo sapiens; identical to SEQ ID NO: 194139
  misc_feature: GYAE6OF02IHGQ5.51.29.C07.1.454.CMB.1.raw
  modified_base (118)..(118): a, c, t, g, unknown or other
  misc_feature (118)..(118): n is a, c, g, or t

SEQ ID NO: 195167 - DNA, 122 bp, Homo sapiens; identical to SEQ ID NO: 194631
  misc_feature: GYAE6OF02H1MRL.51.29.C07.1.454.CMB.1.raw
  modified_base (118)..(122): a, c, t, g, unknown or other
  misc_feature (118)..(122): n is a, c, g, or t

SEQ ID NO: 195168 - DNA, 118 bp, Homo sapiens; identical to SEQ ID NO: 194139
  misc_feature: GYAE6OF02HFUYQ.51.29.C07.1.454.CMB.1.raw
  modified_base (118)..(118): a, c, t, g, unknown or other
  misc_feature (118)..(118): n is a, c, g, or t

SEQ ID NO: 195169 - DNA, 116 bp, Homo sapiens; identical to SEQ ID NO: 194617
  misc_feature: GYAE6OF02IULBI.51.29.C07.1.454.CMB.1.raw

SEQ ID NO: 195170 - DNA, 117 bp, Homo sapiens; identical to SEQ ID NO: 194147
  misc_feature: GYAE6OF02FWYQH.51.29.C07.1.454.CMB.1.raw

SEQ ID NO: 195171 - DNA, 117 bp, Homo sapiens; identical to SEQ ID NO: 194206
  misc_feature: GYAE6OF02IQ2W4.51.29.C07.1.454.CMB.1.raw

SEQ ID NO: 195172 - DNA, 123 bp, Homo sapiens
  misc_feature: GYAE6OF02FQLE0.51.29.C07.1.454.CMB.1.raw
  modified_base (80)..(80): a, c, t, g, unknown or other
  misc_feature (80)..(80): n is a, c, g, or t
  modified_base (109)..(109): a, c, t, g, unknown or other
  misc_feature (109)..(109): n is a, c, g, or t
  modified_base (115)..(123): a, c, t, g, unknown or other
  misc_feature (115)..(123): n is a, c, g, or t
tcagcgatcgtatacacgaccggtgctcgatttagagtgctacgaagggtaagggcagcgtcactctgttcccgcctctntcgtagcactctgagcggctggcaaggcncatagnnnnnnnnn

SEQ ID NO: 195173 - DNA, 121 bp, Homo sapiens; identical to SEQ ID NO: 194352
  misc_feature: GYAE6OF02GP85H.51.29.C07.1.454.CMB.1.raw
  modified_base (118)..(121): a, c, t, g, unknown or other
  misc_feature (118)..(121): n is a, c, g, or t

SEQ ID NO: 195174 - DNA, 118 bp, Homo sapiens; identical to SEQ ID NO: 194140
  misc_feature: GYAE6OF02GC1F9.51.29.C07.1.454.CMB.1.raw
  modified_base (118)..(118): a, c, t, g, unknown or other
  misc_feature (118)..(118): n is a, c, g, or t

SEQ ID NO: 195175 - DNA, 119 bp, Homo sapiens; identical to SEQ ID NO: 194160
  misc_feature: GYAE6OF02HLEKF.51.29.C07.1.454.CMB.1.raw
  modified_base (118)..(119): a, c, t, g, unknown or other
  misc_feature (118)..(119): n is a, c, g, or t

SEQ ID NO: 195176 - DNA, 119 bp, Homo sapiens
  misc_feature: GYAE6OF02GH7ZP.51.29.C07.1.454.CMB.1.raw
  modified_base (119)..(119): a, c, t, g, unknown or other
  misc_feature (119)..(119): n is a, c, g, or t
tcagcgatcgtatacacgaccggtgctcgatttagagtgctacgaagggaaagggcagcgtcactctgttcccaccctcctctcgtagcacttctgagcgggctggcaaggcgcatagn

SEQ ID NO: 195177 - DNA, 118 bp, Homo sapiens; identical to SEQ ID NO: 194140
  misc_feature: GYAE6OF02HEN3P.51.29.C07.1.454.CMB.1.raw
  modified_base (118)..(118): a, c, t, g, unknown or other
  misc_feature (118)..(118): n is a, c, g, or t

SEQ ID NO: 195178 - DNA, 119 bp, Homo sapiens; identical to SEQ ID NO: 194160
  misc_feature: GYAE6OF02IK3T5.51.29.C07.1.454.CMB.1.raw
  modified_base (118)..(119): a, c, t, g, unknown or other
  misc_feature (118)..(119): n is a, c, g, or t

SEQ ID NO: 195179 - DNA, 114 bp, Homo sapiens; identical to SEQ ID NO: 194234
  misc_feature: GYAE6OF02FE7NF.51.29.C07.1.454.CMB.1.raw

SEQ ID NO: 195180 - DNA, 118 bp, Homo sapiens; identical to SEQ ID NO: 194140
  misc_feature: GYAE6OF02HKN1F.51.29.C07.1.454.CMB.1.raw
  modified_base (118)..(118): a, c, t, g, unknown or other
  misc_feature (118)..(118): n is a, c, g, or t

SEQ ID NO: 195181 - DNA, 118 bp, Homo sapiens; identical to SEQ ID NO: 194139
  misc_feature: GYAE6OF02F6H4H.51.29.C07.1.454.CMB.1.raw
  modified_base (118)..(118): a, c, t, g, unknown or other
  misc_feature (118)..(118): n is a, c, g, or t

SEQ ID NO: 195182 - DNA, 118 bp, Homo sapiens; identical to SEQ ID NO: 194139
  misc_feature: GYAE6OF02GBHUJ.51.29.C07.1.454.CMB.1.raw
  modified_base (118)..(118): a, c, t, g, unknown or other
  misc_feature (118)..(118): n is a, c, g, or t

SEQ ID NO: 195183 - DNA, 118 bp, Homo sapiens; identical to SEQ ID NO: 194139
  misc_feature: GYAE6OF02GI5I1.51.29.C07.1.454.CMB.1.raw
  modified_base (118)..(118): a, c, t, g, unknown or other
  misc_feature (118)..(118): n is a, c, g, or t

SEQ ID NO: 195184 - DNA, 118 bp, Homo sapiens; identical to SEQ ID NO: 194140
  misc_feature: GYAE6OF02IPA74.51.29.C07.1.454.CMB.1.raw
  modified_base (118)..(118): a, c, t, g, unknown or other
  misc_feature (118)..(118): n is a, c, g, or t

SEQ ID NO: 195185 - DNA, 173 bp, Homo sapiens
  misc_feature: GYAE6OF02I8WBC.51.29.C07.1.454.CMB.1.raw
  modified_base (121)..(173): a, c, t, g, unknown or other
  misc_feature (121)..(173): n is a, c, g, or t
tcagcgatcgtatacacgaccggtgctcgatttagagtgctacgaagggaaagggcagcgtcactctgttcccgccctcctctcgtagcactcctggagcgggctggcaaaggcgcatagnnnnnnnnnnnnnnnnnnnnnnnnnnnnnnnnnnnnnnnnnnnnnnnnnnnnn

SEQ ID NO: 195186 - DNA, 118 bp, Homo sapiens; identical to SEQ ID NO: 194139
  misc_feature: GYAE6OF02HSPKY.51.29.C07.1.454.CMB.1.raw
  modified_base (118)..(118): a, c, t, g, unknown or other
  misc_feature (118)..(118): n is a, c, g, or t

SEQ ID NO: 195187 - DNA, 117 bp, Homo sapiens; identical to SEQ ID NO: 194206
  misc_feature: GYAE6OF02IU6JX.51.29.C07.1.454.CMB.1.raw

SEQ ID NO: 195188 - DNA, 123 bp, Homo sapiens; identical to SEQ ID NO: 194393
  misc_feature: GYAE6OF02JIGJR.51.29.C07.1.454.CMB.1.raw
  modified_base (118)..(123): a, c, t, g, unknown or other
  misc_feature (118)..(123): n is a, c, g, or t

SEQ ID NO: 195189 - DNA, 118 bp, Homo sapiens; identical to SEQ ID NO: 194140
  misc_feature: GYAE6OF02H8CQI.51.29.C07.1.454.CMB.1.raw
  modified_base (118)..(118): a, c, t, g, unknown or other
  misc_feature (118)..(118): n is a, c, g, or t

SEQ ID NO: 195190 - DNA, 120 bp, Homo sapiens; identical to SEQ ID NO: 194365
  misc_feature: GYAE6OF02GHYHG.51.29.C07.1.454.CMB.1.raw
  modified_base (118)..(120): a, c, t, g, unknown or other
  misc_feature (118)..(120): n is a, c, g, or t

SEQ ID NO: 195191 - DNA, 117 bp, Homo sapiens; identical to SEQ ID NO: 194123
  misc_feature: GYAE6OF02FG0XB.51.29.C07.1.454.CMB.1.raw
  modified_base (117)..(117): a, c, t, g, unknown or other
  misc_feature (117)..(117): n is a, c, g, or t

SEQ ID NO: 195192 - DNA, 118 bp, Homo sapiens; identical to SEQ ID NO: 194139
  misc_feature: GYAE6OF02G71NO.51.29.C07.1.454.CMB.1.raw
  modified_base (118)..(118): a, c, t, g, unknown or other
  misc_feature (118)..(118): n is a, c, g, or t

SEQ ID NO: 195193 - DNA, 118 bp, Homo sapiens; identical to SEQ ID NO: 194139
  misc_feature: GYAE6OF02HGRYR.51.29.C07.1.454.CMB.1.raw
  modified_base (118)..(118): a, c, t, g, unknown or other
  misc_feature (118)..(118): n is a, c, g, or t

SEQ ID NO: 195194 - DNA, 118 bp, Homo sapiens; identical to SEQ ID NO: 194139
  misc_feature: GYAE6OF02IOCNF.51.29.C07.1.454.CMB.1.raw
  modified_base (118)..(118): a, c, t, g, unknown or other
  misc_feature (118)..(118): n is a, c, g, or t

SEQ ID NO: 195195 - DNA, 117 bp, Homo sapiens; identical to SEQ ID NO: 194505
  misc_feature: GYAE6OF02G5Y18.51.29.C07.1.454.CMB.1.raw
  modified_base (117)..(117): a, c, t, g, unknown or other
  misc_feature (117)..(117): n is a, c, g, or t

SEQ ID NO: 195196 - DNA, 118 bp, Homo sapiens; identical to SEQ ID NO: 194140
  misc_feature: GYAE6OF02FYS9L.51.29.C07.1.454.CMB.1.raw
  modified_base (118)..(118): a, c, t, g, unknown or other
  misc_feature (118)..(118): n is a, c, g, or t

SEQ ID NO: 195197 - DNA, 118 bp, Homo sapiens; identical to SEQ ID NO: 194140
  misc_feature: GYAE6OF02H9UEB.51.29.C07.1.454.CMB.1.raw
  modified_base (118)..(118): a, c, t, g, unknown or other
  misc_feature (118)..(118): n is a, c, g, or t

SEQ ID NO: 195198 - DNA, 118 bp, Homo sapiens; identical to SEQ ID NO: 194139
  misc_feature: GYAE6OF02GVXEH.51.29.C07.1.454.CMB.1.raw
  modified_base (118)..(118): a, c, t, g, unknown or other
  misc_feature (118)..(118): n is a, c, g, or t

SEQ ID NO: 195199 - DNA, 118 bp, Homo sapiens; identical to SEQ ID NO: 194140
  misc_feature: GYAE6OF02FUB1O.51.29.C07.1.454.CMB.1.raw
  modified_base (118)..(118): a, c, t, g, unknown or other
  misc_feature (118)..(118): n is a, c, g, or t

SEQ ID NO: 195200 - DNA, 176 bp, Homo sapiens
  misc_feature: GYAE6OF02FVVUY.51.29.C07.1.454.CMB.1.raw
  modified_base (158)..(176): a, c, t, g, unknown or other
  misc_feature (158)..(176): n is a, c, g, or t
tcagcgatcgtatacacgaccggtgctcgatttagagtgctacgaagggaaagggcacgaccggtgctcgatttagagtgctacgaaggaaagggcagcgtcactctgttcccaccctcctctcgtagcactctgagcgggctggcaaggcgcatagnnnnnnnnnnnnnnnnnnn

SEQ ID NO: 195201 - DNA, 118 bp, Homo sapiens; identical to SEQ ID NO: 194140
  misc_feature: GYAE6OF02H7BI4.51.29.C07.1.454.CMB.1.raw
  modified_base (118)..(118): a, c, t, g, unknown or other
  misc_feature (118)..(118): n is a, c, g, or t

SEQ ID NO: 195202 - DNA, 118 bp, Homo sapiens; identical to SEQ ID NO: 194139
  misc_feature: GYAE6OF02IR6FT.51.29.C07.1.454.CMB.1.raw
  modified_base (118)..(118): a, c, t, g, unknown or other
  misc_feature (118)..(118): n is a, c, g, or t

SEQ ID NO: 195203 - DNA, 118 bp, Homo sapiens; identical to SEQ ID NO: 194139
  misc_feature: GYAE6OF02H11EZ.51.29.C07.1.454.CMB.1.raw
  modified_base (118)..(118): a, c, t, g, unknown or other
  misc_feature (118)..(118): n is a, c, g, or t

SEQ ID NO: 195204 - DNA, 125 bp, Homo sapiens
  misc_feature: GYAE6OF02H6NTV.51.29.C07.1.454.CMB.1.raw
  modified_base (119)..(125): a, c, t, g, unknown or other
  misc_feature (119)..(125): n is a, c, g, or t
tcagcgatcgtatacacgaccggtgctcgatttagagtgctacgagggaaagggcagcgtcactctcgttccaccctcctctcgtagcactctgagccgggctggcaaggcgcaatagnnnnnnn

SEQ ID NO: 195205 - DNA, 118 bp, Homo sapiens; identical to SEQ ID NO: 194139
  misc_feature: GYAE6OF02F6PE9.51.29.C07.1.454.CMB.1.raw
  modified_base (118)..(118): a, c, t, g, unknown or other
  misc_feature (118)..(118): n is a, c, g, or t

SEQ ID NO: 195206 - DNA, 120 bp, Homo sapiens; identical to SEQ ID NO: 194377
  misc_feature: GYAE6OF02F0LPO.51.29.C07.1.454.CMB.1.raw
  modified_base (117)..(120): a, c, t, g, unknown or other
  misc_feature (117)..(120): n is a, c, g, or t

SEQ ID NO: 195207 - DNA, 165 bp, Homo sapiens
  misc_feature: GYAE6OF02IT31O.51.29.C07.1.454.CMB.1.raw
  modified_base (151)..(151): a, c, t, g, unknown or other
  misc_feature (151)..(151): n is a, c, g, or t
  modified_base (156)..(165): a, c, t, g, unknown or other
  misc_feature (156)..(165): n is a, c, g, or t
tcagcgatcgtatacacgaccggtgctcgatttagagtgctacgaagggaaagggcacgaccggtgctcgatttagagtgcctacgaagggaaggcagcgtcactctgttcccaccctctctcgtagctactctgagcggctggcaaggcncatgnnnnnnnnnn

SEQ ID NO: 195208 - DNA, 118 bp, Homo sapiens; identical to SEQ ID NO: 194140
  misc_feature: GYAE6OF02H1MNR.51.29.C07.1.454.CMB.1.raw
  modified_base (118)..(118): a, c, t, g, unknown or other
  misc_feature (118)..(118): n is a, c, g, or t

SEQ ID NO: 195209 - DNA, 130 bp, Homo sapiens
  misc_feature: GYAE6OF02HH15A.51.29.C07.1.454.CMB.1.raw
  modified_base (118)..(130): a, c, t, g, unknown or other
  misc_feature (118)..(130): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnn

SEQ ID NO: 195210 - DNA, 117 bp, Homo sapiens; identical to SEQ ID NO: 194123
  misc_feature: GYAE6OF02HJ2RT.51.29.C07.1.454.CMB.1.raw
  modified_base (117)..(117): a, c, t, g, unknown or other
  misc_feature (117)..(117): n is a, c, g, or t

SEQ ID NO: 195211 - DNA, 164 bp, Homo sapiens
  misc_feature: GYAE6OF02GR7Q4.51.29.C07.1.454.CMB.1.raw
  modified_base (158)..(164): a, c, t, g, unknown or other
  misc_feature (158)..(164): n is a, c, g, or t
tcagcgatcgtatacacgaccggtgctcgatttagagtgctacgaagggaaagggcacgaccggtgctcgatttagagtgctacgaaggaaagggcagcgtcactctgttcccaccctcctctcgtagcactctgagcgggctggcaaggcgcatagnnnnnnn

SEQ ID NO: 195212 - DNA, 127 bp, Homo sapiens
  misc_feature: GYAE6OF02GO58B.51.29.C07.1.454.CMB.1.raw
  modified_base (96)..(96): a, c, t, g, unknown or other
  misc_feature (96)..(96): n is a, c, g, or t
  modified_base (118)..(127): a, c, t, g, unknown or other
  misc_feature (118)..(127): n is a, c, g, or t
tcagcgatcgtatacacgaccggtgctcgatttagagtgctacgaaggaaagggcagcgtcactctgttcccgccctcctctcgtagcactctgancgggcctggcaaggcgcatagnnnnnnnnnn

SEQ ID NO: 195213 - DNA, 118 bp, Homo sapiens; identical to SEQ ID NO: 194140
  misc_feature: GYAE6OF02GW994.51.29.C07.1.454.CMB.1.raw
  modified_base (118)..(118): a, c, t, g, unknown or other
  misc_feature (118)..(118): n is a, c, g, or t

SEQ ID NO: 195214 - DNA, 120 bp, Homo sapiens; identical to SEQ ID NO: 194289
  misc_feature: GYAE6OF02FYZD4.51.29.C07.1.454.CMB.1.raw
  modified_base (118)..(120): a, c, t, g, unknown or other
  misc_feature (118)..(120): n is a, c, g, or t

SEQ ID NO: 195215 - DNA, 123 bp, Homo sapiens
  misc_feature: GYAE6OF02F4HOZ.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaagggcagcgtcactctgttcccgctctcctctcgtagcactctgagcgggctggcaaggcgcatagnnnnnnn

SEQ ID NO: 195216 - DNA, 119 bp, Homo sapiens; identical to SEQ ID NO: 194160
  misc_feature: GYAE6OF02ICWPP.51.29.C07.1.454.CMB.1.raw
  modified_base (118)..(119): a, c, t, g, unknown or other
  misc_feature (118)..(119): n is a, c, g, or t

SEQ ID NO: 195217 - DNA, 118 bp, Homo sapiens; identical to SEQ ID NO: 194140
  misc_feature: GYAE6OF02HE7LL.51.29.C07.1.454.CMB.1.raw
  modified_base (118)..(118): a, c, t, g, unknown or other
  misc_feature (118)..(118): n is a, c, g, or t

SEQ ID NO: 195218 - DNA, 117 bp, Homo sapiens; identical to SEQ ID NO: 194147
  misc_feature: GYAE6OF02H0AD9.51.29.C07.1.454.CMB.1.raw

SEQ ID NO: 195219 - DNA, 132 bp, Homo sapiens
  misc_feature: GYAE6OF02GJ2UH.51.29.C07.1.454.CMB.1.raw
  modified_base (119)..(132): a, c, t, g, unknown or other
  misc_feature (119)..(132): n is a, c, g, or t
tcagcgatcgtatacacgaccggtgctcgatttagagtgctacgaagggaaaggggcaggcgtcactctgttccaccctcctctcgtagcactctgagcgggctggcaaggcgcatagnnnnnnnnnnnnnn

SEQ ID NO: 195220 - DNA, 122 bp, Homo sapiens; identical to SEQ ID NO: 195017
  misc_feature: GYAE6OF02FM1B4.51.29.C07.1.454.CMB.1.raw
  modified_base (117)..(122): a, c, t, g, unknown or other
  misc_feature (117)..(122): n is a, c, g, or t

SEQ ID NO: 195221 - DNA, 116 bp, Homo sapiens; identical to SEQ ID NO: 194971
  misc_feature: GYAE6OF02HR14I.51.29.C07.1.454.CMB.1.raw
  modified_base (116)..(116): a, c, t, g, unknown or other
  misc_feature (116)..(116): n is a, c, g, or t

SEQ ID NO: 195222 - DNA, 118 bp, Homo sapiens; identical to SEQ ID NO: 194140
  misc_feature: GYAE6OF02HTJFC.51.29.C07.1.454.CMB.1.raw
  modified_base (118)..(118): a, c, t, g, unknown or other
  misc_feature (118)..(118): n is a, c, g, or t

SEQ ID NO: 195223 - DNA, 118 bp, Homo sapiens; identical to SEQ ID NO: 194139
  misc_feature: GYAE6OF02G1KTZ.51.29.C07.1.454.CMB.1.raw
  modified_base (118)..(118): a, c, t, g, unknown or other
  misc_feature (118)..(118): n is a, c, g, or t

SEQ ID NO: 195224 - DNA, 132 bp, Homo sapiens; identical to SEQ ID NO: 194380
  misc_feature: GYAE6OF02GNM6A.51.29.C07.1.454.CMB.1.raw
  modified_base (118)..(132): a, c, t, g, unknown or other
  misc_feature (118)..(132): n is a, c, g, or t

SEQ ID NO: 195225 - DNA, 127 bp, Homo sapiens
  misc_feature: GYAE6OF02F8W0K.51.29.C07.1.454.CMB.1.raw
  modified_base (119)..(127): a, c, t, g, unknown or other
  misc_feature (119)..(127): n is a, c, g, or t
tcagcgatcgtatacacgaccggtgctcgatttagagtgctacgaagggaaagggcgagcgtcactctgttcccgccctcctctcgtagcactctgagcgggctggcaaggcgcatagnnnnnnnnn

SEQ ID NO: 195226 - DNA, 117 bp, Homo sapiens
  misc_feature: GYAE6OF02FT98G.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaggcagcgtcactctgttcccaccctcctctcgtagcactctgagcgggctggcaaggcgcatagnn

SEQ ID NO: 195227 - DNA, 118 bp, Homo sapiens; identical to SEQ ID NO: 194140
  misc_feature: GYAE6OF02JFPNR.51.29.C07.1.454.CMB.1.raw
  modified_base (118)..(118): a, c, t, g, unknown or other
  misc_feature (118)..(118): n is a, c, g, or t

SEQ ID NO: 195228 - DNA, 117 bp, Homo sapiens
  misc_feature: GYAE6OF02GVRDB.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaaggaaagggcagcgtcactctgttcccaccctcctctcgtagcactctgagcgggctggcaaggcgcatagn

SEQ ID NO: 195229 - DNA, 121 bp, Homo sapiens; identical to SEQ ID NO: 194651
  misc_feature: GYAE6OF02IUZPJ.51.29.C07.1.454.CMB.1.raw
  modified_base (118)..(121): a, c, t, g, unknown or other
  misc_feature (118)..(121): n is a, c, g, or t

SEQ ID NO: 195230 - DNA, 117 bp, Homo sapiens
  misc_feature: GYAE6OF02HULIB.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaggcagcgtcactctgttcccgccctcctctcgtagcactctgagcgggctggcaaggcgcatagnn

SEQ ID NO: 195231 - DNA, 116 bp, Homo sapiens
  misc_feature: GYAE6OF02IPX79.51.29.C07.1.454.CMB.1.raw
  modified_base (116)..(116): a, c, t, g, unknown or other
  misc_feature (116)..(116): n is a, c, g, or t
tcagcgatcgtatacacgaccggtgctcgatttagagtgctacgaaggaaagggcagcgtcactctgttcccgcctcctctcgtagcactctgagcgggctggcaaggcgcatagn

SEQ ID NO: 195232 - DNA, 118 bp, Homo sapiens; identical to SEQ ID NO: 194140
  misc_feature: GYAE6OF02F0PLI.51.29.C07.1.454.CMB.1.raw
  modified_base (118)..(118): a, c, t, g, unknown or other
  misc_feature (118)..(118): n is a, c, g, or t

SEQ ID NO: 195233 - DNA, 118 bp, Homo sapiens; identical to SEQ ID NO: 194139
  misc_feature: GYAE6OF02F8SDC.51.29.C07.1.454.CMB.1.raw
  modified_base (118)..(118): a, c, t, g, unknown or other
  misc_feature (118)..(118): n is a, c, g, or t

SEQ ID NO: 195234 - DNA, 117 bp, Homo sapiens; identical to SEQ ID NO: 194206
  misc_feature: GYAE6OF02H11ZL.51.29.C07.1.454.CMB.1.raw

SEQ ID NO: 195235 - DNA, 127 bp, Homo sapiens
  misc_feature: GYAE6OF02HBEEF.51.29.C07.1.454.CMB.1.raw
  modified_base (119)..(127): a, c, t, g, unknown or other
  misc_feature (119)..(127): n is a, c, g, or t
tcagcgatcgtatacacgaccggtgctcgatttagagtgctacgaagggaaagggcaggcgtcactctgttcccgccctcctctcgtagcactctgagcgggctggcaaggcgcatagnnnnnnnnn

SEQ ID NO: 195236 - DNA, 122 bp, Homo sapiens
  misc_feature: GYAE6OF02I4Y5S.51.29.C07.1.454.CMB.1.raw
  modified_base (112)..(122): a, c, t, g, unknown or other
  misc_feature (112)..(122): n is a, c, g, or t
tcagcgatcgtatacacgaccggtgctcgatttagagtgctacgaaggaaggcagcgtcactctgttccacctcctctcgtagcactctgagcggctggcaaggcgcatagnnnnnnnnnnn

SEQ ID NO: 195237 - DNA, 119 bp, Homo sapiens; identical to SEQ ID NO: 194160
  misc_feature: GYAE6OF02H5IY5.51.29.C07.1.454.CMB.1.raw
  modified_base (118)..(119): a, c, t, g, unknown or other
  misc_feature (118)..(119): n is a, c, g, or t

SEQ ID NO: 195238 - DNA, 119 bp, Homo sapiens
  misc_feature: GYAE6OF02F9IL7.51.29.C07.1.454.CMB.1.raw
  modified_base (119)..(119): a, c, t, g, unknown or other
  misc_feature (119)..(119): n is a, c, g, or t
tcagcgatcgtatacacgaccggtgctcgatttagagtgctacgaagggaaagggcagcgtcactctgttcccgccctcctctcgtagccactctgagcgggctggcaaggcgcatagn

SEQ ID NO: 195239 - DNA, 118 bp, Homo sapiens; identical to SEQ ID NO: 194140
  misc_feature: GYAE6OF02IA47J.51.29.C07.1.454.CMB.1.raw
  modified_base (118)..(118): a, c, t, g, unknown or other
  misc_feature (118)..(118): n is a, c, g, or t

SEQ ID NO: 195240 - DNA, 118 bp, Homo sapiens; identical to SEQ ID NO: 195028
  misc_feature: GYAE6OF02H5D8D.51.29.C07.1.454.CMB.1.raw
  modified_base (117)..(118): a, c, t, g, unknown or other
  misc_feature (117)..(118): n is a, c, g, or t

SEQ ID NO: 195241 - DNA, 136 bp, Homo sapiens
  misc_feature: GYAE6OF02GUKZN.51.29.C07.1.454.CMB.1.raw
  modified_base (98)..(98): a, c, t, g, unknown or other
  misc_feature (98)..(98): n is a, c, g, or t
  modified_base (120)..(136): a, c, t, g, unknown or other
  misc_feature (120)..(136): n is a, c, g, or t
tcagcgatcgtatacacgaccggtgctcgatttagagtgctacgaagggaaagggcgagcgtcactctgttcccgccctcctctcgtagcactctgancgggctggccaaggcgcatagnnnnnnnnnnnnnnnnn

SEQ ID NO: 195242 - DNA, 116 bp, Homo sapiens; identical to SEQ ID NO: 194224
  misc_feature: GYAE6OF02JAGL9.51.29.C07.1.454.CMB.1.raw

SEQ ID NO: 195243 - DNA, 160 bp, Homo sapiens; identical to SEQ ID NO: 194364
  misc_feature: GYAE6OF02HMQ47.51.29.C07.1.454.CMB.1.raw
  modified_base (159)..(160): a, c, t, g, unknown or other
  misc_feature (159)..(160): n is a, c, g, or t

SEQ ID NO: 195244 - DNA, 118 bp, Homo sapiens; identical to SEQ ID NO: 194139
  misc_feature: GYAE6OF02HXWQY.51.29.C07.1.454.CMB.1.raw
  modified_base (118)..(118): a, c, t, g, unknown or other
  misc_feature (118)..(118): n is a, c, g, or t

SEQ ID NO: 195245 - DNA, 117 bp, Homo sapiens; identical to SEQ ID NO: 194173
  misc_feature: GYAE6OF02F0RHN.51.29.C07.1.454.CMB.1.raw
  modified_base (117)..(117): a, c, t, g, unknown or other
  misc_feature (117)..(117): n is a, c, g, or t

SEQ ID NO: 195246 - DNA, 131 bp, Homo sapiens
  misc_feature: GYAE6OF02JUPF9.51.29.C07.1.454.CMB.1.raw
  modified_base (117)..(131): a, c, t, g, unknown or other
  misc_feature (117)..(131): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnnnnnnn

SEQ ID NO: 195247 - DNA, 116 bp, Homo sapiens; identical to SEQ ID NO: 194127
  misc_feature: GYAE6OF02G18MB.51.29.C07.1.454.CMB.1.raw
  modified_base (116)..(116): a, c, t, g, unknown or other
  misc_feature (116)..(116): n is a, c, g, or t

SEQ ID NO: 195248 - DNA, 120 bp, Homo sapiens; identical to SEQ ID NO: 194365
  misc_feature: GYAE6OF02H5BCA.51.29.C07.1.454.CMB.1.raw
  modified_base (118)..(120): a, c, t, g, unknown or other
  misc_feature (118)..(120): n is a, c, g, or t

SEQ ID NO: 195249 - DNA, 150 bp, Homo sapiens
  misc_feature: GYAE6OF02FTQB7.51.29.C07.1.454.CMB.1.raw
  modified_base (119)..(150): a, c, t, g, unknown or other
  misc_feature (119)..(150): n is a, c, g, or t
tcagcgatcgtatacacgaccggtgctcgatttagagtgctacgaagggtaagggcagcgtcactctgttcccgcccgtcctctcgtagcactctgagcgggctggcaaggcgcatagnnnnnnnnnnnnnnnnnnnnnnnnnnnnnnnn

SEQ ID NO: 195250 - DNA, 118 bp, Homo sapiens; identical to SEQ ID NO: 194140
  misc_feature: GYAE6OF02GLS6U.51.29.C07.1.454.CMB.1.raw
  modified_base (118)..(118): a, c, t, g, unknown or other
  misc_feature (118)..(118): n is a, c, g, or t

SEQ ID NO: 195251 - DNA, 119 bp, Homo sapiens; identical to SEQ ID NO: 194160
  misc_feature: GYAE6OF02IB80F.51.29.C07.1.454.CMB.1.raw
  modified_base (118)..(119): a, c, t, g, unknown or other
  misc_feature (118)..(119): n is a, c, g, or t

SEQ ID NO: 195252 - DNA, 116 bp, Homo sapiens; identical to SEQ ID NO: 194201
  misc_feature: GYAE6OF02FID9R.51.29.C07.1.454.CMB.1.raw

SEQ ID NO: 195253 - DNA, 120 bp, Homo sapiens; identical to SEQ ID NO: 194365
  misc_feature: GYAE6OF02HRIBU.51.29.C07.1.454.CMB.1.raw
  modified_base (118)..(120): a, c, t, g, unknown or other
  misc_feature (118)..(120): n is a, c, g, or t

SEQ ID NO: 195254 - DNA, 117 bp, Homo sapiens
  misc_feature: GYAE6OF02GB0M1.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaaggaagggcagcgtcactctgttcccaccctcctctcgtagcactctgagcgggctggcaaggcgcatagnn

SEQ ID NO: 195255 - DNA, 118 bp, Homo sapiens; identical to SEQ ID NO: 194140
  misc_feature: GYAE6OF02H6O0J.51.29.C07.1.454.CMB.1.raw
  modified_base (118)..(118): a, c, t, g, unknown or other
  misc_feature (118)..(118): n is a, c, g, or t

SEQ ID NO: 195256 - DNA, 121 bp, Homo sapiens
  misc_feature: GYAE6OF02IV1M6.51.29.C07.1.454.CMB.1.raw
  modified_base (117)..(121): a, c, t, g, unknown or other
  misc_feature (117)..(121): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnn

SEQ ID NO: 195257 - DNA, 144 bp, Homo sapiens
  misc_feature: GYAE6OF02HS216.51.29.C07.1.454.CMB.1.raw
  modified_base (118)..(144): a, c, t, g, unknown or other
  misc_feature (118)..(144): n is a, c, g, or t
tcagcgatcgtatacacgaccggtgctcgatttagagtgctacgaagggaaagggcgagcgtcactctgttcccacctcctctcgtagcactctgagcgggctggcaaggcgcatagnnnnnnnnnnnnnnnnnnnnnnnnnnn

SEQ ID NO: 195258 - DNA, 118 bp, Homo sapiens; identical to SEQ ID NO: 194140
  misc_feature: GYAE6OF02HYNEU.51.29.C07.1.454.CMB.1.raw
  modified_base (118)..(118): a, c, t, g, unknown or other
  misc_feature (118)..(118): n is a, c, g, or t

SEQ ID NO: 195259 - DNA, 160 bp, Homo sapiens
  misc_feature: GYAE6OF02HIP1F.51.29.C07.1.454.CMB.1.raw
  modified_base (158)..(160): a, c, t, g, unknown or other
  misc_feature (158)..(160): n is a, c, g, or t
tcagcgatcgtatacacgaccggtgctcgatttagagtgctacgaagggaaagggcacgaccggtgctcgatttagagtgctacgaagggaaagggcagcgtcactctgttcccacctcctctcgtagcactctgagcgggctggcaaggcgcatagnnn

SEQ ID NO: 195260 - DNA, 117 bp, Homo sapiens; identical to SEQ ID NO: 194677
  misc_feature: GYAE6OF02H72LD.51.29.C07.1.454.CMB.1.raw
  modified_base (117)..(117): a, c, t, g, unknown or other
  misc_feature (117)..(117): n is a, c, g, or t

SEQ ID NO: 195261 - DNA, 120 bp, Homo sapiens; identical to SEQ ID NO: 194365
  misc_feature: GYAE6OF02HNLRG.51.29.C07.1.454.CMB.1.raw
  modified_base (118)..(120): a, c, t, g, unknown or other
  misc_feature (118)..(120): n is a, c, g, or t

SEQ ID NO: 195262 - DNA, 118 bp, Homo sapiens; identical to SEQ ID NO: 194139
  misc_feature: GYAE6OF02H4IT0.51.29.C07.1.454.CMB.1.raw
  modified_base (118)..(118): a, c, t, g, unknown or other
  misc_feature (118)..(118): n is a, c, g, or t

SEQ ID NO: 195263 - DNA, 124 bp, Homo sapiens
  misc_feature: GYAE6OF02HQZ9X.51.29.C07.1.454.CMB.1.raw
  modified_base (116)..(124): a, c, t, g, unknown or other
  misc_feature (116)..(124): n is a, c, g, or t
tcagcgatcgtatacacgaccggtgctcgatttagagtgctacgaagggaagggcagcgtcactctgttcccgcctcctctcgtagcactctgagcgggctggcaaggcgcatagnnnnnnnnn

SEQ ID NO: 195264 - DNA, 120 bp, Homo sapiens; identical to SEQ ID NO: 194289
  misc_feature: GYAE6OF02JHBFZ.51.29.C07.1.454.CMB.1.raw
  modified_base (118)..(120): a, c, t, g, unknown or other
  misc_feature (118)..(120): n is a, c, g, or t

SEQ ID NO: 195265 - DNA, 118 bp, Homo sapiens; identical to SEQ ID NO: 194139
  misc_feature: GYAE6OF02IF3C8.51.29.C07.1.454.CMB.1.raw
  modified_base (118)..(118): a, c, t, g, unknown or other
  misc_feature (118)..(118): n is a, c, g, or t

SEQ ID NO: 195266 - DNA, 118 bp, Homo sapiens; identical to SEQ ID NO: 194140
  misc_feature: GYAE6OF02IZ00Z.51.29.C07.1.454.CMB.1.raw
  modified_base (118)..(118): a, c, t, g, unknown or other
  misc_feature (118)..(118): n is a, c, g, or t

SEQ ID NO: 195267 - DNA, 118 bp, Homo sapiens; identical to SEQ ID NO: 194139
  misc_feature: GYAE6OF02H6CSX.51.29.C07.1.454.CMB.1.raw
  modified_base (118)..(118): a, c, t, g, unknown or other
  misc_feature (118)..(118): n is a, c, g, or t

SEQ ID NO: 195268 - DNA, 118 bp, Homo sapiens; identical to SEQ ID NO: 194140
  misc_feature: GYAE6OF02GTIYC.51.29.C07.1.454.CMB.1.raw
  modified_base (118)..(118): a, c, t, g, unknown or other
  misc_feature (118)..(118): n is a, c, g, or t

SEQ ID NO: 195269 - DNA, 119 bp, Homo sapiens; identical to SEQ ID NO: 195001
  misc_feature: GYAE6OF02HMYZ5.51.29.C07.1.454.CMB.1.raw
  modified_base (117)..(119): a, c, t, g, unknown or other
  misc_feature (117)..(119): n is a, c, g, or t

SEQ ID NO: 195270 - DNA, 117 bp, Homo sapiens; identical to SEQ ID NO: 194147
  misc_feature: GYAE6OF02GHSTD.51.29.C07.1.454.CMB.1.raw

SEQ ID NO: 195271 - DNA, 125 bp, Homo sapiens
  misc_feature: GYAE6OF02GEZO5.51.29.C07.1.454.CMB.1.raw
  modified_base (119)..(125): a, c, t, g, unknown or other
  misc_feature (119)..(125): n is a, c, g, or t
tcagcgatcgtatacacgaccggtgctcgatttagagtgctacgaagggaagggtcgagcgtcactctgttcccgccctcctctcgtagcactctgagcgggctggcaaggcgcatagnnnnnnn

SEQ ID NO: 195272 - DNA, 118 bp, Homo sapiens; identical to SEQ ID NO: 194140
  misc_feature: GYAE6OF02GRVDM.51.29.C07.1.454.CMB.1.raw
  modified_base (118)..(118): a, c, t, g, unknown or other
  misc_feature (118)..(118): n is a, c, g, or t

SEQ ID NO: 195273 - DNA, 118 bp, Homo sapiens; identical to SEQ ID NO: 194139
  misc_feature: GYAE6OF02GME6B.51.29.C07.1.454.CMB.1.raw
  modified_base (118)..(118): a, c, t, g, unknown or other
  misc_feature (118)..(118): n is a, c, g, or t

SEQ ID NO: 195274 - DNA, 123 bp, Homo sapiens; identical to SEQ ID NO: 194393
  misc_feature: GYAE6OF02GRT57.51.29.C07.1.454.CMB.1.raw
  modified_base (118)..(123): a, c, t, g, unknown or other
  misc_feature (118)..(123): n is a, c, g, or t

SEQ ID NO: 195275 - DNA, 117 bp, Homo sapiens; identical to SEQ ID NO: 194947
  misc_feature: GYAE6OF02I47TF.51.29.C07.1.454.CMB.1.raw
  modified_base (117)..(117): a, c, t, g, unknown or other
  misc_feature (117)..(117): n is a, c, g, or t

SEQ ID NO: 195276 - DNA, 119 bp, Homo sapiens; identical to SEQ ID NO: 194137
  misc_feature: GYAE6OF02HOUOH.51.29.C07.1.454.CMB.1.raw
  modified_base (118)..(119): a, c, t, g, unknown or other
  misc_feature (118)..(119): n is a, c, g, or t

SEQ ID NO: 195277 - DNA, 118 bp, Homo sapiens; identical to SEQ ID NO: 194140
  misc_feature: GYAE6OF02GXXRJ.51.29.C07.1.454.CMB.1.raw
  modified_base (118)..(118): a, c, t, g, unknown or other
  misc_feature (118)..(118): n is a, c, g, or t

SEQ ID NO: 195278 - DNA, 119 bp, Homo sapiens; identical to SEQ ID NO: 194160
  misc_feature: GYAE6OF02HF6OY.51.29.C07.1.454.CMB.1.raw
  modified_base (118)..(119): a, c, t, g, unknown or other
  misc_feature (118)..(119): n is a, c, g, or t

SEQ ID NO: 195279 - DNA, 118 bp, Homo sapiens; identical to SEQ ID NO: 194139
  misc_feature: GYAE6OF02G1OPA.51.29.C07.1.454.CMB.1.raw
  modified_base (118)..(118): a, c, t, g, unknown or other
  misc_feature (118)..(118): n is a, c, g, or t

SEQ ID NO: 195280 - DNA, 132 bp, Homo sapiens
  misc_feature: GYAE6OF02H3BLP.51.29.C07.1.454.CMB.1.raw
  modified_base (111)..(111): a, c, t, g, unknown or other
  misc_feature (111)..(111): n is a, c, g, or t
  modified_base (117)..(132): a, c, t, g, unknown or other
  misc_feature (117)..(132): n is a, c, g, or t
tcagcgatcgtatacacgaccggtgctcgatttagagtgctacgaagggaagggcagcgtcactctgttcccaccttcctctcgtagcactctgagcgggctggcaaggcncatagnnnnnnnnnnnnnnnn

SEQ ID NO: 195281 - DNA, 118 bp, Homo sapiens; identical to SEQ ID NO: 194140
  misc_feature: GYAE6OF02FU7AH.51.29.C07.1.454.CMB.1.raw
  modified_base (118)..(118): a, c, t, g, unknown or other
  misc_feature (118)..(118): n is a, c, g, or t

SEQ ID NO: 195282 - DNA, 118 bp, Homo sapiens; identical to SEQ ID NO: 194140
  misc_feature: GYAE6OF02HLWMF.51.29.C07.1.454.CMB.1.raw
  modified_base (118)..(118): a, c, t, g, unknown or other
  misc_feature (118)..(118): n is a, c, g, or t

SEQ ID NO: 195283 - DNA, 115 bp, Homo sapiens
  misc_feature: GYAE6OF02FF0H7.51.29.C07.1.454.CMB.1.raw
tcagcgatcgtatacacgaccggtgctcgatttagagtgctacgaagggaagggcagcgtcactctgttccaccctcctctcgtagcactctgagcgggctggcaaggcgcatag

SEQ ID NO: 195284 - DNA, 118 bp, Homo sapiens; identical to SEQ ID NO: 194140
  misc_feature: GYAE6OF02G8YYK.51.29.C07.1.454.CMB.1.raw
  modified_base (118)..(118): a, c, t, g, unknown or other
  misc_feature (118)..(118): n is a, c, g, or t

SEQ ID NO: 195285 - DNA, 148 bp, Homo sapiens
  misc_feature: GYAE6OF02GW1QQ.51.29.C07.1.454.CMB.1.raw
  modified_base (121)..(148): a, c, t, g, unknown or other
  misc_feature (121)..(148): n is a, c, g, or t
tcagcgatcgtatacacgaccggtgctcgatttagagtgctacgaagggaaagggcaggcgtcactctgttcccaccctcctctcgtagccactctgagcgggctggcaaggccgcatagnnnnnnnnnnnnnnnnnnnnnnnnnnnn

SEQ ID NO: 195286 - DNA, 117 bp, Homo sapiens; identical to SEQ ID NO: 194123
  misc_feature: GYAE6OF02H1QUB.51.29.C07.1.454.CMB.1.raw
  modified_base (117)..(117): a, c, t, g, unknown or other
  misc_feature (117)..(117): n is a, c, g, or t

SEQ ID NO: 195287 - DNA, 118 bp, Homo sapiens; identical to SEQ ID NO: 194139
  misc_feature: GYAE6OF02G5QMQ.51.29.C07.1.454.CMB.1.raw
  modified_base (118)..(118): a, c, t, g, unknown or other
  misc_feature (118)..(118): n is a, c, g, or t

SEQ ID NO: 195288 - DNA, 117 bp, Homo sapiens; identical to SEQ ID NO: 194147
  misc_feature: GYAE6OF02JC5QL.51.29.C07.1.454.CMB.1.raw

SEQ ID NO: 195289 - DNA, 127 bp, Homo sapiens
  misc_feature: GYAE6OF02HAJ2W.51.29.C07.1.454.CMB.1.raw
  modified_base (119)..(127): a, c, t, g, unknown or other
  misc_feature (119)..(127): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnnnnnnn

SEQ ID NO: 195290 - DNA, 153 bp, Homo sapiens
  misc_feature: GYAE6OF02ISFSN.51.29.C07.1.454.CMB.1.raw
  modified_base (126)..(153): a, c, t, g, unknown or other
  misc_feature (126)..(153): n is a, c, g, or t
tcagcgatcgtatacacgaccggtgctcgatttagagtgctacgaagggaaaggggtcgagcggtcactctcgttcccaccctcctcgtcgtacgcacttctgagcgggctggcaaggcgcatagnnnnnnnnnnnnnnnnnnnnnnnnnnnn

SEQ ID NO: 195291 - DNA, 118 bp, Homo sapiens; identical to SEQ ID NO: 194139
  misc_feature: GYAE6OF02HGVCQ.51.29.C07.1.454.CMB.1.raw
  modified_base (118)..(118): a, c, t, g, unknown or other
  misc_feature (118)..(118): n is a, c, g, or t

SEQ ID NO: 195292 - DNA, 113 bp, Homo sapiens
  misc_feature: GYAE6OF02HTDSU.51.29.C07.1.454.CMB.1.raw
tcagcgatcgtatacacgaccggtgctcgatttagagtgctacgaagggaaggcagcgtcactctgttcccgccctcctctcgtagcactgagcgggctggcaaggcgcatag

SEQ ID NO: 195293 - DNA, 118 bp, Homo sapiens; identical to SEQ ID NO: 194139
  misc_feature: GYAE6OF02IDMD5.51.29.C07.1.454.CMB.1.raw
  modified_base (118)..(118): a, c, t, g, unknown or other
  misc_feature (118)..(118): n is a, c, g, or t

SEQ ID NO: 195294 - DNA, 119 bp, Homo sapiens; identical to SEQ ID NO: 194160
  misc_feature: GYAE6OF02IWDUN.51.29.C07.1.454.CMB.1.raw
  modified_base (118)..(119): a, c, t, g, unknown or other
  misc_feature (118)..(119): n is a, c, g, or t

SEQ ID NO: 195295 - DNA, 120 bp, Homo sapiens; identical to SEQ ID NO: 194931
  misc_feature: GYAE6OF02H45WY.51.29.C07.1.454.CMB.1.raw
  modified_base (116)..(120): a, c, t, g, unknown or other
  misc_feature (116)..(120): n is a, c, g, or t

SEQ ID NO: 195296 - DNA, 156 bp, Homo sapiens
  misc_feature: GYAE6OF02IE8AS.51.29.C07.1.454.CMB.1.raw
  modified_base (122)..(156): a, c, t, g, unknown or other
  misc_feature (122)..(156): n is a, c, g, or t
tcagcgatcgtatacacgaccggtgctcgatttagagtgctacgaagggaaagggggcagcgtcactctgttcccacctccgtctcgtagcacctctgagcgggctggctaaggcgcatagnnnnnnnnnnnnnnnnnnnnnnnnnnnnnnnnnnn

SEQ ID NO: 195297 - DNA, 122 bp, Homo sapiens; identical to SEQ ID NO: 194631
  misc_feature: GYAE6OF02I1LTR.51.29.C07.1.454.CMB.1.raw
  modified_base (118)..(122): a, c, t, g, unknown or other
  misc_feature (118)..(122): n is a, c, g, or t

SEQ ID NO: 195298 - DNA, 118 bp, Homo sapiens; identical to SEQ ID NO: 194140
  misc_feature: GYAE6OF02G27P8.51.29.C07.1.454.CMB.1.raw
  modified_base (118)..(118): a, c, t, g, unknown or other
  misc_feature (118)..(118): n is a, c, g, or t

SEQ ID NO: 195299 - DNA, 116 bp, Homo sapiens; identical to SEQ ID NO: 194269
  misc_feature: GYAE6OF02F4V59.51.29.C07.1.454.CMB.1.raw

SEQ ID NO: 195300 - DNA, 118 bp, Homo sapiens; identical to SEQ ID NO: 194140
  misc_feature: GYAE6OF02HB682.51.29.C07.1.454.CMB.1.raw
  modified_base (118)..(118): a, c, t, g, unknown or other
  misc_feature (118)..(118): n is a, c, g, or t

SEQ ID NO: 195301 - DNA, 116 bp, Homo sapiens; identical to SEQ ID NO: 194269
  misc_feature: GYAE6OF02H6R2X.51.29.C07.1.454.CMB.1.raw

SEQ ID NO: 195302 - DNA, 118 bp, Homo sapiens; identical to SEQ ID NO: 194140
  misc_feature: GYAE6OF02G8D6B.51.29.C07.1.454.CMB.1.raw
  modified_base (118)..(118): a, c, t, g, unknown or other
  misc_feature (118)..(118): n is a, c, g, or t

SEQ ID NO: 195303 - DNA, 119 bp, Homo sapiens; identical to SEQ ID NO: 195001
  misc_feature: GYAE6OF02F5AMY.51.29.C07.1.454.CMB.1.raw
  modified_base (117)..(119): a, c, t, g, unknown or other
  misc_feature (117)..(119): n is a, c, g, or t

SEQ ID NO: 195304 - DNA, 117 bp, Homo sapiens; identical to SEQ ID NO: 194173
  misc_feature: GYAE6OF02HHVFW.51.29.C07.1.454.CMB.1.raw
  modified_base (117)..(117): a, c, t, g, unknown or other
  misc_feature (117)..(117): n is a, c, g, or t

SEQ ID NO: 195305 - DNA, 117 bp, Homo sapiens; identical to SEQ ID NO: 194206
  misc_feature: GYAE6OF02HM1G2.51.29.C07.1.454.CMB.1.raw

SEQ ID NO: 195306 - DNA, 118 bp, Homo sapiens; identical to SEQ ID NO: 194139
  misc_feature: GYAE6OF02HQYO4.51.29.C07.1.454.CMB.1.raw
  modified_base (118)..(118): a, c, t, g, unknown or other
  misc_feature (118)..(118): n is a, c, g, or t

SEQ ID NO: 195307 - DNA, 118 bp, Homo sapiens; identical to SEQ ID NO: 194139
  misc_feature: GYAE6OF02HQDBQ.51.29.C07.1.454.CMB.1.raw
  modified_base (118)..(118): a, c, t, g, unknown or other
  misc_feature (118)..(118): n is a, c, g, or t

SEQ ID NO: 195308 - DNA, 117 bp, Homo sapiens; identical to SEQ ID NO: 194206
  misc_feature: GYAE6OF02HM998.51.29.C07.1.454.CMB.1.raw

SEQ ID NO: 195309 - DNA, 118 bp, Homo sapiens; identical to SEQ ID NO: 194139
  misc_feature: GYAE6OF02FYCWD.51.29.C07.1.454.CMB.1.raw
  modified_base (118)..(118): a, c, t, g, unknown or other
  misc_feature (118)..(118): n is a, c, g, or t

SEQ ID NO: 195310 - DNA, 118 bp, Homo sapiens
  misc_feature: GYAE6OF02FVIQV.51.29.C07.1.454.CMB.1.raw
tcagcgatcgtatacacgaccggtgctcgatttagagtgctacgaagggaaagggcagcgtcactctgttcccggccctcctctcgtagcactctgagcgggctggcaaggcgcatag

SEQ ID NO: 195311 - DNA, 119 bp, Homo sapiens
  misc_feature: GYAE6OF02HRE4A.51.29.C07.1.454.CMB.1.raw
  modified_base (119)..(119): a, c, t, g, unknown or other
  misc_feature (119)..(119): n is a, c, g, or t
tcagcgatcgtatacacgaccggtgctcgatttagagtgctacgaagggaaagggcagcgtcactctgttcccggccctcctctcgtagcactctgagcgggctggcaaggcgcatagn

SEQ ID NO: 195312 - DNA, 168 bp, Homo sapiens
  misc_feature: GYAE6OF02GG7MZ.51.29.C07.1.454.CMB.1.raw
  modified_base (120)..(131): a, c, t, g, unknown or other
  misc_feature (120)..(131): n is a, c, g, or t
  modified_base (133)..(168): a, c, t, g, unknown or other
  misc_feature (133)..(168): n is a, c, g, or t
tcagcgatcgtatacacgaccggtgctcgatttagagtgctacgaagggaaagggcagcggtcactctgttcccgccctcctctcgtagcactctgagtcgggctggcaaggcgcatagnnnnnnnnnnnntnnnnnnnnnnnnnnnnnnnnnnnnnnnnnnnnnnnn

SEQ ID NO: 195313 - DNA, 118 bp, Homo sapiens; identical to SEQ ID NO: 194140
  misc_feature: GYAE6OF02F41KU.51.29.C07.1.454.CMB.1.raw
  modified_base (118)..(118): a, c, t, g, unknown or other
  misc_feature (118)..(118): n is a, c, g, or t

SEQ ID NO: 195314 - DNA, 120 bp, Homo sapiens
  misc_feature: GYAE6OF02JXRUC.51.29.C07.1.454.CMB.1.raw
  modified_base (116)..(120): a, c, t, g, unknown or other
  misc_feature (116)..(120): n is a, c, g, or t
tcagcgatcgtatacacgaccggtgctcgatttagagtgctacgaagggaaagggcagcgtcactctgttcccacctcctctcgtagcactctgagcggctggcaaggcgcatagnnnnn

SEQ ID NO: 195315 - DNA, 118 bp, Homo sapiens; identical to SEQ ID NO: 194140
  misc_feature: GYAE6OF02IBOFN.51.29.C07.1.454.CMB.1.raw
  modified_base (118)..(118): a, c, t, g, unknown or other
  misc_feature (118)..(118): n is a, c, g, or t

SEQ ID NO: 195316 - DNA, 118 bp, Homo sapiens
  misc_feature: GYAE6OF02F0M80.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgattagagtgctacgaagggaaagggcagcgtcactctgttcccgccctcctctcgtagcactctgagcgggctggcaaggcgcatagnn

SEQ ID NO: 195317 - DNA, 120 bp, Homo sapiens; identical to SEQ ID NO: 194365
  misc_feature: GYAE6OF02F2Y3C.51.29.C07.1.454.CMB.1.raw
  modified_base (118)..(120): a, c, t, g, unknown or other
  misc_feature (118)..(120): n is a, c, g, or t

SEQ ID NO: 195318 - DNA, 162 bp, Homo sapiens
  misc_feature: GYAE6OF02F8RZD.51.29.C07.1.454.CMB.1.raw
  modified_base (120)..(162): a, c, t, g, unknown or other
  misc_feature (120)..(162): n is a, c, g, or t
tcagcgatcgtatacacgaccggtgctcgatttagagtgctacgaagggaaagggcagcgtcactctgttctcaccctcctactcgtaagcactctgagcgggctggcaaggcgcatagnnnnnnnnnnnnnnnnnnnnnnnnnnnnnnnnnnnnnnnnnnn

SEQ ID NO: 195319 - DNA, 121 bp, Homo sapiens; identical to SEQ ID NO: 194651
  misc_feature: GYAE6OF02FXYWH.51.29.C07.1.454.CMB.1.raw
  modified_base (118)..(121): a, c, t, g, unknown or other
  misc_feature (118)..(121): n is a, c, g, or t

SEQ ID NO: 195320 - DNA, 117 bp, Homo sapiens
  misc_feature: GYAE6OF02GXFFM.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccaccctccctcgtagcactctgagcgggctggcaaggcgcatagn

SEQ ID NO: 195321 - DNA, 117 bp, Homo sapiens; identical to SEQ ID NO: 194147
  misc_feature: GYAE6OF02FPN0J.51.29.C07.1.454.CMB.1.raw

SEQ ID NO: 195322 - DNA, 118 bp, Homo sapiens; identical to SEQ ID NO: 194139
  misc_feature: GYAE6OF02I6D6W.51.29.C07.1.454.CMB.1.raw
  modified_base (118)..(118): a, c, t, g, unknown or other
  misc_feature (118)..(118): n is a, c, g, or t

SEQ ID NO: 195323 - DNA, 118 bp, Homo sapiens; identical to SEQ ID NO: 194140
  misc_feature: GYAE6OF02IDO1L.51.29.C07.1.454.CMB.1.raw
  modified_base (118)..(118): a, c, t, g, unknown or other
  misc_feature (118)..(118): n is a, c, g, or t

SEQ ID NO: 195324 - DNA, 121 bp, Homo sapiens; identical to SEQ ID NO: 195256
  misc_feature: GYAE6OF02IK28Z.51.29.C07.1.454.CMB.1.raw
  modified_base (117)..(121): a, c, t, g, unknown or other
  misc_feature (117)..(121): n is a, c, g, or t

SEQ ID NO: 195325 - DNA, 171 bp, Homo sapiens
  misc_feature: GYAE6OF02IE46K.51.29.C07.1.454.CMB.1.raw
  modified_base (126)..(128): a, c, t, g, unknown or other
  misc_feature (126)..(128): n is a, c, g, or t
  modified_base (130)..(171): a, c, t, g, unknown or other
  misc_feature (130)..(171): n is a, c, g, or t
tcagcgatcgtatacacgaccggtgctcgatttagagtgctacgaagggaaagggcagacggtccaactctcgttcccacccgtcctctccgtagcactctgagcgggctggcaaggcgccatagnnntnnnnnnnnnnnnnnnnnnnnnnnnnnnnnnnnnnnnnnnnnn

SEQ ID NO: 195326 - DNA, 117 bp, Homo sapiens; identical to SEQ ID NO: 194147
  misc_feature: GYAE6OF02FLJF6.51.29.C07.1.454.CMB.1.raw

SEQ ID NO: 195327 - DNA, 157 bp, Homo sapiens
  misc_feature: GYAE6OF02IBLPO.51.29.C07.1.454.CMB.1.raw
  modified_base (123)..(157): a, c, t, g, unknown or other
  misc_feature (123)..(157): n is a, c, g, or t
tcagcgatcgtatacacgaccggtgctcgattttagagtgctacgaagggaaagggcaggcggtcactctgttcccgccctcctctcgtagcactctcgagcgggctggctaaggcgcatagnnnnnnnnnnnnnnnnnnnnnnnnnnnnnnnnnnn

SEQ ID NO: 195328 - DNA, 120 bp, Homo sapiens
  misc_feature: GYAE6OF02I45A3.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnnn

SEQ ID NO: 195329 - DNA, 119 bp, Homo sapiens; identical to SEQ ID NO: 195001
  misc_feature: GYAE6OF02IBVES.51.29.C07.1.454.CMB.1.raw
  modified_base (117)..(119): a, c, t, g, unknown or other
  misc_feature (117)..(119): n is a, c, g, or t

SEQ ID NO: 195330 - DNA, 118 bp, Homo sapiens; identical to SEQ ID NO: 195028
  misc_feature: GYAE6OF02FG8K6.51.29.C07.1.454.CMB.1.raw
  modified_base (117)..(118): a, c, t, g, unknown or other
  misc_feature (117)..(118): n is a, c, g, or t

SEQ ID NO: 195331 - DNA, 124 bp, Homo sapiens
  misc_feature: GYAE6OF02FITMJ.51.29.C07.1.454.CMB.1.raw
  modified_base (119)..(124): a, c, t, g, unknown or other
  misc_feature (119)..(124): n is a, c, g, or t
tcagcgatcgtatacacgaccggtgctcgatttagagtgctacgaagggaaagggcagcgtcgactctgttcccaccctcctctcgtagcactctgagcgggctggcaaggcgcatagnnnnnn

SEQ ID NO: 195332 - DNA, 118 bp, Homo sapiens; identical to SEQ ID NO: 194139
  misc_feature: GYAE6OF02IDSAE.51.29.C07.1.454.CMB.1.raw
  modified_base (118)..(118): a, c, t, g, unknown or other
  misc_feature (118)..(118): n is a, c, g, or t

SEQ ID NO: 195333 - DNA, 121 bp, Homo sapiens; identical to SEQ ID NO: 194352
  misc_feature: GYAE6OF02ISI2I.51.29.C07.1.454.CMB.1.raw
  modified_base (118)..(121): a, c, t, g, unknown or other
  misc_feature (118)..(121): n is a, c, g, or t

SEQ ID NO: 195334 - DNA, 118 bp, Homo sapiens; identical to SEQ ID NO: 194139
  misc_feature: GYAE6OF02FIGHE.51.29.C07.1.454.CMB.1.raw
  modified_base (118)..(118): a, c, t, g, unknown or other
  misc_feature (118)..(118): n is a, c, g, or t

SEQ ID NO: 195335 - DNA, 121 bp, Homo sapiens; identical to SEQ ID NO: 195100
  misc_feature: GYAE6OF02IDC4B.51.29.C07.1.454.CMB.1.raw
  modified_base (117)..(121): a, c, t, g, unknown or other
  misc_feature (117)..(121): n is a, c, g, or t

SEQ ID NO: 195336 - DNA, 161 bp, Homo sapiens
  misc_feature: GYAE6OF02JE69V.51.29.C07.1.454.CMB.1.raw
  modified_base (122)..(161): a, c, t, g, unknown or other
  misc_feature (122)..(161): n is a, c, g, or t
tcagcgatcgtatacacgaccggtgctcgatttagagtgctacgaagggtaagggcagcgtcactctgttcccacctcctctcgtagcaccttctggagccgggctggccaaggcgcatagnnnnnnnnnnnnnnnnnnnnnnnnnnnnnnnnnnnnnnnn

SEQ ID NO: 195337 - DNA, 118 bp, Homo sapiens; identical to SEQ ID NO: 194140
  misc_feature: GYAE6OF02GC3XA.51.29.C07.1.454.CMB.1.raw
  modified_base (118)..(118): a, c, t, g, unknown or other
  misc_feature (118)..(118): n is a, c, g, or t

SEQ ID NO: 195338 - DNA, 118 bp, Homo sapiens; identical to SEQ ID NO: 194140
  misc_feature: GYAE6OF02H6455.51.29.C07.1.454.CMB.1.raw
  modified_base (118)..(118): a, c, t, g, unknown or other
  misc_feature (118)..(118): n is a, c, g, or t

SEQ ID NO: 195339 - DNA, 140 bp, Homo sapiens
  misc_feature: GYAE6OF02I0DFS.51.29.C07.1.454.CMB.1.raw
  modified_base (117)..(140): a, c, t, g, unknown or other
  misc_feature (117)..(140): n is a, c, g, or t
tcagcgatcgtatacacgaccggtgctcgatttagagtgctacgaagggaaaggcagcgtcactctgttcccgcctcctctcgtagcactctgagcgggctggcaaggcgcgatagnnnnnnnnnnnnnnnnnnnnnnnn

SEQ ID NO: 195340 - DNA, 129 bp, Homo sapiens; identical to SEQ ID NO: 194487
  misc_feature: GYAE6OF02H7PSV.51.29.C07.1.454.CMB.1.raw
  modified_base (118)..(129): a, c, t, g, unknown or other
  misc_feature (118)..(129): n is a, c, g, or t

SEQ ID NO: 195341 - DNA, 117 bp, Homo sapiens; identical to SEQ ID NO: 194147
  misc_feature: GYAE6OF02FIWL9.51.29.C07.1.454.CMB.1.raw

SEQ ID NO: 195342 - DNA, 120 bp, Homo sapiens; identical to SEQ ID NO: 194365
  misc_feature: GYAE6OF02G7E3X.51.29.C07.1.454.CMB.1.raw
  modified_base (118)..(120): a, c, t, g, unknown or other
  misc_feature (118)..(120): n is a, c, g, or t

SEQ ID NO: 195343 - DNA, 118 bp, Homo sapiens; identical to SEQ ID NO: 194139
  misc_feature: GYAE6OF02HCOQI.51.29.C07.1.454.CMB.1.raw
  modified_base (118)..(118): a, c, t, g, unknown or other
  misc_feature (118)..(118): n is a, c, g, or t

SEQ ID NO: 195344 - DNA, 117 bp, Homo sapiens; identical to SEQ ID NO: 194147
  misc_feature: GYAE6OF02HBRQX.51.29.C07.1.454.CMB.1.raw

SEQ ID NO: 195345 - DNA, 148 bp, Homo sapiens
  misc_feature: GYAE6OF02GFOUR.51.29.C07.1.454.CMB.1.raw
  modified_base (125)..(148): a, c, t, g, unknown or other
  misc_feature (125)..(148): n is a, c, g, or t
tcagcgatcgtatacacgaccggtgctcgatttagagtgctacgaaggggaaagggcgagcgtcactctgttcccaccctcctctcggtagtcactctgagtcggggctggcaagggcgcatagnnnnnnnnnnnnnnnnnnnnnnnn

SEQ ID NO: 195346 - DNA, 136 bp, Homo sapiens
  misc_feature: GYAE6OF02GNTNE.51.29.C07.1.454.CMB.1.raw
  modified_base (119)..(136): a, c, t, g, unknown or other
  misc_feature (119)..(136): n is a, c, g, or t
tcagcgatcgtatacacgaccggtgctcgatttagagtgctacgaagggaaagggcagcgtcactctgttcccgccctcctctcgtagcacctctgagcgggctggcaaggcgcatagnnnnnnnnnnnnnnnnnn

SEQ ID NO: 195347 - DNA, 118 bp, Homo sapiens; identical to SEQ ID NO: 194139
  misc_feature: GYAE6OF02FG011.51.29.C07.1.454.CMB.1.raw
  modified_base (118)..(118): a, c, t, g, unknown or other
  misc_feature (118)..(118): n is a, c, g, or t

SEQ ID NO: 195348 - DNA, 118 bp, Homo sapiens; identical to SEQ ID NO: 194140
  misc_feature: GYAE6OF02F7NBJ.51.29.C07.1.454.CMB.1.raw
  modified_base (118)..(118): a, c, t, g, unknown or other
  misc_feature (118)..(118): n is a, c, g, or t

SEQ ID NO: 195349 - DNA, 120 bp, Homo sapiens; identical to SEQ ID NO: 194365
  misc_feature: GYAE6OF02IQ483.51.29.C07.1.454.CMB.1.raw
  modified_base (118)..(120): a, c, t, g, unknown or other
  misc_feature (118)..(120): n is a, c, g, or t

SEQ ID NO: 195350 - DNA, 163 bp, Homo sapiens
  misc_feature: GYAE6OF02ITK0T.51.29.C07.1.454.CMB.1.raw
  modified_base (159)..(163): a, c, t, g, unknown or other
  misc_feature (159)..(163): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnnnn

SEQ ID NO: 195351 - DNA, 138 bp, Homo sapiens
  misc_feature: GYAE6OF02F7JSQ.51.29.C07.1.454.CMB.1.raw
  modified_base (118)..(138): a, c, t, g, unknown or other
  misc_feature (118)..(138): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnn

SEQ ID NO: 195352 - DNA, 117 bp, Homo sapiens; identical to SEQ ID NO: 194123
  misc_feature: GYAE6OF02FOAJP.51.29.C07.1.454.CMB.1.raw
  modified_base (117)..(117): a, c, t, g, unknown or other
  misc_feature (117)..(117): n is a, c, g, or t

SEQ ID NO: 195353 - DNA, 121 bp, Homo sapiens; identical to SEQ ID NO: 195256
  misc_feature: GYAE6OF02I35KV.51.29.C07.1.454.CMB.1.raw
  modified_base (117)..(121): a, c, t, g, unknown or other
  misc_feature (117)..(121): n is a, c, g, or t

SEQ ID NO: 195354 - DNA, 121 bp, Homo sapiens; identical to SEQ ID NO: 194352
  misc_feature: GYAE6OF02INYHW.51.29.C07.1.454.CMB.1.raw
  modified_base (118)..(121): a, c, t, g, unknown or other
  misc_feature (118)..(121): n is a, c, g, or t

SEQ ID NO: 195355 - DNA, 119 bp, Homo sapiens; identical to SEQ ID NO: 194160
  misc_feature: GYAE6OF02GEIPD.51.29.C07.1.454.CMB.1.raw
  modified_base (118)..(119): a, c, t, g, unknown or other
  misc_feature (118)..(119): n is a, c, g, or t

SEQ ID NO: 195356 - DNA, 159 bp, Homo sapiens; identical to SEQ ID NO: 194634
  misc_feature: GYAE6OF02FMG9W.51.29.C07.1.454.CMB.1.raw
  modified_base (159)..(159): a, c, t, g, unknown or other
  misc_feature (159)..(159): n is a, c, g, or t

SEQ ID NO: 195357 - DNA, 164 bp, Homo sapiens
  misc_feature: GYAE6OF02FVF2W.51.29.C07.1.454.CMB.1.raw
  modified_base (119)..(164): a, c, t, g, unknown or other
  misc_feature (119)..(164): n is a, c, g, or t
tcagcgatcgtatacacgaccggtgctcgatttagagtgctacgaagggaaagggcagcgtcgactctgttcccaccctcctctcgtagcactctgagcgggctggcaaggcgcatagnnnnnnnnnnnnnnnnnnnnnnnnnnnnnnnnnnnnnnnnnnnnnn

SEQ ID NO: 195358 - DNA, 150 bp, Homo sapiens
  misc_feature: GYAE6OF02HI9R4.51.29.C07.1.454.CMB.1.raw
  modified_base (122)..(150): a, c, t, g, unknown or other
  misc_feature (122)..(150): n is a, c, g, or t
tcagcgatcgtatacacgaccggtgctcgatttagagtgctacgaagggaaagggtcgagcgtcactctgttcccgccctccgtctcgtagcactctgagcgggctggcaaggccgcatagnnnnnnnnnnnnnnnnnnnnnnnnnnnnn

SEQ ID NO: 195359 - DNA, 118 bp, Homo sapiens; identical to SEQ ID NO: 194139
  misc_feature: GYAE6OF02F2P4I.51.29.C07.1.454.CMB.1.raw
  modified_base (118)..(118): a, c, t, g, unknown or other
  misc_feature (118)..(118): n is a, c, g, or t

SEQ ID NO: 195360 - DNA, 117 bp, Homo sapiens; identical to SEQ ID NO: 194206
  misc_feature: GYAE6OF02HC4FL.51.29.C07.1.454.CMB.1.raw

SEQ ID NO: 195361 - DNA, 120 bp, Homo sapiens; identical to SEQ ID NO: 194289
  misc_feature: GYAE6OF02HM528.51.29.C07.1.454.CMB.1.raw
  modified_base (118)..(120): a, c, t, g, unknown or other
  misc_feature (118)..(120): n is a, c, g, or t

SEQ ID NO: 195362 - DNA, 118 bp, Homo sapiens; identical to SEQ ID NO: 194140
  misc_feature: GYAE6OF02GT2R7.51.29.C07.1.454.CMB.1.raw
  modified_base (118)..(118): a, c, t, g, unknown or other
  misc_feature (118)..(118): n is a, c, g, or t

SEQ ID NO: 195363 - DNA, 121 bp, Homo sapiens; identical to SEQ ID NO: 194352
  misc_feature: GYAE6OF02I3XW1.51.29.C07.1.454.CMB.1.raw
  modified_base (118)..(121): a, c, t, g, unknown or other
  misc_feature (118)..(121): n is a, c, g, or t

SEQ ID NO: 195364 - DNA, 119 bp, Homo sapiens; identical to SEQ ID NO: 194927
  misc_feature: GYAE6OF02HACV8.51.29.C07.1.454.CMB.1.raw
  modified_base (117)..(119): a, c, t, g, unknown or other
  misc_feature (117)..(119): n is a, c, g, or t

SEQ ID NO: 195365 - DNA, 122 bp, Homo sapiens; identical to SEQ ID NO: 194631
  misc_feature: GYAE6OF02HQ09J.51.29.C07.1.454.CMB.1.raw
  modified_base (118)..(122): a, c, t, g, unknown or other
  misc_feature (118)..(122): n is a, c, g, or t

SEQ ID NO: 195366 - DNA, 124 bp, Homo sapiens
  misc_feature: GYAE6OF02HC3WC.51.29.C07.1.454.CMB.1.raw
  modified_base (112)..(112): a, c, t, g, unknown or other
  misc_feature (112)..(112): n is a, c, g, or t
  modified_base (118)..(124): a, c, t, g, unknown or other
  misc_feature (118)..(124): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnnnn

SEQ ID NO: 195367 - DNA, 159 bp, Homo sapiens; identical to SEQ ID NO: 194634
  misc_feature: GYAE6OF02H6MDU.51.29.C07.1.454.CMB.1.raw
  modified_base (159)..(159): a, c, t, g, unknown or other
  misc_feature (159)..(159): n is a, c, g, or t

SEQ ID NO: 195368 - DNA, 119 bp, Homo sapiens; identical to SEQ ID NO: 194160
  misc_feature: GYAE6OF02GWSWT.51.29.C07.1.454.CMB.1.raw
  modified_base (118)..(119): a, c, t, g, unknown or other
  misc_feature (118)..(119): n is a, c, g, or t

SEQ ID NO: 195369 - DNA, 115 bp, Homo sapiens
  misc_feature: GYAE6OF02I7947.51.29.C07.1.454.CMB.1.raw
  modified_base (115)..(115): a, c, t, g, unknown or other
  misc_feature (115)..(115): n is a, c, g, or t
tcagcgatcgtatacacgaccggtgctcgatttagagtgctacgaagggaaggcagcgtcactctgttcccacctcctctcgtagcactctgagcgggctggcaaggcgcatagn

SEQ ID NO: 195370 - DNA, 117 bp, Homo sapiens; identical to SEQ ID NO: 194147
  misc_feature: GYAE6OF02FUFDG.51.29.C07.1.454.CMB.1.raw

SEQ ID NO: 195371 - DNA, 166 bp, Homo sapiens
  misc_feature: GYAE6OF02IRRQL.51.29.C07.1.454.CMB.1.raw
  modified_base (159)..(166): a, c, t, g, unknown or other
  misc_feature (159)..(166): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnnnnnnn

SEQ ID NO: 195372 - DNA, 117 bp, Homo sapiens; identical to SEQ ID NO: 194206
  misc_feature: GYAE6OF02HZYQR.51.29.C07.1.454.CMB.1.raw

SEQ ID NO: 195373 - DNA, 118 bp, Homo sapiens; identical to SEQ ID NO: 195028
  misc_feature: GYAE6OF02GWZV0.51.29.C07.1.454.CMB.1.raw
  modified_base (117)..(118): a, c, t, g, unknown or other
  misc_feature (117)..(118): n is a, c, g, or t

SEQ ID NO: 195374 - DNA, 120 bp, Homo sapiens; identical to SEQ ID NO: 194365
  misc_feature: GYAE6OF02HH44G.51.29.C07.1.454.CMB.1.raw
  modified_base (118)..(120): a, c, t, g, unknown or other
  misc_feature (118)..(120): n is a, c, g, or t

SEQ ID NO: 195375 - DNA, 120 bp, Homo sapiens; identical to SEQ ID NO: 194365
  misc_feature: GYAE6OF02G87R4.51.29.C07.1.454.CMB.1.raw
  modified_base (118)..(120): a, c, t, g, unknown or other
  misc_feature (118)..(120): n is a, c, g, or t

SEQ ID NO: 195376 - DNA, 122 bp, Homo sapiens
  misc_feature: GYAE6OF02I4MK2.51.29.C07.1.454.CMB.1.raw
  modified_base (116)..(118): a, c, t, g, unknown or other
  misc_feature (116)..(118): n is a, c, g, or t
  modified_base (120)..(122): a, c, t, g, unknown or other
  misc_feature (120)..(122): n is a, c, g, or t
tcagcgatcgtatacacgaccggtgctcgatttagagtgctacgaagggaaagggcagcgtcactctgttcccacctcctctcgtagcactctgagcggctggcaaggcgcatagnnntnnn

SEQ ID NO: 195377 - DNA, 122 bp, Homo sapiens; identical to SEQ ID NO: 194631
  misc_feature: GYAE6OF02H3ZZO.51.29.C07.1.454.CMB.1.raw
  modified_base (118)..(122): a, c, t, g, unknown or other
  misc_feature (118)..(122): n is a, c, g, or t

SEQ ID NO: 195378 - DNA, 117 bp, Homo sapiens; identical to SEQ ID NO: 194206
  misc_feature: GYAE6OF02HZ3RQ.51.29.C07.1.454.CMB.1.raw

SEQ ID NO: 195379 - DNA, 119 bp, Homo sapiens; identical to SEQ ID NO: 194160
  misc_feature: GYAE6OF02HO9US.51.29.C07.1.454.CMB.1.raw
  modified_base (118)..(119): a, c, t, g, unknown or other
  misc_feature (118)..(119): n is a, c, g, or t

SEQ ID NO: 195380 - DNA, 118 bp, Homo sapiens; identical to SEQ ID NO: 194139
  misc_feature: GYAE6OF02GVM4O.51.29.C07.1.454.CMB.1.raw
  modified_base (118)..(118): a, c, t, g, unknown or other
  misc_feature (118)..(118): n is a, c, g, or t

SEQ ID NO: 195381 - DNA, 118 bp, Homo sapiens; identical to SEQ ID NO: 194140
  misc_feature: GYAE6OF02FV3S7.51.29.C07.1.454.CMB.1.raw
  modified_base (118)..(118): a, c, t, g, unknown or other
  misc_feature (118)..(118): n is a, c, g, or t

SEQ ID NO: 195382 - DNA, 126 bp, Homo sapiens
  misc_feature: GYAE6OF02ILHA6.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnn

SEQ ID NO: 195383 - DNA, 121 bp, Homo sapiens
  misc_feature: GYAE6OF02I5P3I.51.29.C07.1.454.CMB.1.raw
  modified_base (116)..(121): a, c, t, g, unknown or other
  misc_feature (116)..(121): n is a, c, g, or t
tcagcgatcgtatacacgaccggtgctcgatttagagtgctacgaagggaaagggcagcgtcactctgttcccacctctctcgtagcactctgagcgggctggcaaggcgcatagnnnnnn

SEQ ID NO: 195384 - DNA, 128 bp, Homo sapiens; identical to SEQ ID NO: 194613
  misc_feature: GYAE6OF02HOKQE.51.29.C07.1.454.CMB.1.raw
  modified_base (118)..(128): a, c, t, g, unknown or other
  misc_feature (118)..(128): n is a, c, g, or t

SEQ ID NO: 195385 - DNA, 148 bp, Homo sapiens
  misc_feature: GYAE6OF02GC7MX.51.29.C07.1.454.CMB.1.raw
  modified_base (122)..(148): a, c, t, g, unknown or other
  misc_feature (122)..(148): n is a, c, g, or t
tcagcgatcgtatacacgaccggtgctcgatttagagtgctacgaagggaaagggtcgagcgtcactctgttcccgccctcctctcgtagcactctgagccgggctggcaaggcgcgatagnnnnnnnnnnnnnnnnnnnnnnnnnnn

SEQ ID NO: 195386 - DNA, 121 bp, Homo sapiens; identical to SEQ ID NO: 195256
  misc_feature: GYAE6OF02G9XKR.51.29.C07.1.454.CMB.1.raw
  modified_base (117)..(121): a, c, t, g, unknown or other
  misc_feature (117)..(121): n is a, c, g, or t

SEQ ID NO: 195387 - DNA, 117 bp, Homo sapiens; identical to SEQ ID NO: 194206
  misc_feature: GYAE6OF02F56B9.51.29.C07.1.454.CMB.1.raw

SEQ ID NO: 195388 - DNA, 118 bp, Homo sapiens; identical to SEQ ID NO: 194140
  misc_feature: GYAE6OF02G0N4X.51.29.C07.1.454.CMB.1.raw
  modified_base (118)..(118): a, c, t, g, unknown or other
  misc_feature (118)..(118): n is a, c, g, or t

SEQ ID NO: 195389 - DNA, 118 bp, Homo sapiens; identical to SEQ ID NO: 194140
  misc_feature: GYAE6OF02I05SQ.51.29.C07.1.454.CMB.1.raw
  modified_base (118)..(118): a, c, t, g, unknown or other
  misc_feature (118)..(118): n is a, c, g, or t

SEQ ID NO: 195390 - DNA, 117 bp, Homo sapiens; identical to SEQ ID NO: 194206
  misc_feature: GYAE6OF02FMPKP.51.29.C07.1.454.CMB.1.raw

SEQ ID NO: 195391 - DNA, 118 bp, Homo sapiens; identical to SEQ ID NO: 194140
  misc_feature: GYAE6OF02IBEVB.51.29.C07.1.454.CMB.1.raw
  modified_base (118)..(118): a, c, t, g, unknown or other
  misc_feature (118)..(118): n is a, c, g, or t

SEQ ID NO: 195392 - DNA, 117 bp, Homo sapiens; identical to SEQ ID NO: 194147
  misc_feature: GYAE6OF02GD0EH.51.29.C07.1.454.CMB.1.raw

SEQ ID NO: 195393 - DNA, 120 bp, Homo sapiens; identical to SEQ ID NO: 194689
  misc_feature: GYAE6OF02I4UTA.51.29.C07.1.454.CMB.1.raw
  modified_base (117)..(120): a, c, t, g, unknown or other
  misc_feature (117)..(120): n is a, c, g, or t

SEQ ID NO: 195394 - DNA, 119 bp, Homo sapiens; identical to SEQ ID NO: 194137
  misc_feature: GYAE6OF02JA5FK.51.29.C07.1.454.CMB.1.raw
  modified_base (118)..(119): a, c, t, g, unknown or other
  misc_feature (118)..(119): n is a, c, g, or t

SEQ ID NO: 195395 - DNA, 169 bp, Homo sapiens
  misc_feature: GYAE6OF02HJ406.51.29.C07.1.454.CMB.1.raw
  modified_base (121)..(169): a, c, t, g, unknown or other
  misc_feature (121)..(169): n is a, c, g, or t
tcagcgatcgtatacacgaccggtgctcgatttagagtgctacgaagggaaaggggctagcgtcactctgttcccaccctcctctcgtagcactctgagcgggctggctaaggcgcatagnnnnnnnnnnnnnnnnnnnnnnnnnnnnnnnnnnnnnnnnnnnnnnnnn

SEQ ID NO: 195396 - DNA, 125 bp, Homo sapiens
  misc_feature: GYAE6OF02GUXIH.51.29.C07.1.454.CMB.1.raw
  modified_base (118)..(125): a, c, t, g, unknown or other
  misc_feature (118)..(125): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnn

SEQ ID NO: 195397 - DNA, 118 bp, Homo sapiens; identical to SEQ ID NO: 194140
  misc_feature: GYAE6OF02IWNKP.51.29.C07.1.454.CMB.1.raw
  modified_base (118)..(118): a, c, t, g, unknown or other
  misc_feature (118)..(118): n is a, c, g, or t

SEQ ID NO: 195398 - DNA, 127 bp, Homo sapiens
  misc_feature: GYAE6OF02HHO8Q.51.29.C07.1.454.CMB.1.raw
  modified_base (120)..(127): a, c, t, g, unknown or other
  misc_feature (120)..(127): n is a, c, g, or t
tcagcgatcgtatacacgaccggtgctcgatttagagtgctacgaagggaaagggcagcgtcactctggttcccaccctcctctccgtagcactctgagcgggctggcaaggcgcatagnnnnnnnn

SEQ ID NO: 195399 - DNA, 142 bp, Homo sapiens
  misc_feature: GYAE6OF02HNQLJ.51.29.C07.1.454.CMB.1.raw
  modified_base (118)..(142): a, c, t, g, unknown or other
  misc_feature (118)..(142): n is a, c, g, or t
tcagcgatcgtatacacgaccggtgctcgatttagagtgctacgaagggaaagggcgagcgtcactctgttcccgcctcctctcgtagcactctgagcgggctggcaaggcgcatagnnnnnnnnnnnnnnnnnnnnnnnnn

SEQ ID NO: 195400 - DNA, 118 bp, Homo sapiens; identical to SEQ ID NO: 194139
  misc_feature: GYAE6OF02GXMUN.51.29.C07.1.454.CMB.1.raw
  modified_base (118)..(118): a, c, t, g, unknown or other
  misc_feature (118)..(118): n is a, c, g, or t

SEQ ID NO: 195401 - DNA, 119 bp, Homo sapiens; identical to SEQ ID NO: 194160
  misc_feature: GYAE6OF02H6YJ6.51.29.C07.1.454.CMB.1.raw
  modified_base (118)..(119): a, c, t, g, unknown or other
  misc_feature (118)..(119): n is a, c, g, or t

SEQ ID NO: 195402 - DNA, 118 bp, Homo sapiens; identical to SEQ ID NO: 194140
  misc_feature: GYAE6OF02F7Z8O.51.29.C07.1.454.CMB.1.raw
  modified_base (118)..(118): a, c, t, g, unknown or other
  misc_feature (118)..(118): n is a, c, g, or t

SEQ ID NO: 195403 - DNA, 118 bp, Homo sapiens; identical to SEQ ID NO: 194140
  misc_feature: GYAE6OF02GQ6A4.51.29.C07.1.454.CMB.1.raw
  modified_base (118)..(118): a, c, t, g, unknown or other
  misc_feature (118)..(118): n is a, c, g, or t

SEQ ID NO: 195404 - DNA, 120 bp, Homo sapiens; identical to SEQ ID NO: 194289
  misc_feature: GYAE6OF02HWB5F.51.29.C07.1.454.CMB.1.raw
  modified_base (118)..(120): a, c, t, g, unknown or other
  misc_feature (118)..(120): n is a, c, g, or t

SEQ ID NO: 195405 - DNA, 118 bp, Homo sapiens
  misc_feature: GYAE6OF02FHSE4.51.29.C07.1.454.CMB.1.raw
  modified_base (116)..(118): a, c, t, g, unknown or other
  misc_feature (116)..(118): n is a, c, g, or t
tcagcgatcgtatacacgaccggtgctcgatttagagtgctacgaagggaagggcagcgtcactctgtcccgccctcctctcgtagcactctgagcgggctggcaaggcgcatagnnn

SEQ ID NO: 195406 - DNA, 128 bp, Homo sapiens
  misc_feature: GYAE6OF02IWBPQ.51.29.C07.1.454.CMB.1.raw
  modified_base (117)..(128): a, c, t, g, unknown or other
  misc_feature (117)..(128): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnnnn

SEQ ID NO: 195407 - DNA, 118 bp, Homo sapiens; identical to SEQ ID NO: 194140
  misc_feature: GYAE6OF02F9SEQ.51.29.C07.1.454.CMB.1.raw
  modified_base (118)..(118): a, c, t, g, unknown or other
  misc_feature (118)..(118): n is a, c, g, or t

SEQ ID NO: 195408 - DNA, 122 bp, Homo sapiens; identical to SEQ ID NO: 194631
  misc_feature: GYAE6OF02HXMFR.51.29.C07.1.454.CMB.1.raw
  modified_base (118)..(122): a, c, t, g, unknown or other
  misc_feature (118)..(122): n is a, c, g, or t

SEQ ID NO: 195409 - DNA, 118 bp, Homo sapiens; identical to SEQ ID NO: 194139
  misc_feature: GYAE6OF02I96KS.51.29.C07.1.454.CMB.1.raw
  modified_base (118)..(118): a, c, t, g, unknown or other
  misc_feature (118)..(118): n is a, c, g, or t

SEQ ID NO: 195410 - DNA, 117 bp, Homo sapiens; identical to SEQ ID NO: 194147
  misc_feature: GYAE6OF02F0OBF.51.29.C07.1.454.CMB.1.raw

SEQ ID NO: 195411 - DNA, 119 bp, Homo sapiens; identical to SEQ ID NO: 194137
  misc_feature: GYAE6OF02JBOSZ.51.29.C07.1.454.CMB.1.raw
  modified_base (118)..(119): a, c, t, g, unknown or other
  misc_feature (118)..(119): n is a, c, g, or t

SEQ ID NO: 195412 - DNA, 118 bp, Homo sapiens; identical to SEQ ID NO: 194139
  misc_feature: GYAE6OF02H2I5P.51.29.C07.1.454.CMB.1.raw
  modified_base (118)..(118): a, c, t, g, unknown or other
  misc_feature (118)..(118): n is a, c, g, or t

SEQ ID NO: 195413 - DNA, 117 bp, Homo sapiens; identical to SEQ ID NO: 194147
  misc_feature: GYAE6OF02I9Z3N.51.29.C07.1.454.CMB.1.raw

SEQ ID NO: 195414 - DNA, 153 bp, Homo sapiens
  misc_feature: GYAE6OF02GW8HO.51.29.C07.1.454.CMB.1.raw
  modified_base (120)..(153): a, c, t, g, unknown or other
  misc_feature (120)..(153): n is a, c, g, or t
tcagcgatcgtatacacgaccggtgctcgatttagagtgctacgaagggaaagggcgagcgtcactctgttcccgccctcctctcgtagcactctgagcgggctggcaaggcgcataggnnnnnnnnnnnnnnnnnnnnnnnnnnnnnnnnnn

SEQ ID NO: 195415 - DNA, 120 bp, Homo sapiens
  misc_feature: GYAE6OF02G7DXP.51.29.C07.1.454.CMB.1.raw
  modified_base (117)..(120): a, c, t, g, unknown or other
  misc_feature (117)..(120): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnn

SEQ ID NO: 195416 - DNA, 117 bp, Homo sapiens; identical to SEQ ID NO: 194123
  misc_feature: GYAE6OF02FH8EQ.51.29.C07.1.454.CMB.1.raw
  modified_base (117)..(117): a, c, t, g, unknown or other
  misc_feature (117)..(117): n is a, c, g, or t

SEQ ID NO: 195417 - DNA, 163 bp, Homo sapiens; identical to SEQ ID NO: 195350
  misc_feature: GYAE6OF02GOX2F.51.29.C07.1.454.CMB.1.raw
  modified_base (159)..(163): a, c, t, g, unknown or other
  misc_feature (159)..(163): n is a, c, g, or t

SEQ ID NO: 195418 - DNA, 118 bp, Homo sapiens; identical to SEQ ID NO: 194139
  misc_feature: GYAE6OF02GG4ZW.51.29.C07.1.454.CMB.1.raw
  modified_base (118)..(118): a, c, t, g, unknown or other
  misc_feature (118)..(118): n is a, c, g, or t

SEQ ID NO: 195419 - DNA, 117 bp, Homo sapiens; identical to SEQ ID NO: 195230
  misc_feature: GYAE6OF02F275I.51.29.C07.1.454.CMB.1.raw
  modified_base (116)..(117): a, c, t, g, unknown or other
  misc_feature (116)..(117): n is a, c, g, or t

SEQ ID NO: 195420 - DNA, 119 bp, Homo sapiens; identical to SEQ ID NO: 194137
  misc_feature: GYAE6OF02GU2PT.51.29.C07.1.454.CMB.1.raw
  modified_base (118)..(119): a, c, t, g, unknown or other
  misc_feature (118)..(119): n is a, c, g, or t

SEQ ID NO: 195421 - DNA, 118 bp, Homo sapiens; identical to SEQ ID NO: 194139
  misc_feature: GYAE6OF02I8QAR.51.29.C07.1.454.CMB.1.raw
  modified_base (118)..(118): a, c, t, g, unknown or other
  misc_feature (118)..(118): n is a, c, g, or t

SEQ ID NO: 195422 - DNA, 118 bp, Homo sapiens; identical to SEQ ID NO: 194139
  misc_feature: GYAE6OF02HF8BL.51.29.C07.1.454.CMB.1.raw
  modified_base (118)..(118): a, c, t, g, unknown or other
  misc_feature (118)..(118): n is a, c, g, or t

SEQ ID NO: 195423 - DNA, 158 bp, Homo sapiens
  misc_feature: GYAE6OF02FQW5Z.51.29.C07.1.454.CMB.1.raw
  modified_base (123)..(158): a, c, t, g, unknown or other
  misc_feature (123)..(158): n is a, c, g, or t
tcagcgatcgtatacacgaccggtgctcgatttagagtgctacgaagggaaagggcagcgttcgactcgtgttcccgcccgtcctctcgtagcactcgtgagcgggctggcaaggcgcatagnnnnnnnnnnnnnnnnnnnnnnnnnnnnnnnnnnnn

SEQ ID NO: 195424 - DNA, 142 bp, Homo sapiens
  misc_feature: GYAE6OF02G8GC7.51.29.C07.1.454.CMB.1.raw
  modified_base (118)..(142): a, c, t, g, unknown or other
  misc_feature (118)..(142): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnnnnnnnnnnnnnnn

SEQ ID NO: 195425 - DNA, 130 bp, Homo sapiens
  misc_feature: GYAE6OF02F3QWX.51.29.C07.1.454.CMB.1.raw
  modified_base (117)..(130): a, c, t, g, unknown or other
  misc_feature (117)..(130): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnnnnnnnn

SEQ ID NO: 195426 - DNA, 117 bp, Homo sapiens; identical to SEQ ID NO: 194147
  misc_feature: GYAE6OF02ILLLX.51.29.C07.1.454.CMB.1.raw

SEQ ID NO: 195427 - DNA, 135 bp, Homo sapiens
  misc_feature: GYAE6OF02FLO20.51.29.C07.1.454.CMB.1.raw
  modified_base (119)..(135): a, c, t, g, unknown or other
  misc_feature (119)..(135): n is a, c, g, or t
tcagcgatcgtatacacgaccggtgctcgatttagagtgctacgaagggaaagggcagcgtcactctgttcccaccctcctctcgtagcactctgagcgggctggcaaggcgcattagnnnnnnnnnnnnnnnnn

SEQ ID NO: 195428 - DNA, 118 bp, Homo sapiens; identical to SEQ ID NO: 194139
  misc_feature: GYAE6OF02HD3T3.51.29.C07.1.454.CMB.1.raw
  modified_base (118)..(118): a, c, t, g, unknown or other
  misc_feature (118)..(118): n is a, c, g, or t

SEQ ID NO: 195429 - DNA, 119 bp, Homo sapiens; identical to SEQ ID NO: 194137
  misc_feature: GYAE6OF02GYYSY.51.29.C07.1.454.CMB.1.raw
  modified_base (118)..(119): a, c, t, g, unknown or other
  misc_feature (118)..(119): n is a, c, g, or t

SEQ ID NO: 195430 - DNA, 119 bp, Homo sapiens; identical to SEQ ID NO: 194137
  misc_feature: GYAE6OF02GMI2F.51.29.C07.1.454.CMB.1.raw
  modified_base (118)..(119): a, c, t, g, unknown or other
  misc_feature (118)..(119): n is a, c, g, or t

SEQ ID NO: 195431 - DNA, 208 bp, Homo sapiens
  misc_feature: GYAE6OF02HKQIZ.51.29.C07.1.454.CMB.1.raw
  modified_base (160)..(161): a, c, t, g, unknown or other
  misc_feature (160)..(161): n is a, c, g, or t
  modified_base (163)..(208): a, c, t, g, unknown or other
  misc_feature (163)..(208): n is a, c, g, or t
tcagcgatcgtatacacgaccggtgctcgatttagagtgctacgaagggaaaggggcacgaccggtcgctcgatttagagtgctacgaagggaaaggcagcgtcactctgtcccaccctcgtctcgtagcactctgagcggctgggcaaggcgcatagcnnannnnnnnnnnnnnnnnnnnnnnnnnnnnnnnnnnnnnnnnnnnnnn

SEQ ID NO: 195432 - DNA, 121 bp, Homo sapiens
  misc_feature: GYAE6OF02H8RUB.51.29.C07.1.454.CMB.1.raw
  modified_base (119)..(121): a, c, t, g, unknown or other
  misc_feature (119)..(121): n is a, c, g, or t
tcagcgatcgtatacacgaccggtgctcgatttagagtgctacgaagggaaagggcagcgtcactctgttcccaccctcctctcgtagcactctgagcgggctggacaaggcgcatagnnn

SEQ ID NO: 195433 - DNA, 118 bp, Homo sapiens; identical to SEQ ID NO: 194139
  misc_feature: GYAE6OF02FGUW1.51.29.C07.1.454.CMB.1.raw
  modified_base (118)..(118): a, c, t, g, unknown or other
  misc_feature (118)..(118): n is a, c, g, or t

SEQ ID NO: 195434 - DNA, 116 bp, Homo sapiens; identical to SEQ ID NO: 194269
  misc_feature: GYAE6OF02FLV8S.51.29.C07.1.454.CMB.1.raw

SEQ ID NO: 195435 - DNA, 129 bp, Homo sapiens; identical to SEQ ID NO: 194159
  misc_feature: GYAE6OF02HPQQH.51.29.C07.1.454.CMB.1.raw
  modified_base (118)..(129): a, c, t, g, unknown or other
  misc_feature (118)..(129): n is a, c, g, or t

SEQ ID NO: 195436 - DNA, 118 bp, Homo sapiens; identical to SEQ ID NO: 194139
  misc_feature: GYAE6OF02HFNUL.51.29.C07.1.454.CMB.1.raw
  modified_base (118)..(118): a, c, t, g, unknown or other
  misc_feature (118)..(118): n is a, c, g, or t

SEQ ID NO: 195437 - DNA, 118 bp, Homo sapiens
  misc_feature: GYAE6OF02IH4B3.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagtgtcactctgttcccgccctcctctcgtagcactctgagcgggctggcaaggcgcatagn

SEQ ID NO: 195438 - DNA, 119 bp, Homo sapiens; identical to SEQ ID NO: 194160
  misc_feature: GYAE6OF02G0K7T.51.29.C07.1.454.CMB.1.raw
  modified_base (118)..(119): a, c, t, g, unknown or other
  misc_feature (118)..(119): n is a, c, g, or t

SEQ ID NO: 195439 - DNA, 119 bp, Homo sapiens; identical to SEQ ID NO: 194137
  misc_feature: GYAE6OF02HRSIS.51.29.C07.1.454.CMB.1.raw
  modified_base (118)..(119): a, c, t, g, unknown or other
  misc_feature (118)..(119): n is a, c, g, or t

SEQ ID NO: 195440 - DNA, 120 bp, Homo sapiens; identical to SEQ ID NO: 194365
  misc_feature: GYAE6OF02GXQG0.51.29.C07.1.454.CMB.1.raw
  modified_base (118)..(120): a, c, t, g, unknown or other
  misc_feature (118)..(120): n is a, c, g, or t

SEQ ID NO: 195441 - DNA, 120 bp, Homo sapiens; identical to SEQ ID NO: 194365
  misc_feature: GYAE6OF02JHTXR.51.29.C07.1.454.CMB.1.raw
  modified_base (118)..(120): a, c, t, g, unknown or other
  misc_feature (118)..(120): n is a, c, g, or t

SEQ ID NO: 195442 - DNA, 117 bp, Homo sapiens; identical to SEQ ID NO: 194147
  misc_feature: GYAE6OF02I4Z48.51.29.C07.1.454.CMB.1.raw

SEQ ID NO: 195443 - DNA, 118 bp, Homo sapiens; identical to SEQ ID NO: 194139
  misc_feature: GYAE6OF02GXV2Q.51.29.C07.1.454.CMB.1.raw
  modified_base (118)..(118): a, c, t, g, unknown or other
  misc_feature (118)..(118): n is a, c, g, or t

SEQ ID NO: 195444 - DNA, 123 bp, Homo sapiens; identical to SEQ ID NO: 194390
  misc_feature: GYAE6OF02FL5Y4.51.29.C07.1.454.CMB.1.raw
  modified_base (118)..(123): a, c, t, g, unknown or other
  misc_feature (118)..(123): n is a, c, g, or t

SEQ ID NO: 195445 - DNA, 117 bp, Homo sapiens; identical to SEQ ID NO: 194206
  misc_feature: GYAE6OF02IKAJ5.51.29.C07.1.454.CMB.1.raw

SEQ ID NO: 195446 - DNA, 119 bp, Homo sapiens; identical to SEQ ID NO: 194160
  misc_feature: GYAE6OF02F6WRG.51.29.C07.1.454.CMB.1.raw
  modified_base (118)..(119): a, c, t, g, unknown or other
  misc_feature (118)..(119): n is a, c, g, or t

SEQ ID NO: 195447 - DNA, 158 bp, Homo sapiens
  misc_feature: GYAE6OF02FE91C.51.29.C07.1.454.CMB.1.raw
  modified_base (158)..(158): a, c, t, g, unknown or other
  misc_feature (158)..(158): n is a, c, g, or t
tcagcgatcgtatacacgaccggtgctcgatttagagtgctacgaagggaagggcacgaccggtgctcgatttagagtgctacgaagggaaagggcagcgtcactctgttcccaccctcctctcgtagcactctgagcgggctggcaaggcgcatagn

SEQ ID NO: 195448 - DNA, 131 bp, Homo sapiens; identical to SEQ ID NO: 194666
  misc_feature: GYAE6OF02IDWTZ.51.29.C07.1.454.CMB.1.raw
  modified_base (118)..(131): a, c, t, g, unknown or other
  misc_feature (118)..(131): n is a, c, g, or t

SEQ ID NO: 195449 - DNA, 123 bp, Homo sapiens
  misc_feature: GYAE6OF02JK4NN.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnnnnnn

SEQ ID NO: 195450 - DNA, 146 bp, Homo sapiens
  misc_feature: GYAE6OF02F9I4C.51.29.C07.1.454.CMB.1.raw
  modified_base (122)..(146): a, c, t, g, unknown or other
  misc_feature (122)..(146): n is a, c, g, or t
tcagcgatcgtatacacgaccggtgctcgatttagagtgctacgaagggaaagggcgagcgtcacctctgttcccgccctcctctcgtagcactctgagccgggctggcaaggcgcgatagnnnnnnnnnnnnnnnnnnnnnnnnn

SEQ ID NO: 195451 - DNA, 119 bp, Homo sapiens; identical to SEQ ID NO: 194160
  misc_feature: GYAE6OF02FIAMQ.51.29.C07.1.454.CMB.1.raw
  modified_base (118)..(119): a, c, t, g, unknown or other
  misc_feature (118)..(119): n is a, c, g, or t

SEQ ID NO: 195452 - DNA, 121 bp, Homo sapiens
  misc_feature: GYAE6OF02JH40I.51.29.C07.1.454.CMB.1.raw
  modified_base (120)..(121): a, c, t, g, unknown or other
  misc_feature (120)..(121): n is a, c, g, or t
tcagcgatcgtatacacgaccggtgctcgatttagagtgctacgaagggaaagggcagcgtcactctgttcccgccctcctctcgtagcactctgagcgggcgtggcgaaggcgcatagnn

SEQ ID NO: 195453 - DNA, 119 bp, Homo sapiens
  misc_feature: GYAE6OF02GNK60.51.29.C07.1.454.CMB.1.raw
  modified_base (118)..(119): a, c, t, g, unknown or other
  misc_feature (118)..(119): n is a, c, g, or t
tcagcgatcgtatacacgaccggtgctcgatttagagtgctacgaagggaaagggcagcgtcactctgtttccgccctcctctcgtagcactctgagcgggctggcaaggcgcatagnn

SEQ ID NO: 195454 - DNA, 125 bp, Homo sapiens; identical to SEQ ID NO: 195396
  misc_feature: GYAE6OF02GFF1U.51.29.C07.1.454.CMB.1.raw
  modified_base (118)..(125): a, c, t, g, unknown or other
  misc_feature (118)..(125): n is a, c, g, or t

SEQ ID NO: 195455 - DNA, 120 bp, Homo sapiens; identical to SEQ ID NO: 194365
  misc_feature: GYAE6OF02H61UK.51.29.C07.1.454.CMB.1.raw
  modified_base (118)..(120): a, c, t, g, unknown or other
  misc_feature (118)..(120): n is a, c, g, or t

SEQ ID NO: 195456 - DNA, 119 bp, Homo sapiens; identical to SEQ ID NO: 194160
  misc_feature: GYAE6OF02JCM4A.51.29.C07.1.454.CMB.1.raw
  modified_base (118)..(119): a, c, t, g, unknown or other
  misc_feature (118)..(119): n is a, c, g, or t

SEQ ID NO: 195457 - DNA, 119 bp, Homo sapiens; identical to SEQ ID NO: 194160
  misc_feature: GYAE6OF02GBCG8.51.29.C07.1.454.CMB.1.raw
  modified_base (118)..(119): a, c, t, g, unknown or other
  misc_feature (118)..(119): n is a, c, g, or t

SEQ ID NO: 195458 - DNA, 122 bp, Homo sapiens; identical to SEQ ID NO: 194769
  misc_feature: GYAE6OF02IGR51.51.29.C07.1.454.CMB.1.raw
  modified_base (112)..(112): a, c, t, g, unknown or other
  misc_feature (112)..(112): n is a, c, g, or t
  modified_base (118)..(122): a, c, t, g, unknown or other
  misc_feature (118)..(122): n is a, c, g, or t

SEQ ID NO: 195459 - DNA, 118 bp, Homo sapiens; identical to SEQ ID NO: 194139
  misc_feature: GYAE6OF02IHM5H.51.29.C07.1.454.CMB.1.raw
  modified_base (118)..(118): a, c, t, g, unknown or other
  misc_feature (118)..(118): n is a, c, g, or t

SEQ ID NO: 195460 - DNA, 118 bp, Homo sapiens
  misc_feature: GYAE6OF02I9FKF.51.29.C07.1.454.CMB.1.raw
  modified_base (117)..(118): a, c, t, g, unknown or other
  misc_feature (117)..(118): n is a, c, g, or t
tcagcgatcgtatacacgaccggtgctcgatttagagtgctacgaagggaaagggcagcgtcactctgttcccaccctcctctcgagcacctctgagcggctggcaaggcgcatagnn

SEQ ID NO: 195461 - DNA, 161 bp, Homo sapiens
  misc_feature: GYAE6OF02F5163.51.29.C07.1.454.CMB.1.raw
  modified_base (159)..(161): a, c, t, g, unknown or other
  misc_feature (159)..(161): n is a, c, g, or t
tcagcgatcgtatacacgaccggtgctcgatttagagtgctacgaagggaaagggcacgaccggtgctcgatttagagtgctacgaagggaaagggcagcgtcactctgttcccaccctcctctcgtagcactctgagcgggctggcaaggcgcatagnnn

SEQ ID NO: 195462 - DNA, 120 bp, Homo sapiens; identical to SEQ ID NO: 194289
  misc_feature: GYAE6OF02H9Q12.51.29.C07.1.454.CMB.1.raw
  modified_base (118)..(120): a, c, t, g, unknown or other
  misc_feature (118)..(120): n is a, c, g, or t

SEQ ID NO: 195463 - DNA, 120 bp, Homo sapiens; identical to SEQ ID NO: 194365
  misc_feature: GYAE6OF02GRW1X.51.29.C07.1.454.CMB.1.raw
  modified_base (118)..(120): a, c, t, g, unknown or other
  misc_feature (118)..(120): n is a, c, g, or t

SEQ ID NO: 195464 - DNA, 120 bp, Homo sapiens; identical to SEQ ID NO: 194365
  misc_feature: GYAE6OF02I4X8F.51.29.C07.1.454.CMB.1.raw
  modified_base (118)..(120): a, c, t, g, unknown or other
  misc_feature (118)..(120): n is a, c, g, or t

SEQ ID NO: 195465 - DNA, 121 bp, Homo sapiens
  misc_feature: GYAE6OF02GRERG.51.29.C07.1.454.CMB.1.raw
  modified_base (119)..(121): a, c, t, g, unknown or other
  misc_feature (119)..(121): n is a, c, g, or t
tcagcgatcgtatacacgaccggtgctcgatttagagtgctacgaagggaaagggcaggcgtcactctgttcccaccctcctctcgtagcactctgagcgggctggcaaggcgcatagnnn

SEQ ID NO: 195466 - DNA, 117 bp, Homo sapiens; identical to SEQ ID NO: 194206
  misc_feature: GYAE6OF02FJF0A.51.29.C07.1.454.CMB.1.raw

SEQ ID NO: 195467 - DNA, 130 bp, Homo sapiens; identical to SEQ ID NO: 195209
  misc_feature: GYAE6OF02HJTU5.51.29.C07.1.454.CMB.1.raw
  modified_base (118)..(130): a, c, t, g, unknown or other
  misc_feature (118)..(130): n is a, c, g, or t

SEQ ID NO: 195468 - DNA, 123 bp, Homo sapiens
  misc_feature: GYAE6OF02IJFEZ.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccgccctctctcgtagcactctgagcgggctggcaaggcgcatagnnnnnnn

SEQ ID NO: 195469 - DNA, 120 bp, Homo sapiens; identical to SEQ ID NO: 194289
  misc_feature: GYAE6OF02F97QT.51.29.C07.1.454.CMB.1.raw
  modified_base (118)..(120): a, c, t, g, unknown or other
  misc_feature (118)..(120): n is a, c, g, or t

SEQ ID NO: 195470 - DNA, 125 bp, Homo sapiens
  misc_feature: GYAE6OF02ILFZB.51.29.C07.1.454.CMB.1.raw
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnn

SEQ ID NO: 195471 - DNA, 117 bp, Homo sapiens; identical to SEQ ID NO: 194206
  misc_feature: GYAE6OF02GBOZ6.51.29.C07.1.454.CMB.1.raw

SEQ ID NO: 195472 - DNA, 119 bp, Homo sapiens; identical to SEQ ID NO: 194137
  misc_feature: GYAE6OF02G52WS.51.29.C07.1.454.CMB.1.raw
  modified_base (118)..(119): a, c, t, g, unknown or other
  misc_feature (118)..(119): n is a, c, g, or t

SEQ ID NO: 195473 - DNA, 118 bp, Homo sapiens; identical to SEQ ID NO: 194139
  misc_feature: GYAE6OF02HK4NS.51.29.C07.1.454.CMB.1.raw
  modified_base (118)..(118): a, c, t, g, unknown or other
  misc_feature (118)..(118): n is a, c, g, or t

SEQ ID NO: 195474 - DNA, 158 bp, Homo sapiens
  misc_feature: GYAE6OF02HY42E.51.29.C07.1.454.CMB.1.raw
tcagcgatcgtatacacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatag

SEQ ID NO: 195475 - DNA, 119 bp, Homo sapiens; identical to SEQ ID NO: 194186
  misc_feature: GYAE6OF02FKIRO.51.29.C07.1.454.CMB.1.raw
  modified_base (116)..(119): a, c, t, g, unknown or other
  misc_feature (116)..(119): n is a, c, g, or t

SEQ ID NO: 195476 - DNA, 118 bp, Homo sapiens; identical to SEQ ID NO: 194140
  misc_feature: GYAE6OF02IBV7Y.51.29.C07.1.454.CMB.1.raw
  modified_base (118)..(118): a, c, t, g, unknown or other
  misc_feature (118)..(118): n is a, c, g, or t

SEQ ID NO: 195477 - DNA, 123 bp, Homo sapiens; identical to SEQ ID NO: 194390
  misc_feature: GYAE6OF02I8IOX.51.29.C07.1.454.CMB.1.raw
  modified_base (118)..(123): a, c, t, g, unknown or other
  misc_feature (118)..(123): n is a, c, g, or t

SEQ ID NO: 195478 - DNA, 118 bp, Homo sapiens; identical to SEQ ID NO: 194140
  misc_feature: GYAE6OF02HVT6L.51.29.C07.1.454.CMB.1.raw
  modified_base (118)..(118): a, c, t, g, unknown or other
  misc_feature (118)..(118): n is a, c, g, or t

SEQ ID NO: 195479 - DNA, 118 bp, Homo sapiens; identical to SEQ ID NO: 194139
  misc_feature: GYAE6OF02H8LDT.51.29.C07.1.454.CMB.1.raw
  modified_base (118)..(118): a, c, t, g, unknown or other
  misc_feature (118)..(118): n is a, c, g, or t

SEQ ID NO: 195480 - DNA, 117 bp, Homo sapiens
  misc_feature: GYAE6OF02IZIMU.51.29.C07.1.454.CMB.1.raw
  modified_base (116)..(117): a, c, t, g, unknown or other
  misc_feature (116)..(117): n is a, c, g, or t
tcagcgatcgtatacacgaccggtgctcgatttagagtgctacgaagggaaagggcagcgtcactctgttcccacctcctctcgtagcactctgagcggctggcaaggcgcatagnn

SEQ ID NO: 195481 - DNA, 118 bp, Homo sapiens; identical to SEQ ID NO: 194140
  misc_feature: GYAE6OF02I57WX.51.29.C07.1.454.CMB.1.raw
  modified_base (118)..(118): a, c, t, g, unknown or other
  misc_feature (118)..(118): n is a, c, g, or t

SEQ ID NO: 195482 - DNA, 124 bp, Homo sapiens; identical to SEQ ID NO: 194227
  misc_feature: GYAE6OF02IRHB1.51.29.C07.1.454.CMB.1.raw
  modified_base (118)..(124): a, c, t, g, unknown or other
  misc_feature (118)..(124): n is a, c, g, or t

SEQ ID NO: 195483 - DNA, 118 bp, Homo sapiens
  misc_feature: GYAE6OF02HJXB5.51.29.C07.1.454.CMB.1.raw
  modified_base (118)..(118): a, c, t, g, unknown or other
  misc_feature (118)..(118): n is a, c, g, or t
tcagcgatcgtatacacgaccggtgctcgatttagagtgctacgaagggaaagggcagcgtcactctgttcccaccctcctctcgtaggactctgagcgggctggcaaggcgcatagn

SEQ ID NO: 195484 - DNA, 118 bp, Homo sapiens; identical to SEQ ID NO: 194140
  misc_feature: GYAE6OF02HTRL3.51.29.C07.1.454.CMB.1.raw
  modified_base (118)..(118): a, c, t, g, unknown or other
  misc_feature (118)..(118): n is a, c, g, or t

SEQ ID NO: 195485 - DNA, 118 bp, Homo sapiens; identical to SEQ ID NO: 195028
  misc_feature: GYAE6OF02FIR8O.51.29.C07.1.454.CMB.1.raw
  modified_base (117)..(118): a, c, t, g, unknown or other
  misc_feature (117)..(118): n is a, c, g, or t

SEQ ID NO: 195486 - DNA, 118 bp, Homo sapiens; identical to SEQ ID NO: 194140
  misc_feature: GYAE6OF02HL5M8.51.29.C07.1.454.CMB.1.raw
  modified_base (118)..(118): a, c, t, g, unknown or other
  misc_feature (118)..(118): n is a, c, g, or t

SEQ ID NO: 195487 - DNA, 117 bp, Homo sapiens; identical to SEQ ID NO: 194206
  misc_feature: GYAE6OF02FV712.51.29.C07.1.454.CMB.1.raw

SEQ ID NO: 195488 - DNA, 121 bp, Homo sapiens; identical to SEQ ID NO: 194352
  misc_feature: GYAE6OF02IGO2K.51.29.C07.1.454.CMB.1.raw
  modified_base (118)..(121): a, c, t, g, unknown or other
  misc_feature (118)..(121): n is a, c, g, or t

SEQ ID NO: 195489 - DNA, 118 bp, Homo sapiens; identical to SEQ ID NO: 194139
  misc_feature: GYAE6OF02HP6QP.51.29.C07.1.454.CMB.1.raw
  modified_base (118)..(118): a, c, t, g, unknown or other
  misc_feature (118)..(118): n is a, c, g, or t

SEQ ID NO: 195490 - DNA, 117 bp, Homo sapiens; identical to SEQ ID NO: 194147
  misc_feature: GYAE6OF02HGYA5.51.29.C07.1.454.CMB.1.raw

SEQ ID NO: 195491 - DNA, 119 bp, Homo sapiens; identical to SEQ ID NO: 194160
  misc_feature: GYAE6OF02IJ4T2.51.29.C07.1.454.CMB.1.raw
  modified_base (118)..(119): a, c, t, g, unknown or other
  misc_feature (118)..(119): n is a, c, g, or t

SEQ ID NO: 195492 - DNA, 154 bp, Homo sapiens
  misc_feature: GYAE6OF02GTH84.51.29.C07.1.454.CMB.1.raw
  modified_base (122)..(154): a, c, t, g, unknown or other
  misc_feature (122)..(154): n is a, c, g, or t
tcagcgatcgtatacacgaccggtgctcgatttagagtgctacgaagggaagggcagcgtcactctgttcccacccctcctcctcgtagccactcttgagtcgggctggcaaggcgcatagnnnnnnnnnnnnnnnnnnnnnnnnnnnnnnnnn

SEQ ID NO: 195493 - DNA, 129 bp, Homo sapiens
  misc_feature: GYAE6OF02H5GA3.51.29.C07.1.454.CMB.1.raw
  modified_base (117)..(129): a, c, t, g, unknown or other
  misc_feature (117)..(129): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnnnnnnn

SEQ ID NO: 195494 - DNA, 118 bp, Homo sapiens; identical to SEQ ID NO: 194140
  misc_feature: GYAE6OF02GCISE.51.29.C07.1.454.CMB.1.raw
  modified_base (118)..(118): a, c, t, g, unknown or other
  misc_feature (118)..(118): n is a, c, g, or t

SEQ ID NO: 195495 - DNA, 124 bp, Homo sapiens; identical to SEQ ID NO: 195366
  misc_feature: GYAE6OF02HZPZH.51.29.C07.1.454.CMB.1.raw
  modified_base (112)..(112): a, c, t, g, unknown or other
  misc_feature (112)..(112): n is a, c, g, or t
  modified_base (118)..(124): a, c, t, g, unknown or other
  misc_feature (118)..(124): n is a, c, g, or t

SEQ ID NO: 195496 - DNA, 120 bp, Homo sapiens; identical to SEQ ID NO: 194365
  misc_feature: GYAE6OF02HO4F9.51.29.C07.1.454.CMB.1.raw
  modified_base (118)..(120): a, c, t, g, unknown or other
  misc_feature (118)..(120): n is a, c, g, or t

SEQ ID NO: 195497 - DNA, 132 bp, Homo sapiens
  misc_feature: GYAE6OF02HF8CZ.51.29.C07.1.454.CMB.1.raw
  modified_base (117)..(132): a, c, t, g, unknown or other
  misc_feature (117)..(132): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnnnnnnnn

SEQ ID NO: 195498 - DNA, 132 bp, Homo sapiens; identical to SEQ ID NO: 194380
  misc_feature: GYAE6OF02I43GQ.51.29.C07.1.454.CMB.1.raw
  modified_base (118)..(132): a, c, t, g, unknown or other
  misc_feature (118)..(132): n is a, c, g, or t

SEQ ID NO: 195499 - DNA, 129 bp, Homo sapiens; identical to SEQ ID NO: 194159
  misc_feature: GYAE6OF02GAAUA.51.29.C07.1.454.CMB.1.raw
  modified_base (118)..(129): a, c, t, g, unknown or other
  misc_feature (118)..(129): n is a, c, g, or t

SEQ ID NO: 195500 - DNA, 124 bp, Homo sapiens; identical to SEQ ID NO: 195084
  misc_feature: GYAE6OF02G8DIN.51.29.C07.1.454.CMB.1.raw
  modified_base (117)..(124): a, c, t, g, unknown or other
  misc_feature (117)..(124): n is a, c, g, or t

SEQ ID NO: 195501 - DNA, 123 bp, Homo sapiens; identical to SEQ ID NO: 194390
  misc_feature: GYAE6OF02GENUU.51.29.C07.1.454.CMB.1.raw
  modified_base (118)..(123): a, c, t, g, unknown or other
  misc_feature (118)..(123): n is a, c, g, or t

SEQ ID NO: 195502 - DNA, 169 bp, Homo sapiens
  misc_feature: GYAE6OF02GY2M7.51.29.C07.1.454.CMB.1.raw
  modified_base (158)..(169): a, c, t, g, unknown or other
  misc_feature (158)..(169): n is a, c, g, or t
tcagcgatcgtatacacgaccggtgctcgatttagagtgctacgaagggaaagggcacgaccggtgctcgatttagagtgctacgaagggaaagggcagcgtcactctgttcccgcctcctctcgtagcactctgagcgggctggcaaggcgcatagnnnnnnnnnnnn

SEQ ID NO: 195503 - DNA, 133 bp, Homo sapiens
  misc_feature: GYAE6OF02IKXFR.51.29.C07.1.454.CMB.1.raw
  modified_base (113)..(113): a, c, t, g, unknown or other
  misc_feature (113)..(113): n is a, c, g, or t
  modified_base (119)..(133): a, c, t, g, unknown or other
  misc_feature (119)..(133): n is a, c, g, or t
tcagcgatcgtatacacgaccggtgctcgatttagagtgctacgaagggaaagggcgagcgtcactctgttcccgccctcctctcgtagcactctgagcgggctggcaaggcncatagnnnnnnnnnnnnnnn

SEQ ID NO: 195504 - DNA, 118 bp, Homo sapiens; identical to SEQ ID NO: 194139
  misc_feature: GYAE6OF02ILC1Z.51.29.C07.1.454.CMB.1.raw
  modified_base (118)..(118): a, c, t, g, unknown or other
  misc_feature (118)..(118): n is a, c, g, or t

SEQ ID NO: 195505 - DNA, 123 bp, Homo sapiens
  misc_feature: GYAE6OF02IUQD9.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnn

SEQ ID NO: 195506 - DNA, 119 bp, Homo sapiens
  misc_feature: GYAE6OF02F1SAN.51.29.C07.1.454.CMB.1.raw
  modified_base (116)..(119): a, c, t, g, unknown or other
  misc_feature (116)..(119): n is a, c, g, or t
tcagcgatcgtatacacgaccggtgctcgatttagagtgctacgaagggaagggcagcgtcactctgttcccaccctctctcgtagcactctgagcgggctggcaaggcgcatagnnnn

SEQ ID NO: 195507 - DNA, 125 bp, Homo sapiens; identical to SEQ ID NO: 194814
  misc_feature: GYAE6OF02ISYNQ.51.29.C07.1.454.CMB.1.raw
  modified_base (116)..(125): a, c, t, g, unknown or other
  misc_feature (116)..(125): n is a, c, g, or t

SEQ ID NO: 195508 - DNA, 122 bp, Homo sapiens; identical to SEQ ID NO: 194631
  misc_feature: GYAE6OF02GE7BA.51.29.C07.1.454.CMB.1.raw
  modified_base (118)..(122): a, c, t, g, unknown or other
  misc_feature (118)..(122): n is a, c, g, or t

SEQ ID NO: 195509 - DNA, 119 bp, Homo sapiens; identical to SEQ ID NO: 194160
  misc_feature: GYAE6OF02FNW10.51.29.C07.1.454.CMB.1.raw
  modified_base (118)..(119): a, c, t, g, unknown or other
  misc_feature (118)..(119): n is a, c, g, or t

SEQ ID NO: 195510 - DNA, 126 bp, Homo sapiens
  misc_feature: GYAE6OF02JKTRD.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcgagcgtcactctgttcccacctcctctcgtagcactctgagcggctggcaaggcgcatagnnnnnnnnnn

SEQ ID NO: 195511 - DNA, 125 bp, Homo sapiens; identical to SEQ ID NO: 195396
  misc_feature: GYAE6OF02G2D5R.51.29.C07.1.454.CMB.1.raw
  modified_base (118)..(125): a, c, t, g, unknown or other
  misc_feature (118)..(125): n is a, c, g, or t

SEQ ID NO: 195512 - DNA, 118 bp, Homo sapiens; identical to SEQ ID NO: 194139
  misc_feature: GYAE6OF02H8PPL.51.29.C07.1.454.CMB.1.raw
  modified_base (118)..(118): a, c, t, g, unknown or other
  misc_feature (118)..(118): n is a, c, g, or t

SEQ ID NO: 195513 - DNA, 117 bp, Homo sapiens; identical to SEQ ID NO: 194206
  misc_feature: GYAE6OF02F0EHK.51.29.C07.1.454.CMB.1.raw

SEQ ID NO: 195514 - DNA, 129 bp, Homo sapiens; identical to SEQ ID NO: 194276
  misc_feature: GYAE6OF02GWH9H.51.29.C07.1.454.CMB.1.raw
  modified_base (117)..(129): a, c, t, g, unknown or other
  misc_feature (117)..(129): n is a, c, g, or t

SEQ ID NO: 195515 - DNA, 127 bp, Homo sapiens; identical to SEQ ID NO: 194501
  misc_feature: GYAE6OF02GXJZL.51.29.C07.1.454.CMB.1.raw
  modified_base (118)..(127): a, c, t, g, unknown or other
  misc_feature (118)..(127): n is a, c, g, or t

SEQ ID NO: 195516 - DNA, 117 bp, Homo sapiens; identical to SEQ ID NO: 194206
  misc_feature: GYAE6OF02HOCI2.51.29.C07.1.454.CMB.1.raw

SEQ ID NO: 195517 - DNA, 119 bp, Homo sapiens; identical to SEQ ID NO: 194160
  misc_feature: GYAE6OF02F3MLC.51.29.C07.1.454.CMB.1.raw
  modified_base (118)..(119): a, c, t, g, unknown or other
  misc_feature (118)..(119): n is a, c, g, or t

SEQ ID NO: 195518 - DNA, 133 bp, Homo sapiens; identical to SEQ ID NO: 194323
  misc_feature: GYAE6OF02IJF7U.51.29.C07.1.454.CMB.1.raw
  modified_base (118)..(133): a, c, t, g, unknown or other
  misc_feature (118)..(133): n is a, c, g, or t

SEQ ID NO: 195519 - DNA, 124 bp, Homo sapiens; identical to SEQ ID NO: 194227
  misc_feature: GYAE6OF02JGR9S.51.29.C07.1.454.CMB.1.raw
  modified_base (118)..(124): a, c, t, g, unknown or other
  misc_feature (118)..(124): n is a, c, g, or t

SEQ ID NO: 195520 - DNA, 127 bp, Homo sapiens; identical to SEQ ID NO: 194501
  misc_feature: GYAE6OF02HDRV8.51.29.C07.1.454.CMB.1.raw
  modified_base (118)..(127): a, c, t, g, unknown or other
  misc_feature (118)..(127): n is a, c, g, or t

SEQ ID NO: 195521 - DNA, 122 bp, Homo sapiens; identical to SEQ ID NO: 194631
  misc_feature: GYAE6OF02JE0AA.51.29.C07.1.454.CMB.1.raw
  modified_base (118)..(122): a, c, t, g, unknown or other
  misc_feature (118)..(122): n is a, c, g, or t

SEQ ID NO: 195522 - DNA, 119 bp, Homo sapiens; identical to SEQ ID NO: 194160
  misc_feature: GYAE6OF02JHD3L.51.29.C07.1.454.CMB.1.raw
  modified_base (118)..(119): a, c, t, g, unknown or other
  misc_feature (118)..(119): n is a, c, g, or t

SEQ ID NO: 195523 - DNA, 128 bp, Homo sapiens; identical to SEQ ID NO: 194886
  misc_feature: GYAE6OF02G5D9B.51.29.C07.1.454.CMB.1.raw
  modified_base (118)..(128): a, c, t, g, unknown or other
  misc_feature (118)..(128): n is a, c, g, or t

SEQ ID NO: 195524 - DNA, 126 bp, Homo sapiens
  misc_feature: GYAE6OF02G3SL8.51.29.C07.1.454.CMB.1.raw
  modified_base (119)..(126): a, c, t, g, unknown or other
  misc_feature (119)..(126): n is a, c, g, or t
tcagcgatcgtatacacgaccggtgctcgatttagagtgctacgaagggaaagggcagcgtcactctgttcccgccctcctctccgtagcactctgagcgggctggcaaggcgcatagnnnnnnnn

SEQ ID NO: 195525 - DNA, 121 bp, Homo sapiens; identical to SEQ ID NO: 195100
  misc_feature: GYAE6OF02HVGCF.51.29.C07.1.454.CMB.1.raw
  modified_base (117)..(121): a, c, t, g, unknown or other
  misc_feature (117)..(121): n is a, c, g, or t

SEQ ID NO: 195526 - DNA, 117 bp, Homo sapiens; identical to SEQ ID NO: 194206
  misc_feature: GYAE6OF02GVFGN.51.29.C07.1.454.CMB.1.raw

SEQ ID NO: 195527 - DNA, 130 bp, Homo sapiens
  misc_feature: GYAE6OF02J1P3U.51.29.C07.1.454.CMB.1.raw
  modified_base (109)..(109): a, c, t, g, unknown or other
  misc_feature (109)..(109): n is a, c, g, or t
  modified_base (115)..(130): a, c, t, g, unknown or other
  misc_feature (115)..(130): n is a, c, g, or t
tcagcgatcgtatacacgaccggtgctcgatttagagtgctacgaagggaagggcagcgtcactctgttcccacctcctctcgtagcactctgagcggctggcaaggcncatagnnnnnnnnnnnnnnnn

SEQ ID NO: 195528 - DNA, 125 bp, Homo sapiens
  misc_feature: GYAE6OF02JMC1L.51.29.C07.1.454.CMB.1.raw
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnn

SEQ ID NO: 195529 - DNA, 120 bp, Homo sapiens; identical to SEQ ID NO: 194289
  misc_feature: GYAE6OF02GYV53.51.29.C07.1.454.CMB.1.raw
  modified_base (118)..(120): a, c, t, g, unknown or other
  misc_feature (118)..(120): n is a, c, g, or t

SEQ ID NO: 195530 - DNA, 122 bp, Homo sapiens
  misc_feature: GYAE6OF02HLTW2.51.29.C07.1.454.CMB.1.raw
  modified_base (118)..(122): a, c, t, g, unknown or other
  misc_feature (118)..(122): n is a, c, g, or t
tcagcgatcgtatacacgaccggtgctcgatttagagtgctacgaagggaaagggcagtgtcactctgttcccgccctcctctcgtagcactctgagcgggctggcaaggcgcatagnnnnn

SEQ ID NO: 195531 - DNA, 127 bp, Homo sapiens; identical to SEQ ID NO: 194501
  misc_feature: GYAE6OF02GKQHY.51.29.C07.1.454.CMB.1.raw
  modified_base (118)..(127): a, c, t, g, unknown or other
  misc_feature (118)..(127): n is a, c, g, or t

SEQ ID NO: 195532 - DNA, 123 bp, Homo sapiens; identical to SEQ ID NO: 194390
  misc_feature: GYAE6OF02II9RF.51.29.C07.1.454.CMB.1.raw
  modified_base (118)..(123): a, c, t, g, unknown or other
  misc_feature (118)..(123): n is a, c, g, or t

SEQ ID NO: 195533 - DNA, 117 bp, Homo sapiens; identical to SEQ ID NO: 194147
  misc_feature: GYAE6OF02GE047.51.29.C07.1.454.CMB.1.raw

SEQ ID NO: 195534 - DNA, 129 bp, Homo sapiens
  misc_feature: GYAE6OF02F7XFT.51.29.C07.1.454.CMB.1.raw
  modified_base (109)..(109): a, c, t, g, unknown or other
  misc_feature (109)..(109): n is a, c, g, or t
  modified_base (115)..(129): a, c, t, g, unknown or other
  misc_feature (115)..(129): n is a, c, g, or t
tcagcgatcgtatacacgaccggtgctcgatttagagtgctacgaagggaagggcagcgtcactctgttcccacctctctcgtagcactctgagcgggctggcaaggcncatagnnnnnnnnnnnnnnn

SEQ ID NO: 195535 - DNA, 126 bp, Homo sapiens
  misc_feature: GYAE6OF02H9FYP.51.29.C07.1.454.CMB.1.raw
  modified_base (122)..(126): a, c, t, g, unknown or other
  misc_feature (122)..(126): n is a, c, g, or t
tcagcgatcgtatacacgaccggtgctcgatttagagtgctacgaagggaaagggcagcgtcactctgttcccaccctcctctcgtagcactctgaggcggctggacaaggcgctaagtagnnnnn

SEQ ID NO: 195536 - DNA, 132 bp, Homo sapiens
  misc_feature: GYAE6OF02IVGHH.51.29.C07.1.454.CMB.1.raw
  modified_base (112)..(112): a, c, t, g, unknown or other
  misc_feature (112)..(112): n is a, c, g, or t
  modified_base (118)..(132): a, c, t, g, unknown or other
  misc_feature (118)..(132): n is a, c, g, or t
tcagcgatcgtatacacgaccggtgctcgatttagagtgctacgaagggaaagggcagcgtcactctgttcccaccctcctctcgtagcactctgagcgggctggcaaggcncatagnnnnnnnnnnnnnnn

SEQ ID NO: 195537 - DNA, 123 bp, Homo sapiens
  misc_feature: GYAE6OF02I5AFN.51.29.C07.1.454.CMB.1.raw
  modified_base (117)..(123): a, c, t, g, unknown or other
  misc_feature (117)..(123): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnn

SEQ ID NO: 195538 - DNA, 118 bp, Homo sapiens; identical to SEQ ID NO: 194139
  misc_feature: GYAE6OF02G82A0.51.29.C07.1.454.CMB.1.raw
  modified_base (118)..(118): a, c, t, g, unknown or other
  misc_feature (118)..(118): n is a, c, g, or t

SEQ ID NO: 195539 - DNA, 127 bp, Homo sapiens; identical to SEQ ID NO: 194501
  misc_feature: GYAE6OF02HROFW.51.29.C07.1.454.CMB.1.raw
  modified_base (118)..(127): a, c, t, g, unknown or other
  misc_feature (118)..(127): n is a, c, g, or t

SEQ ID NO: 195540 - DNA, 121 bp, Homo sapiens; identical to SEQ ID NO: 194651
  misc_feature: GYAE6OF02GESTP.51.29.C07.1.454.CMB.1.raw
  modified_base (118)..(121): a, c, t, g, unknown or other
  misc_feature (118)..(121): n is a, c, g, or t

SEQ ID NO: 195541 - DNA, 128 bp, Homo sapiens
  misc_feature: GYAE6OF02GTSHL.51.29.C07.1.454.CMB.1.raw
  modified_base (117)..(128): a, c, t, g, unknown or other
  misc_feature (117)..(128): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnnnnn

SEQ ID NO: 195542 - DNA, 117 bp, Homo sapiens; identical to SEQ ID NO: 194147
  misc_feature: GYAE6OF02GRWBV.51.29.C07.1.454.CMB.1.raw

SEQ ID NO: 195543 - DNA, 118 bp, Homo sapiens; identical to SEQ ID NO: 194139
  misc_feature: GYAE6OF02GUPFY.51.29.C07.1.454.CMB.1.raw
  modified_base (118)..(118): a, c, t, g, unknown or other
  misc_feature (118)..(118): n is a, c, g, or t

SEQ ID NO: 195544 - DNA, 127 bp, Homo sapiens
  misc_feature: GYAE6OF02FII8T.51.29.C07.1.454.CMB.1.raw
  modified_base (111)..(111): a, c, t, g, unknown or other
  misc_feature (111)..(111): n is a, c, g, or t
  modified_base (117)..(127): a, c, t, g, unknown or other
  misc_feature (117)..(127): n is a, c, g, or t
tcagcgatcgtatacacgaccggtgctcgatttagagtgctacgaagggaagggcagcgtcactctgttcccaccctcctctcgtagcactctgagcgggctggcaaggcncatagnnnnnnnnnnn

SEQ ID NO: 195545 - DNA, 135 bp, Homo sapiens
  misc_feature: GYAE6OF02FI7XV.51.29.C07.1.454.CMB.1.raw
  modified_base (112)..(112): a, c, t, g, unknown or other
  misc_feature (112)..(112): n is a, c, g, or t
  modified_base (118)..(135): a, c, t, g, unknown or other
  misc_feature (118)..(135): n is a, c, g, or t
tcagcgatcgtatacacgaccggtgctcgatttagagtgctacgaagggaaaggggcagcgtcactctgttcccaccctctctcgtagcactctgagcgggctggcaaggcncatagnnnnnnnnnnnnnnnnnn

SEQ ID NO: 195546 - DNA, 135 bp, Homo sapiens
  misc_feature: GYAE6OF02GXK8J.51.29.C07.1.454.CMB.1.raw
  modified_base (118)..(135): a, c, t, g, unknown or other
  misc_feature (118)..(135): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnn

SEQ ID NO: 195547 - DNA, 129 bp, Homo sapiens
  misc_feature: GYAE6OF02I096D.51.29.C07.1.454.CMB.1.raw
  modified_base (116)..(129): a, c, t, g, unknown or other
  misc_feature (116)..(129): n is a, c, g, or t
tcagcgatcgtatacacgaccggtgctcgatttagagtgctacgaagggaagggcagcgtcactctgttcccacctcctctcgtagcactctgagcggctggccaaggcgcatagnnnnnnnnnnnnnn

SEQ ID NO: 195548 - DNA, 122 bp, Homo sapiens; identical to SEQ ID NO: 195017
  misc_feature: GYAE6OF02FHKIV.51.29.C07.1.454.CMB.1.raw
  modified_base (117)..(122): a, c, t, g, unknown or other
  misc_feature (117)..(122): n is a, c, g, or t

SEQ ID NO: 195549 - DNA, 121 bp, Homo sapiens; identical to SEQ ID NO: 194352
  misc_feature: GYAE6OF02JVECQ.51.29.C07.1.454.CMB.1.raw
  modified_base (118)..(121): a, c, t, g, unknown or other
  misc_feature (118)..(121): n is a, c, g, or t

SEQ ID NO: 195550 - DNA, 117 bp, Homo sapiens; identical to SEQ ID NO: 194147
  misc_feature: GYAE6OF02FLAMM.51.29.C07.1.454.CMB.1.raw

SEQ ID NO: 195551 - DNA, 126 bp, Homo sapiens; identical to SEQ ID NO: 194834
  misc_feature: GYAE6OF02GLRJN.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t

SEQ ID NO: 195552 - DNA, 168 bp, Homo sapiens
  misc_feature: GYAE6OF02INM7T.51.29.C07.1.454.CMB.1.raw
  modified_base (80)..(80): a, c, t, g, unknown or other
  misc_feature (80)..(80): n is a, c, g, or t
  modified_base (118)..(122): a, c, t, g, unknown or other
  misc_feature (118)..(122): n is a, c, g, or t
  modified_base (124)..(168): a, c, t, g, unknown or other
  misc_feature (124)..(168): n is a, c, g, or t
tcagcgatcgtatacacgaccggtgctcgatttagagtgctacgaagggaaagggcagcggtcactctgttcccgccctntcgtaggcactctgagcgggctggccaaggcgcatagnnnnntnnnnnnnnnnnnnnnnnnnnnnnnnnnnnnnnnnnnnnnnnnnnn

SEQ ID NO: 195553 - DNA, 148 bp, Homo sapiens
  misc_feature: GYAE6OF02GG8UN.51.29.C07.1.454.CMB.1.raw
  modified_base (118)..(148): a, c, t, g, unknown or other
  misc_feature (118)..(148): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnnnnnnn

SEQ ID NO: 195554 - DNA, 117 bp, Homo sapiens; identical to SEQ ID NO: 194206
  misc_feature: GYAE6OF02FT4YN.51.29.C07.1.454.CMB.1.raw

SEQ ID NO: 195555 - DNA, 143 bp, Homo sapiens
  misc_feature: GYAE6OF02IV4XH.51.29.C07.1.454.CMB.1.raw
  modified_base (119)..(120): a, c, t, g, unknown or other
  misc_feature (119)..(120): n is a, c, g, or t
  modified_base (122)..(143): a, c, t, g, unknown or other
  misc_feature (122)..(143): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagcnnannnnnnnnnnnnnnnnnnnnnn

SEQ ID NO: 195556 - DNA, 138 bp, Homo sapiens
  misc_feature: GYAE6OF02I25SW.51.29.C07.1.454.CMB.1.raw
  modified_base (112)..(112): a, c, t, g, unknown or other
  misc_feature (112)..(112): n is a, c, g, or t
  modified_base (118)..(138): a, c, t, g, unknown or other
  misc_feature (118)..(138): n is a, c, g, or t
tcagcgatcgtatacacgaccggtgctcgatttagagtgctacgaagggaaaggggcagcgtcactctgttcccaccctcctctcgtagcactctgagcggctggcaaggcncatagnnnnnnnnnnnnnnnnnnnnn

SEQ ID NO: 195557 - DNA, 117 bp, Homo sapiens; identical to SEQ ID NO: 194206
  misc_feature: GYAE6OF02F4KZQ.51.29.C07.1.454.CMB.1.raw

SEQ ID NO: 195558 - DNA, 117 bp, Homo sapiens; identical to SEQ ID NO: 194206
  misc_feature: GYAE6OF02GMI5F.51.29.C07.1.454.CMB.1.raw

SEQ ID NO: 195559 - DNA, 176 bp, Homo sapiens
  misc_feature: GYAE6OF02GBDLQ.51.29.C07.1.454.CMB.1.raw
  modified_base (160)..(176): a, c, t, g, unknown or other
  misc_feature (160)..(176): n is a, c, g, or t
tcagcgatcgtatacacgaccggtgctcgatttagagtgctacgaagggaaagggcacgaccggtgctcgatttagagtgctacgaagggaaagggcagcgtcactctgttcccgccctcctctcgtagcactctgagcgggctggcaaggtcgcatagnnnnnnnnnnnnnnnnn

SEQ ID NO: 195560 - DNA, 126 bp, Homo sapiens
  misc_feature: GYAE6OF02HYKVR.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttcccaccctcctctcgtagcactctgagcggctggcaaggcgcatagnnnnnnnnnn

SEQ ID NO: 195561 - DNA, 119 bp, Homo sapiens; identical to SEQ ID NO: 194137
  misc_feature: GYAE6OF02IRIUC.51.29.C07.1.454.CMB.1.raw
  modified_base (118)..(119): a, c, t, g, unknown or other
  misc_feature (118)..(119): n is a, c, g, or t

SEQ ID NO: 195562 - DNA, 132 bp, Homo sapiens; identical to SEQ ID NO: 195497
  misc_feature: GYAE6OF02HQG28.51.29.C07.1.454.CMB.1.raw
  modified_base (117)..(132): a, c, t, g, unknown or other
  misc_feature (117)..(132): n is a, c, g, or t

SEQ ID NO: 195563 - DNA, 129 bp, Homo sapiens; identical to SEQ ID NO: 195493
  misc_feature: GYAE6OF02FWV6J.51.29.C07.1.454.CMB.1.raw
  modified_base (117)..(129): a, c, t, g, unknown or other
  misc_feature (117)..(129): n is a, c, g, or t

SEQ ID NO: 195564 - DNA, 149 bp, Homo sapiens
  misc_feature: GYAE6OF02GPL48.51.29.C07.1.454.CMB.1.raw
  modified_base (120)..(149): a, c, t, g, unknown or other
  misc_feature (120)..(149): n is a, c, g, or t
tcagcgatcgtatacacgaccggtgctcgatttagagtgctacgaagggaaagggcagcggtcacgtctgttcccgccctcctctcgtagcactctgagcgggctggcaaggcgcatagnnnnnnnnnnnnnnnnnnnnnnnnnnnnnn

SEQ ID NO: 195565 - DNA, 150 bp, Homo sapiens
  misc_feature: GYAE6OF02HQ3DR.51.29.C07.1.454.CMB.1.raw
  modified_base (118)..(150): a, c, t, g, unknown or other
  misc_feature (118)..(150): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnnnnnnnnn

SEQ ID NO: 195566 - DNA, 122 bp, Homo sapiens; identical to SEQ ID NO: 194709
  misc_feature: GYAE6OF02G550R.51.29.C07.1.454.CMB.1.raw
  modified_base (118)..(122): a, c, t, g, unknown or other
  misc_feature (118)..(122): n is a, c, g, or t

SEQ ID NO: 195567 - DNA, 137 bp, Homo sapiens
  misc_feature: GYAE6OF02IW61M.51.29.C07.1.454.CMB.1.raw
  modified_base (111)..(111): a, c, t, g, unknown or other
  misc_feature (111)..(111): n is a, c, g, or t
  modified_base (117)..(137): a, c, t, g, unknown or other
  misc_feature (117)..(137): n is a, c, g, or t
tcagcgatcgtatacacgaccggtgctcgatttagagtgctacgaagggaaagggcagcgtcactctgttcccacctcctctcgtagcactctgagcgggctggcaaggcncatagnnnnnnnnnnnnnnnnnnnnn

SEQ ID NO: 195568 - DNA, 118 bp, Homo sapiens; identical to SEQ ID NO: 194140
  misc_feature: GYAE6OF02IQOT4.51.29.C07.1.454.CMB.1.raw
  modified_base (118)..(118): a, c, t, g, unknown or other
  misc_feature (118)..(118): n is a, c, g, or t

SEQ ID NO: 195569 - DNA, 117 bp, Homo sapiens; identical to SEQ ID NO: 194147
  misc_feature: GYAE6OF02IEYW0.51.29.C07.1.454.CMB.1.raw

SEQ ID NO: 195570 - DNA, 125 bp, Homo sapiens; identical to SEQ ID NO: 195396
  misc_feature: GYAE6OF02FN45O.51.29.C07.1.454.CMB.1.raw
  modified_base (118)..(125): a, c, t, g, unknown or other
  misc_feature (118)..(125): n is a, c, g, or t

SEQ ID NO: 195571 - DNA, 126 bp, Homo sapiens
  misc_feature: GYAE6OF02GNNKG.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnnn

SEQ ID NO: 195572 - DNA, 117 bp, Homo sapiens
  misc_feature: GYAE6OF02F99YO.51.29.C07.1.454.CMB.1.raw
  modified_base (117)..(117): a, c, t, g, unknown or other
  misc_feature (117)..(117): n is a, c, g, or t
tcagcgatcgtatacacgaccggtgctcgatttagagtgctacgaagggaaagggcagcgtcactctgttcccgccctctctcgtagcactctgagcgggctggcaaggcgcatagn

SEQ ID NO: 195573 - DNA, 134 bp, Homo sapiens; identical to SEQ ID NO: 194772
  misc_feature: GYAE6OF02FKQO1.51.29.C07.1.454.CMB.1.raw
  modified_base (118)..(134): a, c, t, g, unknown or other
  misc_feature (118)..(134): n is a, c, g, or t

SEQ ID NO: 195574 - DNA, 119 bp, Homo sapiens; identical to SEQ ID NO: 194160
  misc_feature: GYAE6OF02FXTHM.51.29.C07.1.454.CMB.1.raw
  modified_base (118)..(119): a, c, t, g, unknown or other
  misc_feature (118)..(119): n is a, c, g, or t

SEQ ID NO: 195575 - DNA, 114 bp, Homo sapiens
  misc_feature: GYAE6OF02I7TAO.51.29.C07.1.454.CMB.1.raw
  modified_base (109)..(109): a, c, t, g, unknown or other
  misc_feature (109)..(109): n is a, c, g, or t
tcagcgatcgtatacacgaccggtgctcgatttagagtgctacgaagggaaagggcagcgtcactctgttcccacctctctcgtagcactctgagcggctggcaaggcncatag

SEQ ID NO: 195576 - DNA, 149 bp, Homo sapiens
  misc_feature: GYAE6OF02G8740.51.29.C07.1.454.CMB.1.raw
  modified_base (118)..(149): a, c, t, g, unknown or other
  misc_feature (118)..(149): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnnnnnnnn

SEQ ID NO: 195577 - DNA, 123 bp, Homo sapiens; identical to SEQ ID NO: 194855
  misc_feature: GYAE6OF02HI8J4.51.29.C07.1.454.CMB.1.raw
  modified_base (112)..(112): a, c, t, g, unknown or other
  misc_feature (112)..(112): n is a, c, g, or t
  modified_base (118)..(123): a, c, t, g, unknown or other
  misc_feature (118)..(123): n is a, c, g, or t

SEQ ID NO: 195578 - DNA, 118 bp, Homo sapiens; identical to SEQ ID NO: 194139
  misc_feature: GYAE6OF02I14PB.51.29.C07.1.454.CMB.1.raw
  modified_base (118)..(118): a, c, t, g, unknown or other
  misc_feature (118)..(118): n is a, c, g, or t

SEQ ID NO: 195579 - DNA, 120 bp, Homo sapiens; identical to SEQ ID NO: 194365
  misc_feature: GYAE6OF02HB810.51.29.C07.1.454.CMB.1.raw
  modified_base (118)..(120): a, c, t, g, unknown or other
  misc_feature (118)..(120): n is a, c, g, or t

SEQ ID NO: 195580 - DNA, 119 bp, Homo sapiens; identical to SEQ ID NO: 194160
  misc_feature: GYAE6OF02GPNI0.51.29.C07.1.454.CMB.1.raw
  modified_base (118)..(119): a, c, t, g, unknown or other
  misc_feature (118)..(119): n is a, c, g, or t

SEQ ID NO: 195581 - DNA, 126 bp, Homo sapiens
  misc_feature: GYAE6OF02FN913.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttccaccctcctctcgtagcactctgagcgggctggcaaggcgcatagnnnnnnnnnn

SEQ ID NO: 195582 - DNA, 119 bp, Homo sapiens; identical to SEQ ID NO: 194160
  misc_feature: GYAE6OF02HFKKT.51.29.C07.1.454.CMB.1.raw
  modified_base (118)..(119): a, c, t, g, unknown or other
  misc_feature (118)..(119): n is a, c, g, or t

SEQ ID NO: 195583 - DNA, 142 bp, Homo sapiens
  misc_feature: GYAE6OF02HTL0E.51.29.C07.1.454.CMB.1.raw
  modified_base (120)..(142): a, c, t, g, unknown or other
  misc_feature (120)..(142): n is a, c, g, or t
tcagcgatcgtatacacgaccggtgctcgatttagagtgctacgaagggaaagggcaggcgtcactcctgttcccaccctcctctcgtagcactctgagcgggctggcaaggcgcatagnnnnnnnnnnnnnnnnnnnnnnn

SEQ ID NO: 195584 - DNA, 129 bp, Homo sapiens
  misc_feature: GYAE6OF02G7AUZ.51.29.C07.1.454.CMB.1.raw
  modified_base (111)..(111): a, c, t, g, unknown or other
  misc_feature (111)..(111): n is a, c, g, or t
  modified_base (117)..(129): a, c, t, g, unknown or other
  misc_feature (117)..(129): n is a, c, g, or t
tcagcgatcgtatacacgaccggtgctcgatttagagtgctacgaagggaaagggcagcgtcactctgttcccaccctctctcgtagcactctgagcgggctggcaaggcncatagnnnnnnnnnnnnn

SEQ ID NO: 195585 - DNA, 131 bp, Homo sapiens
  misc_feature: GYAE6OF02G3TU6.51.29.C07.1.454.CMB.1.raw
  modified_base (111)..(111): a, c, t, g, unknown or other
  misc_feature (111)..(111): n is a, c, g, or t
  modified_base (117)..(131): a, c, t, g, unknown or other
  misc_feature (117)..(131): n is a, c, g, or t
tcagcgatcgtatacacgaccggtgctcgatttagagtgctacgaagggaagggcagcgtcactctgttcccaccctcctctcgtagcactctgagcgggctggcaaggcncatagnnnnnnnnnnnnnnn

SEQ ID NO: 195586 - DNA, 120 bp, Homo sapiens; identical to SEQ ID NO: 194365
  misc_feature: GYAE6OF02ICTMW.51.29.C07.1.454.CMB.1.raw
  modified_base (118)..(120): a, c, t, g, unknown or other
  misc_feature (118)..(120): n is a, c, g, or t

SEQ ID NO: 195587 - DNA, 154 bp, Homo sapiens
  misc_feature: GYAE6OF02IWF0M.51.29.C07.1.454.CMB.1.raw
  modified_base (117)..(154): a, c, t, g, unknown or other
  misc_feature (117)..(154): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnnnnnnnnnnnnnnnnnnnnnnnnnnnnnnnn

SEQ ID NO: 195588 - DNA, 130 bp, Homo sapiens
  misc_feature: GYAE6OF02I797G.51.29.C07.1.454.CMB.1.raw
  modified_base (117)..(130): a, c, t, g, unknown or other
  misc_feature (117)..(130): n is a, c, g, or t
tcagcgatcgtatacacgaccggtgctcgatttagagtgctacgaagggaaagggcagcgtcactctgttcccacctcctctcgtagcactctgagcgggctggcaaggcgcatagnnnnnnnnnnnnnn

SEQ ID NO: 195589 - DNA, 126 bp, Homo sapiens
  misc_feature: GYAE6OF02FJHD2.51.29.C07.1.454.CMB.1.raw
  modified_base (119)..(126): a, c, t, g, unknown or other
  misc_feature (119)..(126): n is a, c, g, or t
tcagcgatcgtatacacgaccggtgctcgatttagagtgctacgaagggaaagggcgagcgtcactctgttcccaccctcctctcgtagcactctgagcgggctggcaaggcgcatagnnnnnnnn

SEQ ID NO: 195590 - DNA, 207 bp, Homo sapiens
  misc_feature: GYAE6OF02GJEH0.51.29.C07.1.454.CMB.1.raw
  modified_base (108)..(108): a, c, t, g, unknown or other
  misc_feature (108)..(108): n is a, c, g, or t
  modified_base (127)..(128): a, c, t, g, unknown or other
  misc_feature (127)..(128): n is a, c, g, or t
  modified_base (131)..(134): a, c, t, g, unknown or other
  misc_feature (131)..(134): n is a, c, g, or t
  modified_base (136)..(207): a, c, t, g, unknown or other
  misc_feature (136)..(207): n is a, c, g, or t
tcagcgatcgtatacacgaccggtgctcgatttagagtgctacgaagggaaaggggcaagcgtcactctgttccccaccctcctctcgtaggcacctcagcggcggtntcgacgacggccatatagnngcnnnncnnnnnnnnnnnnnnnnnnnnnnnnnnnnnnnnnnnnnnnnnnnnnnnnnnnnnnnnnnnnnnnnnnnnnnnn

SEQ ID NO: 195591 - DNA, 126 bp, Homo sapiens
  misc_feature: GYAE6OF02IQ0QH.51.29.C07.1.454.CMB.1.raw
  modified_base (117)..(126): a, c, t, g, unknown or other
  misc_feature (117)..(126): n is a, c, g, or t
tcagcgatcgtatacacgaccggtgctcgatttagagtgctacgaagggaaagggcagcgtcactctgttccacctcctctcgtagcactctgagcgggctaggcaaggtcgcatgnnnnnnnnnn

SEQ ID NO: 195592 - DNA, 122 bp, Homo sapiens
  misc_feature: GYAE6OF02JNEV9.51.29.C07.1.454.CMB.1.raw
  modified_base (111)..(111): a, c, t, g, unknown or other
  misc_feature (111)..(111): n is a, c, g, or t
  modified_base (117)..(122): a, c, t, g, unknown or other
  misc_feature (117)..(122): n is a, c, g, or t
tcagcgatcgtatacacgaccggtgctcgatttagagtgctacgaagggaaagggcagcgtcactctgttcccacctcctctcgtagcactctgagcgggctggcaaggcncatagnnnnnn

SEQ ID NO: 195593 - DNA, 120 bp, Homo sapiens; identical to SEQ ID NO: 194289
  misc_feature: GYAE6OF02F2B2O.51.29.C07.1.454.CMB.1.raw
  modified_base (118)..(120): a, c, t, g, unknown or other
  misc_feature (118)..(120): n is a, c, g, or t

SEQ ID NO: 195594 - DNA, 122 bp, Homo sapiens; identical to SEQ ID NO: 194709
  misc_feature: GYAE6OF02IEPK5.51.29.C07.1.454.CMB.1.raw
  modified_base (118)..(122): a, c, t, g, unknown or other
  misc_feature (118)..(122): n is a, c, g, or t

SEQ ID NO: 195595 - DNA, 133 bp, Homo sapiens; identical to SEQ ID NO: 195147
  misc_feature: GYAE6OF02H2JC3.51.29.C07.1.454.CMB.1.raw
  modified_base (117)..(133): a, c, t, g, unknown or other
  misc_feature (117)..(133): n is a, c, g, or t

SEQ ID NO: 195596 - DNA, 214 bp, Homo sapiens
  misc_feature: GYAE6OF02G3GZ0.51.29.C07.1.454.CMB.1.raw
  modified_base (125)..(125): a, c, t, g, unknown or other
  misc_feature (125)..(125): n is a, c, g, or t
  modified_base (127)..(127): a, c, t, g, unknown or other
  misc_feature (127)..(127): n is a, c, g, or t
  modified_base (129)..(131): a, c, t, g, unknown or other
  misc_feature (129)..(131): n is a, c, g, or t
  modified_base (134)..(134): a, c, t, g, unknown or other
  misc_feature (134)..(134): n is a, c, g, or t
  modified_base (138)..(214): a, c, t, g, unknown or other
  misc_feature (138)..(214): n is a, c, g, or t
tcagcgatcgtatacacgaccggtgctcgattttagagtgctacgaagggaaaggggcgagcgtcactctgttccccaccctcctcgtcgtagcacttctgagcgggctggccaaggcgcatagngncnnntcntgcnnnnnnnnnnnnnnnnnnnnnnnnnnnnnnnnnnnnnnnnnnnnnnnnnnnnnnnnnnnnnnnnnnnnnnnnnnnnn

SEQ ID NO: 195597 - DNA, 145 bp, Homo sapiens
  misc_feature: GYAE6OF02HXZ4V.51.29.C07.1.454.CMB.1.raw
  modified_base (121)..(145): a, c, t, g, unknown or other
  misc_feature (121)..(145): n is a, c, g, or t
tcagcgatcgtatacacgaccggtgctcgatttagagtgctacgaagggaaaggggcagcgtcactctgttcccaccctcctctcgtagcactctgacgcgggctggcaagggcgcatagnnnnnnnnnnnnnnnnnnnnnnnnn

SEQ ID NO: 195598 - DNA, 134 bp, Homo sapiens
  misc_feature: GYAE6OF02GFIFU.51.29.C07.1.454.CMB.1.raw
  modified_base (117)..(134): a, c, t, g, unknown or other
  misc_feature (117)..(134): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnnnnnnnnnnn

SEQ ID NO: 195599 - DNA, 126 bp, Homo sapiens; identical to SEQ ID NO: 194834
  misc_feature: GYAE6OF02H87UV.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t

SEQ ID NO: 195600 - DNA, 143 bp, Homo sapiens
  misc_feature: GYAE6OF02IZH2H.51.29.C07.1.454.CMB.1.raw
  modified_base (118)..(143): a, c, t, g, unknown or other
  misc_feature (118)..(143): n is a, c, g, or t
tcagcgatcgtatacacgaccggtgctcgatttagagtgctacgaagggaaagggcagcgtcactctgttcccacctctctcgtagcactctgagcgggctggccaaggcgcatacgnnnnnnnnnnnnnnnnnnnnnnnnnn

SEQ ID NO: 195601 - DNA, 125 bp, Homo sapiens
  misc_feature: GYAE6OF02H4GN1.51.29.C07.1.454.CMB.1.raw
  modified_base (111)..(111): a, c, t, g, unknown or other
  misc_feature (111)..(111): n is a, c, g, or t
  modified_base (117)..(125): a, c, t, g, unknown or other
  misc_feature (117)..(125): n is a, c, g, or t
tcagcgatcgtatacacgaccggtgctcgatttagagtgctacgaagggaagggcagcgtcactctgttcccaccctcctctcgtagcactctgagcgggctggcaaggcncatagnnnnnnnnn

SEQ ID NO: 195602 - DNA, 134 bp, Homo sapiens; identical to SEQ ID NO: 194772
  misc_feature: GYAE6OF02HIUDB.51.29.C07.1.454.CMB.1.raw
  modified_base (118)..(134): a, c, t, g, unknown or other
  misc_feature (118)..(134): n is a, c, g, or t

SEQ ID NO: 195603 - DNA, 119 bp, Homo sapiens; identical to SEQ ID NO: 194160
  misc_feature: GYAE6OF02FPQHR.51.29.C07.1.454.CMB.1.raw
  modified_base (118)..(119): a, c, t, g, unknown or other
  misc_feature (118)..(119): n is a, c, g, or t

SEQ ID NO: 195604 - DNA, 127 bp, Homo sapiens
  misc_feature: GYAE6OF02HI6ET.51.29.C07.1.454.CMB.1.raw
  modified_base (116)..(127): a, c, t, g, unknown or other
  misc_feature (116)..(127): n is a, c, g, or t
tcagcgatcgtatacacgaccggtgctcgatttagagtgctacgaagggaaagggcagcgtcactctgttcccacctctctcgtagcactctgagcgggctggcaaggcgcatagnnnnnnnnnnnn

SEQ ID NO: 195605 - DNA, 118 bp, Homo sapiens; identical to SEQ ID NO: 194139
  misc_feature: GYAE6OF02FS8ER.51.29.C07.1.454.CMB.1.raw
  modified_base (118)..(118): a, c, t, g, unknown or other
  misc_feature (118)..(118): n is a, c, g, or t

SEQ ID NO: 195606 - DNA, 126 bp, Homo sapiens; identical to SEQ ID NO: 194668
  misc_feature: GYAE6OF02FLFE4.51.29.C07.1.454.CMB.1.raw
  modified_base (118)..(126): a, c, t, g, unknown or other
  misc_feature (118)..(126): n is a, c, g, or t

SEQ ID NO: 195607 - DNA, 560 bp, Homo sapiens
  misc_feature: GYAE6OF02GPZHL.51.29.C07.1.454.CMB.1.raw
  modified_base (119)..(123): a, c, t, g, unknown or other
  misc_feature (119)..(123): n is a, c, g, or t
  modified_base (125)..(125): a, c, t, g, unknown or other
  misc_feature (125)..(125): n is a, c, g, or t
  modified_base (128)..(128): a, c, t, g, unknown or other
  misc_feature (128)..(128): n is a, c, g, or t
  modified_base (133)..(133): a, c, t, g, unknown or other
  misc_feature (133)..(133): n is a, c, g, or t
  modified_base (135)..(135): a, c, t, g, unknown or other
  misc_feature (135)..(135): n is a, c, g, or t
  modified_base (137)..(138): a, c, t, g, unknown or other
  misc_feature (137)..(138): n is a, c, g, or t
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagcgatcgtatacacgaccggtgctcgatttagagtgctacgaagggaaaggggcagcgtcactctgttcccaccctcctctcgtagcactctgagcgggctggcaaggcgcatagnnnnncnganctcancntnntcgcagctcatcnggctctgagctgaanggacnctnacngtcacgntgtcncgacncgtacgcncncgtacgntcgngtcatagtacngtcaatcganacgtacgactagcagtcgtagtacactncgtaagctacgtgtcgcttacggacgtacgtntacgtattacgacgtacgtacgacgtccgtacgcgtcgaaacgtcgactcgtacgacgtttaccncgacctaacgtcgactcctagtaccgttcaaactagactacgtacgtacgtaccgtacgtacgtacgtacgtacgtcgtcgtacgtacgtacgtacgtacgtacgtactacgtacgtacgtacgtacgtacgtacgtacgtacgtacggtacgtacgtacgttacgtacgtacgtaccgtacgtacgtacgtacgtacg

SEQ ID NO: 195608 - DNA, 132 bp, Homo sapiens; identical to SEQ ID NO: 194380
  misc_feature: GYAE6OF02HKT8H.51.29.C07.1.454.CMB.1.raw
  modified_base (118)..(132): a, c, t, g, unknown or other
  misc_feature (118)..(132): n is a, c, g, or t

SEQ ID NO: 195609 - DNA, 147 bp, Homo sapiens
  misc_feature: GYAE6OF02IYM31.51.29.C07.1.454.CMB.1.raw
  modified_base (96)..(96): a, c, t, g, unknown or other
  misc_feature (96)..(96): n is a, c, g, or t
  modified_base (119)..(120): a, c, t, g, unknown or other
  misc_feature (119)..(120): n is a, c, g, or t
  modified_base (122)..(147): a, c, t, g, unknown or other
  misc_feature (122)..(147): n is a, c, g, or t
tcagcgatcgtatacacgaccggtgctcgatttagagtgctacgaagggaaagggcagcgtcactctgttcccacctcctctcgtagcactctgancgggctggcaagggcgcatagcnncnnnnnnnnnnnnnnnnnnnnnnnnnn

SEQ ID NO: 195610 - DNA, 119 bp, Homo sapiens; identical to SEQ ID NO: 194137
  misc_feature: GYAE6OF02IW9TW.51.29.C07.1.454.CMB.1.raw
  modified_base (118)..(119): a, c, t, g, unknown or other
  misc_feature (118)..(119): n is a, c, g, or t

SEQ ID NO: 195611 - DNA, 152 bp, Homo sapiens
  misc_feature: GYAE6OF02GTZAW.51.29.C07.1.454.CMB.1.raw
  modified_base (118)..(152): a, c, t, g, unknown or other
  misc_feature (118)..(152): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnnnnnnnnnnn

SEQ ID NO: 195612 - DNA, 184 bp, Homo sapiens
  misc_feature: GYAE6OF02FUOT6.51.29.C07.1.454.CMB.1.raw
  modified_base (125)..(184): a, c, t, g, unknown or other
  misc_feature (125)..(184): n is a, c, g, or t
tcagcgatcgtatacacgaccggtgctcgatttagagtgctacgaagggaaagggtcgagcgtcactctgttcccgccctcctcgtcgtagcaactcctgagcgggctggtcaaggccgcatagnnnnnnnnnnnnnnnnnnnnnnnnnnnnnnnnnnnnnnnnnnnnnnnnnnnnnnnnnnnn

SEQ ID NO: 195613 - DNA, 161 bp, Homo sapiens
  misc_feature: GYAE6OF02I257H.51.29.C07.1.454.CMB.1.raw
  modified_base (118)..(118): a, c, t, g, unknown or other
  misc_feature (118)..(118): n is a, c, g, or t
  modified_base (124)..(161): a, c, t, g, unknown or other
  misc_feature (124)..(161): n is a, c, g, or t
tcagcgatcgtatacacgaccggtgctcgatttagagtgctacgaagggtaaaggggcgagcgtcactctgttcccaccctcctcgtccgtagcactcctgagcgggctggcaaggcncatagnnnnnnnnnnnnnnnnnnnnnnnnnnnnnnnnnnnnnn

SEQ ID NO: 195614 - DNA, 118 bp, Homo sapiens; identical to SEQ ID NO: 194139
  misc_feature: GYAE6OF02FKZLD.51.29.C07.1.454.CMB.1.raw
  modified_base (118)..(118): a, c, t, g, unknown or other
  misc_feature (118)..(118): n is a, c, g, or t

SEQ ID NO: 195615 - DNA, 133 bp, Homo sapiens; identical to SEQ ID NO: 194323
  misc_feature: GYAE6OF02FXEPS.51.29.C07.1.454.CMB.1.raw
  modified_base (118)..(133): a, c, t, g, unknown or other
  misc_feature (118)..(133): n is a, c, g, or t

SEQ ID NO: 195616 - DNA, 118 bp, Homo sapiens; identical to SEQ ID NO: 194139
  misc_feature: GYAE6OF02G3VCJ.51.29.C07.1.454.CMB.1.raw
  modified_base (118)..(118): a, c, t, g, unknown or other
  misc_feature (118)..(118): n is a, c, g, or t

SEQ ID NO: 195617 - DNA, 123 bp, Homo sapiens; identical to SEQ ID NO: 194855
  misc_feature: GYAE6OF02H3N8J.51.29.C07.1.454.CMB.1.raw
  modified_base (112)..(112): a, c, t, g, unknown or other
  misc_feature (112)..(112): n is a, c, g, or t
  modified_base (118)..(123): a, c, t, g, unknown or other
  misc_feature (118)..(123): n is a, c, g, or t

SEQ ID NO: 195618 - DNA, 161 bp, Homo sapiens
  misc_feature: GYAE6OF02ILXXU.51.29.C07.1.454.CMB.1.raw
  modified_base (154)..(154): a, c, t, g, unknown or other
  misc_feature (154)..(154): n is a, c, g, or t
  modified_base (160)..(161): a, c, t, g, unknown or other
  misc_feature (160)..(161): n is a, c, g, or t
tcagcgatcgtatacacgaccggtgctcgatttagagtgctacgaagggaaagggcacgaccggtgctcgatttagagtgctacgaagggaaagggcagcgtcactctgttccccaccctcctctcgtagcactctgagcgggctggcaaggcncatagnn

SEQ ID NO: 195619 - DNA, 122 bp, Homo sapiens; identical to SEQ ID NO: 194631
  misc_feature: GYAE6OF02HMXKW.51.29.C07.1.454.CMB.1.raw
  modified_base (118)..(122): a, c, t, g, unknown or other
  misc_feature (118)..(122): n is a, c, g, or t

SEQ ID NO: 195620 - DNA, 129 bp, Homo sapiens; identical to SEQ ID NO: 194159
  misc_feature: GYAE6OF02F3A61.51.29.C07.1.454.CMB.1.raw
  modified_base (118)..(129): a, c, t, g, unknown or other
  misc_feature (118)..(129): n is a, c, g, or t

SEQ ID NO: 195621 - DNA, 120 bp, Homo sapiens; identical to SEQ ID NO: 194365
  misc_feature: GYAE6OF02GY407.51.29.C07.1.454.CMB.1.raw
  modified_base (118)..(120): a, c, t, g, unknown or other
  misc_feature (118)..(120): n is a, c, g, or t

SEQ ID NO: 195622 - DNA, 151 bp, Homo sapiens
  misc_feature: GYAE6OF02HEZGZ.51.29.C07.1.454.CMB.1.raw
  modified_base (118)..(151): a, c, t, g, unknown or other
  misc_feature (118)..(151): n is a, c, g, or t
tcagcgatcgtatacacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnnnnnnnnnnn

SEQ ID NO: 195623 - DNA, 119 bp, Homo sapiens; identical to SEQ ID NO: 194160
  misc_feature: GYAE6OF02GFZ3B.51.29.C07.1.454.CMB.1.raw
  modified_base (118)..(119): a, c, t, g, unknown or other
  misc_feature (118)..(119): n is a, c, g, or t

SEQ ID NO: 195624 - DNA, 134 bp, Homo sapiens
  misc_feature: GYAE6OF02GDTHQ.51.29.C07.1.454.CMB.1.raw
  modified_base (113)..(113): a, c, t, g, unknown or other
  misc_feature (113)..(113): n is a, c, g, or t
  modified_base (119)..(134): a, c, t, g, unknown or other
  misc_feature (119)..(134): n is a, c, g, or t
tcagcgatcgtatacacgaccggtgctcgatttagagtgctacgaagggaaagggcagcgtcactctgttcccaccctcctctcgtagcactctgagcgggctggacaaggcncatagnnnnnnnnnnnnnnnn

SEQ ID NO: 195625 - DNA, 119 bp, Homo sapiens; identical to SEQ ID NO: 194160
  misc_feature: GYAE6OF02FJ92N.51.29.C07.1.454.CMB.1.raw
  modified_base (118)..(119): a, c, t, g, unknown or other
  misc_feature (118)..(119): n is a, c, g, or t

SEQ ID NO: 195626 - DNA, 135 bp, Homo sapiens
  misc_feature: GYAE6OF02GUXZ2.51.29.C07.1.454.CMB.1.raw
  modified_base (111)..(111): a, c, t, g, unknown or other
  misc_feature (111)..(111): n is a, c, g, or t
  modified_base (117)..(135): a, c, t, g, unknown or other
  misc_feature (117)..(135): n is a, c, g, or t
tcagcgatcgtatacacgaccggtgctcgatttagagtgctacgaagggaaagggcagcgtcactctgttcccaccctctctcgtagcactctgagcgggctggcaaggcncatagnnnnnnnnnnnnnnnnnnn

SEQ ID NO: 195627 - DNA, 118 bp, Homo sapiens; identical to SEQ ID NO: 194140
  misc_feature: GYAE6OF02G8U07.51.29.C07.1.454.CMB.1.raw
  modified_base (118)..(118): a, c, t, g, unknown or other
  misc_feature (118)..(118): n is a, c, g, or t

SEQ ID NO: 195628 - DNA, 131 bp, Homo sapiens; identical to SEQ ID NO: 194666
  misc_feature: GYAE6OF02FTWHS.51.29.C07.1.454.CMB.1.raw
  modified_base (118)..(131): a, c, t, g, unknown or other
  misc_feature (118)..(131): n is a, c, g, or t

SEQ ID NO: 195629 - DNA, 122 bp, Homo sapiens; identical to SEQ ID NO: 194631
  misc_feature: GYAE6OF02HAKPZ.51.29.C07.1.454.CMB.1.raw
  modified_base (118)..(122): a, c, t, g, unknown or other
  misc_feature (118)..(122): n is a, c, g, or t

SEQ ID NO: 195630 - DNA, 119 bp, Homo sapiens; identical to SEQ ID NO: 194160
  misc_feature: GYAE6OF02FRBVR.51.29.C07.1.454.CMB.1.raw
  modified_base (118)..(119): a, c, t, g, unknown or other
  misc_feature (118)..(119): n is a, c, g, or t

SEQ ID NO: 195631 - DNA, 121 bp, Homo sapiens; identical to SEQ ID NO: 194352
  misc_feature: GYAE6OF02G4ITG.51.29.C07.1.454.CMB.1.raw
  modified_base (118)..(121): a, c, t, g, unknown or other
  misc_feature (118)..(121): n is a, c, g, or t

SEQ ID NO: 195632 - DNA, 126 bp, Homo sapiens
  misc_feature: GYAE6OF02H5NRI.51.29.C07.1.454.CMB.1.raw
  modified_base (116)..(126): a, c, t, g, unknown or other
  misc_feature (116)..(126): n is a, c, g, or t
tcagcgatcgtatacacgaccggtgctcgatttagagtgctacgaagggaagggcagcgtcactctgttcccaccctctctcgtagcactctgagcgggctggcaaggcgcatagnnnnnnnnnnn

SEQ ID NO: 195633 - DNA, 131 bp, Homo sapiens; identical to SEQ ID NO: 195246
  misc_feature: GYAE6OF02F98D6.51.29.C07.1.454.CMB.1.raw
  modified_base (117)..(131): a, c, t, g, unknown or other
  misc_feature (117)..(131): n is a, c, g, or t

SEQ ID NO: 195634 - DNA, 148 bp, Homo sapiens
  misc_feature: GYAE6OF02G3DVX.51.29.C07.1.454.CMB.1.raw
  modified_base (120)..(148): a, c, t, g, unknown or other
  misc_feature (120)..(148): n is a, c, g, or t
tcagcgatcgtatacacgaccggtgctcgatttagagtgctacgaagggaaagggcgagcgtcactctgttcccaccctcctctcgtagcactcctgagcgggctggcaaggcgcatagnnnnnnnnnnnnnnnnnnnnnnnnnnnnn

SEQ ID NO: 195635 - DNA, 127 bp, Homo sapiens; identical to SEQ ID NO: 194501
  misc_feature: GYAE6OF02H4LMN.51.29.C07.1.454.CMB.1.raw
  modified_base (118)..(127): a, c, t, g, unknown or other
  misc_feature (118)..(127): n is a, c, g, or t

SEQ ID NO: 195636 - DNA, 165 bp, Homo sapiens
  misc_feature: GYAE6OF02HYJRZ.51.29.C07.1.454.CMB.1.raw
  modified_base (158)..(165): a, c, t, g, unknown or other
  misc_feature (158)..(165): n is a, c, g, or t
tcagcgatcgtatacacgaccggtgctcgatttagagtgctacgaagggaaagggcacgaccggtgctcgatttagagtgctacgaagggaaaggcagcgtcactctgttcccaccctcctctcgtagcactctgagcgggctggcaaggcgcatagnnnnnnnn

SEQ ID NO: 195637 - DNA, 126 bp, Homo sapiens; identical to SEQ ID NO: 194834
  misc_feature: GYAE6OF02HRDQA.51.29.C07.1.454.CMB.1.raw
  modified_base (112)..(112): a, c, t, g, unknown or other
  misc_feature (112)..(112): n is a, c, g, or t
  modified_base (118)..(126): a, c, t, g, unknown or other
  misc_feature (118)..(126): n is a, c, g, or t

SEQ ID NO: 195638 - DNA, 150 bp, Homo sapiens
  misc_feature: GYAE6OF02IHKK5.51.29.C07.1.454.CMB.1.raw
  modified_base (112)..(112): a, c, t, g, unknown or other
  misc_feature (112)..(112): n is a, c, g, or t
  modified_base (118)..(120): a, c, t, g, unknown or other
  misc_feature (118)..(120): n is a, c, g, or t
  modified_base (122)..(150): a, c, t, g, unknown or other
  misc_feature (122)..(150): n is a, c, g, or t
tcagcgatcgtatacacgaccggtgctcgatttagagtgctacgaagggaagggcagcgtcactctgttcccaccctcctctcgtagcacgtctgagcgggctggcaaggcncatagnnntnnnnnnnnnnnnnnnnnnnnnnnnnnnnn

SEQ ID NO: 195639 - DNA, 138 bp, Homo sapiens; identical to SEQ ID NO: 195351
  misc_feature: GYAE6OF02IAS9N.51.29.C07.1.454.CMB.1.raw
  modified_base (118)..(138): a, c, t, g, unknown or other
  misc_feature (118)..(138): n is a, c, g, or t

SEQ ID NO: 195640 - DNA, 120 bp, Homo sapiens; identical to SEQ ID NO: 194365
  misc_feature: GYAE6OF02IB52K.51.29.C07.1.454.CMB.1.raw
  modified_base (118)..(120): a, c, t, g, unknown or other
  misc_feature (118)..(120): n is a, c, g, or t

SEQ ID NO: 195641 - DNA, 120 bp, Homo sapiens; identical to SEQ ID NO: 194289
  misc_feature: GYAE6OF02GNCZS.51.29.C07.1.454.CMB.1.raw
  modified_base (118)..(120): a, c, t, g, unknown or other
  misc_feature (118)..(120): n is a, c, g, or t

SEQ ID NO: 195642 - DNA, 127 bp, Homo sapiens
  misc_feature: GYAE6OF02FLFYQ.51.29.C07.1.454.CMB.1.raw
  modified_base (117)..(127): a, c, t, g, unknown or other
  misc_feature (117)..(127): n is a, c, g, or t
tcagcgatcgtatacacgaccggtgctcgatttagagtgctacgaagggaagggcagcgtcactctgttcccaccctcctctcgtagcactctgagcgggctggcaaggcgcatagnnnnnnnnnnn

SEQ ID NO: 195643 - DNA, 119 bp, Homo sapiens; identical to SEQ ID NO: 194160
  misc_feature: GYAE6OF02F82N1.51.29.C07.1.454.CMB.1.raw
  modified_base (118)..(119): a, c, t, g, unknown or other
  misc_feature (118)..(119): n is a, c, g, or t

SEQ ID NO: 195644 - DNA, 133 bp, Homo sapiens
  misc_feature: GYAE6OF02IHELY.51.29.C07.1.454.CMB.1.raw
  modified_base (111)..(111): a, c, t, g, unknown or other
  misc_feature (111)..(111): n is a, c, g, or t
  modified_base (117)..(133): a, c, t, g, unknown or other
  misc_feature (117)..(133): n is a, c, g, or t
tcagcgatcgtatacacgaccggtgctcgatttagagtgctacgaagggaaagggcagcgtcactctgttcccaccctctctcgtagcactctgagcgggctggcaaggcncatagnnnnnnnnnnnnnnnnn

SEQ ID NO: 195645 - DNA, 125 bp, Homo sapiens; identical to SEQ ID NO: 195396
  misc_feature: GYAE6OF02FSWT3.51.29.C07.1.454.CMB.1.raw
  modified_base (118)..(125): a, c, t, g, unknown or other
  misc_feature (118)..(125): n is a, c, g, or t

SEQ ID NO: 195646 - DNA, 164 bp, Homo sapiens
  misc_feature: GYAE6OF02HOPUI.51.29.C07.1.454.CMB.1.raw
  modified_base (127)..(164): a, c, t, g, unknown or other
  misc_feature (127)..(164): n is a, c, g, or t
tcagcgatcgtatacacgaccggtgctcgatttagagtgctacgaagggtaaaggggtcgacgcgtccacgtctcgttcccgccctccttctcgtagcactctgagcgggctggcaaggcgcatagnnnnnnnnnnnnnnnnnnnnnnnnnnnnnnnnnnnnnn

SEQ ID NO: 195647 - DNA, 121 bp, Homo sapiens; identical to SEQ ID NO: 194352
  misc_feature: GYAE6OF02HGV56.51.29.C07.1.454.CMB.1.raw
  modified_base (118)..(121): a, c, t, g, unknown or other
  misc_feature (118)..(121): n is a, c, g, or t

SEQ ID NO: 195648 - DNA, 125 bp, Homo sapiens
  misc_feature: GYAE6OF02IAQZK.51.29.C07.1.454.CMB.1.raw
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccgcctcctctcgtagcactctgagcgggctggcaaggcgcatagnnnnnnnnn

SEQ ID NO: 195649 - DNA, 117 bp, Homo sapiens; identical to SEQ ID NO: 194147
  misc_feature: GYAE6OF02IV1EK.51.29.C07.1.454.CMB.1.raw

SEQ ID NO: 195650 - DNA, 652 bp, Homo sapiens
  misc_feature: GYAE6OF02I3UUN.51.29.C07.1.454.CMB.1.raw
  modified_base (126)..(126): a, c, t, g, unknown or other
  misc_feature (126)..(126): n is a, c, g, or t
  modified_base (166)..(166): a, c, t, g, unknown or other
  misc_feature (166)..(166): n is a, c, g, or t
  modified_base (168)..(169): a, c, t, g, unknown or other
  misc_feature (168)..(169): n is a, c, g, or t
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (449)..(449): a, c, t, g, unknown or other
  misc_feature (449)..(449): n is a, c, g, or t
tcagcgatcgtatacacgaccggtgctcgatttagagtgctacgaaggaaagggcacgaccggtgctcgatttagagtgctacgaagggaaggcagcgtcacgtctgttcccacctctctacgtanctacgtctgaggcggctcggacaaggcgtacaagtaggtntnngtngtcagctntgtactnacgtgcgacgngtcncgntcgctcgacganagtacgacagtacgtngactcgtactctgtaacgtcgtcgtacgtacgtacgtactacgacgtacgtacgtacgtccgtacgaccggtactaccggtacggtacgtacgtacgtagttaacccggacgtacgaccggtgtaccgttaagtaccggtactggtaccgtacgtcttaggagtaccggtagttcgtactaaaggtacgaagtcttacgtaccactacggtacgtntacgtacgtacgtacgtacgtactacgtacgtacgtacgtacgtacgtacgtacgtacgtaacgtacgtacgtacgtacgtacgtacgtacgtacgtacgtacgtacgtacgtacgtacgtacgtacgtacgtacgtacggtacgtacggtaccgtacgtacgtacgtacgtacgtacgtaccgacgtacgtacgtacgtacg

SEQ ID NO: 195651 - DNA, 146 bp, Homo sapiens
  misc_feature: GYAE6OF02FZ2A3.51.29.C07.1.454.CMB.1.raw
  modified_base (117)..(146): a, c, t, g, unknown or other
  misc_feature (117)..(146): n is a, c, g, or t
tcagcgatcgtatacacgaccggtgctcgatttagagtgctacgaagggaaagggcagcgtcactctgttcccaccctctctcgtagcactctgagcgggctggcaaggcgcatagnnnnnnnnnnnnnnnnnnnnnnnnnnnnnn

SEQ ID NO: 195652 - DNA, 133 bp, Homo sapiens
  misc_feature: GYAE6OF02FQO9B.51.29.C07.1.454.CMB.1.raw
  modified_base (119)..(133): a, c, t, g, unknown or other
  misc_feature (119)..(133): n is a, c, g, or t
tcagcgatcgtatacacgaccggtgctcgatttagagtgctacgaagggaaagggcagcgtcactctgttcccacccgtcctctcgtagcactctgagcgggctggcaaggctcatagnnnnnnnnnnnnnnn

SEQ ID NO: 195653 - DNA, 132 bp, Homo sapiens
  misc_feature: GYAE6OF02HF1X1.51.29.C07.1.454.CMB.1.raw
  modified_base (111)..(111): a, c, t, g, unknown or other
  misc_feature (111)..(111): n is a, c, g, or t
  modified_base (117)..(132): a, c, t, g, unknown or other
  misc_feature (117)..(132): n is a, c, g, or t
tcagcgatcgtatacacgaccggtgctcgatttagagtgctacgaagggaagggcagcgtcactctgttcccaccctcctctcgtagcactctgagcgggctggcaaggcncatagnnnnnnnnnnnnnnnn

SEQ ID NO: 195654 - DNA, 126 bp, Homo sapiens; identical to SEQ ID NO: 194668
  misc_feature: GYAE6OF02FU154.51.29.C07.1.454.CMB.1.raw
  modified_base (118)..(126): a, c, t, g, unknown or other
  misc_feature (118)..(126): n is a, c, g, or t

SEQ ID NO: 195655 - DNA, 135 bp, Homo sapiens
  misc_feature: GYAE6OF02GPE3E.51.29.C07.1.454.CMB.1.raw
  modified_base (119)..(135): a, c, t, g, unknown or other
  misc_feature (119)..(135): n is a, c, g, or t
tcagcgatcgtatacacgaccggtgctcgatttagagtgctacgaagggaaagggccaagcgtcactctgttcccaccctctctcgtagcactctgagcgggctggcaaggcgcatagnnnnnnnnnnnnnnnnn

SEQ ID NO: 195656 - DNA, 133 bp, Homo sapiens
  misc_feature: GYAE6OF02HINZD.51.29.C07.1.454.CMB.1.raw
  modified_base (119)..(133): a, c, t, g, unknown or other
  misc_feature (119)..(133): n is a, c, g, or t
tcagcgatcgtatacacgaccggtgctcgatttagagtgctacgaagggaaaggggcagcgtcactctgttcccaccctcctctcgtagcactctgagcgggctggcaaggcgcatagnnnnnnnnnnnnnnn

SEQ ID NO: 195657 - DNA, 118 bp, Homo sapiens; identical to SEQ ID NO: 194140
  misc_feature: GYAE6OF02H1ELS.51.29.C07.1.454.CMB.1.raw
  modified_base (118)..(118): a, c, t, g, unknown or other
  misc_feature (118)..(118): n is a, c, g, or t

SEQ ID NO: 195658 - DNA, 125 bp, Homo sapiens
  misc_feature: GYAE6OF02I1YD2.51.29.C07.1.454.CMB.1.raw
  modified_base (112)..(112): a, c, t, g, unknown or other
  misc_feature (112)..(112): n is a, c, g, or t
  modified_base (117)..(125): a, c, t, g, unknown or other
  misc_feature (117)..(125): n is a, c, g, or t
tcagcgatcgtatacacgaccggtgctcgatttagagtgctacgaagggaaagggcagcgtcactctgttcccaccctcctctcgtagcactctgagcgggctggcaaggcncatgnnnnnnnnn

SEQ ID NO: 195659 - DNA, 635 bp, Homo sapiens
  misc_feature: GYAE6OF02IIQTQ.51.29.C07.1.454.CMB.1.raw
  modified_base (102)..(102): a, c, t, g, unknown or other
  misc_feature (102)..(102): n is a, c, g, or t
  modified_base (118)..(119): a, c, t, g, unknown or other
  misc_feature (118)..(119): n is a, c, g, or t
  modified_base (121)..(122): a, c, t, g, unknown or other
  misc_feature (121)..(122): n is a, c, g, or t
  modified_base (124)..(124): a, c, t, g, unknown or other
  misc_feature (124)..(124): n is a, c, g, or t
  modified_base (130)..(130): a, c, t, g, unknown or other
  misc_feature (130)..(130): n is a, c, g, or t
  modified_base (132)..(132): a, c, t, g, unknown or other
  misc_feature (132)..(132): n is a, c, g, or t
  modified_base (134)..(134): a, c, t, g, unknown or other
  misc_feature (134)..(134): n is a, c, g, or t
  modified_base (136)..(136): a, c, t, g, unknown or other
  misc_feature (136)..(136): n is a, c, g, or t
  modified_base (141)..(142): a, c, t, g, unknown or other
  misc_feature (141)..(142): n is a, c, g, or t
  modified_base (145)..(145): a, c, t, g, unknown or other
  misc_feature (145)..(145): n is a, c, g, or t
  modified_base (154)..(154): a, c, t, g, unknown or other
  misc_feature (154)..(154): n is a, c, g, or t
  modified_base (156)..(157): a, c, t, g, unknown or other
  misc_feature (156)..(157): n is a, c, g, or t
  modified_base (160)..(161): a, c, t, g, unknown or other
  misc_feature (160)..(161): n is a, c, g, or t
  modified_base (164)..(164): a, c, t, g, unknown or other
  misc_feature (164)..(164): n is a, c, g, or t
  modified_base (174)..(175): a, c, t, g, unknown or other
  misc_feature (174)..(175): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagcgatcgtatacacgaccggtgctcgattttagagtgctacgaagggaaaggggcagcgtcactctgttcccacctctctcgtagcactctgagcgggntggcaaggcgcatagnngnntnacgagntncngnatctnntcngttagcctngnntannagntagcgtgtanncngtncnatgcnaactganccgancgngtcatntatcgacgtcgnaacgttagagacctacgcttcgactagccgtancgtancgtgaacgtcgtaacngtcgtaacgcggttacnctttaacggtntcgagtactacgtaagtcgaagtccgtaaatacgacgtacgtacgtaccgtacgtacgtaccgtaccgtacgtaacgtaccgtaacgtacgtacgtacgtacgtacgttacgttaacggtacggtaacggtaacgtacgttacgtaaccgtacgttacgtacggttacgtaccgttaacggtacgtaacggttaccggttaaccggtaaccgttacgttaccggtacgttaaccggttaccggtacggttaccggtaccggtaaccggttaacggttaacccggttaacgttaccggtaccggttaaccggttaccgtacgtaccggtacccg

SEQ ID NO: 195660 - DNA, 122 bp, Homo sapiens; identical to SEQ ID NO: 194631
  misc_feature: GYAE6OF02I9QJX.51.29.C07.1.454.CMB.1.raw
  modified_base (118)..(122): a, c, t, g, unknown or other
  misc_feature (118)..(122): n is a, c, g, or t

SEQ ID NO: 195661 - DNA, 126 bp, Homo sapiens
  misc_feature: GYAE6OF02I09I4.51.29.C07.1.454.CMB.1.raw
  modified_base (119)..(126): a, c, t, g, unknown or other
  misc_feature (119)..(126): n is a, c, g, or t
tcagcgatcgtatacacgaccggtgctcgatttagagtgctacgaagggaaagggcagcgtcactctgttccccgccctcctctcgtagcactctgagcgggctggcaaggcgcatagnnnnnnnn

SEQ ID NO: 195662 - DNA, 125 bp, Homo sapiens
  misc_feature: GYAE6OF02GJTUL.51.29.C07.1.454.CMB.1.raw
  modified_base (110)..(110): a, c, t, g, unknown or other
  misc_feature (110)..(110): n is a, c, g, or t
  modified_base (115)..(118): a, c, t, g, unknown or other
  misc_feature (115)..(118): n is a, c, g, or t
  modified_base (120)..(125): a, c, t, g, unknown or other
  misc_feature (120)..(125): n is a, c, g, or t
tcagcgatcgtatacacgaccggtgctcgatttagagtgctacgaagggaaagggcaagcgtcactctgttccaccctcctctcgtagcactctgagcggctgcaaggcnatagnnnnannnnnn

SEQ ID NO: 195663 - DNA, 144 bp, Homo sapiens
  misc_feature: GYAE6OF02FQM0N.51.29.C07.1.454.CMB.1.raw
  modified_base (113)..(113): a, c, t, g, unknown or other
  misc_feature (113)..(113): n is a, c, g, or t
  modified_base (119)..(144): a, c, t, g, unknown or other
  misc_feature (119)..(144): n is a, c, g, or t
tcagcgatcgtatacacgaccggtgctcgatttagagtgctacgaagggaaagggcagcgtcactctgttcccaccctcctctcgtagcactctgagcgggctggcaagggcncatagnnnnnnnnnnnnnnnnnnnnnnnnnn

SEQ ID NO: 195664 - DNA, 124 bp, Homo sapiens; identical to SEQ ID NO: 194372
  misc_feature: GYAE6OF02FVQYG.51.29.C07.1.454.CMB.1.raw
  modified_base (117)..(124): a, c, t, g, unknown or other
  misc_feature (117)..(124): n is a, c, g, or t

SEQ ID NO: 195665 - DNA, 130 bp, Homo sapiens; identical to SEQ ID NO: 195209
  misc_feature: GYAE6OF02I4R4B.51.29.C07.1.454.CMB.1.raw
  modified_base (118)..(130): a, c, t, g, unknown or other
  misc_feature (118)..(130): n is a, c, g, or t

SEQ ID NO: 195666 - DNA, 150 bp, Homo sapiens; identical to SEQ ID NO: 195565
  misc_feature: GYAE6OF02IWBF1.51.29.C07.1.454.CMB.1.raw
  modified_base (118)..(150): a, c, t, g, unknown or other
  misc_feature (118)..(150): n is a, c, g, or t

SEQ ID NO: 195667 - DNA, 126 bp, Homo sapiens
  misc_feature: GYAE6OF02FJSPY.51.29.C07.1.454.CMB.1.raw
  modified_base (111)..(111): a, c, t, g, unknown or other
  misc_feature (111)..(111): n is a, c, g, or t
  modified_base (117)..(126): a, c, t, g, unknown or other
  misc_feature (117)..(126): n is a, c, g, or t
tcagcgatcgtatacacgaccggtgctcgatttagagtgctacgaagggaagggcagcgtcactctgttcccaccctcctctcgtagcactctgagcgggctggcaaggcncatagnnnnnnnnnn

SEQ ID NO: 195668 - DNA, 140 bp, Homo sapiens
  misc_feature: GYAE6OF02FP362.51.29.C07.1.454.CMB.1.raw
  modified_base (118)..(140): a, c, t, g, unknown or other
  misc_feature (118)..(140): n is a, c, g, or t
tcagcgatcgtatacacgaccggtgctcgatttagagtgctacgaagggaaagggcagcgtcactctgttcccgccctcctctcgtagcactctgagcgggctggcaaggcgcatagnnnnnnnnnnnnnnnnnnnnnnn

SEQ ID NO: 195669 - DNA, 133 bp, Homo sapiens; identical to SEQ ID NO: 194323
  misc_feature: GYAE6OF02F4G71.51.29.C07.1.454.CMB.1.raw
  modified_base (118)..(133): a, c, t, g, unknown or other
  misc_feature (118)..(133): n is a, c, g, or t

SEQ ID NO: 195670 - DNA, 133 bp, Homo sapiens
  misc_feature: GYAE6OF02FYS7U.51.29.C07.1.454.CMB.1.raw
  modified_base (116)..(133): a, c, t, g, unknown or other
  misc_feature (116)..(133): n is a, c, g, or t
tcagcgatcgtatacacgaccggtgctcgatttagagtgctacgaagggaaagggcagcgtcactctgttcccaccctctctcgtagcactctgagcggctggcaaggcgcatagnnnnnnnnnnnnnnnnnn

SEQ ID NO: 195671 - DNA, 564 bp, Homo sapiens
  misc_feature: GYAE6OF01BLL6L.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctttctatggtgggtccttcagtggttactactggagctggatccgccagccccagggaagggctggagtggattggggaatcaatcatagtggaagcaccaactacaacccgtcctcaggagtcgagtcaccatatcagtagacacgtaccaaagaaccagttctccctagaacgctgagctctgtcgaccgccgcggacacggctgtgtattactgtgcgagagcggatagttgtagtagtaccagctgcttagttttcgtccggttggtttcccgaccccggttggggacccaacggggtaaccctcgggttacccaccggttcctccctacgacgtccctccgaacccgg

SEQ ID NO: 195672 - DNA, 501 bp, Homo sapiens
  misc_feature: GYAE6OF01D7RHO.48.65.F10.1.454.CMB.1.raw
tcagagtatacatacacgaccggtgctcgatttagctacgctctaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttaggagttataaccttgtctcctggtaccaacagcaccaggcaaagcccccaaactcatgatttatgaggacagtaagcggccctcgaggggtttctaatcgcttctctggctcaagtctggcaacacggcctccctgacccgtctctgggctccgaggctgaggatggaggctgatttattactgcagctcatatgcaggcagcaacatgtggtatcgggcggaggaccagctagccgtcgtaggccagacccaggcctcgccccgtcgg

SEQ ID NO: 195673 - DNA, 547 bp, Homo sapiens
  misc_feature: GYAE6OF01C3ALZ.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagcctttcggagacccctgtcccctcacctgccgtctttctatggtggtcccttcagtggttactactggagctggactccgccagcccccaggggaaggggctggagtggattggggaaatcaatcatagtggaagcaccaactacaacccgtcctcaggagtcgagtcaccatatcagtagacacgtccaagaaccagttcctcctgaagctgagctctgtcgaccgccgcggacacggctgtgtattactgtgcgagagcgataatgtagtagtacagctgcttagttttcgccggttggttccgaccccgttggggcccgacgggtaccctggtccaccgtcctcctcacgcctccgaacccgg

SEQ ID NO: 195674 - DNA, 573 bp, Homo sapiens
  misc_feature: GYAE6OF01DYVD4.48.65.F10.1.454.CMB.1.raw
  modified_base (167)..(167): a, c, t, g, unknown or other
  misc_feature (167)..(167): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtcccctcacctgccgtctttctatgggtggtccttcagtggttactactggagctggactccgccacgcccccagggaaggggctgggagtggagttggggaaatcaatcaatagtggaagcaccaactacaacccgtccctcaggagtcgagtcaccatatcagtagacacgtccaaagaccagttccncctaganctganctctgtcgccgcgcgacncggctgtgtattctgtcgngagagcggatagttgtaagtacgtacagtctgtcttagttttcggtccggttaggttccgaccccggtgggggccctaacggggtacccctgggttaccacccggttctcccgtcgaccgtccctcccgaaaccccgg

SEQ ID NO: 195675 - DNA, 523 bp, Homo sapiens
  misc_feature: GYAE6OF01AL1AU.48.65.F10.1.454.CMB.1.raw
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (513)..(513): a, c, t, g, unknown or other
  misc_feature (513)..(513): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctttctatggtgggtccttcagttggttaactactggagctggatccgccagcccccaggaaggggctggagtggattggggaaatcaatcatagtgaagcaccaactacaacccgtcctcaggagtcgagtcaccatatcagtagacacgtacaagaaccagttctaccctgaagctgagctctgtcgaccgcgcggacacggctgtgtattacngtgcgagngcgatatgtagtagtaccagctgcttagttttgcggtgtccgacccgtgggccagggccctggtcaccgtctcctcacncctccaaccg

SEQ ID NO: 195676 - DNA, 606 bp, Homo sapiens
  misc_feature: GYAE6OF01B7UMG.48.65.F10.1.454.CMB.1.raw
  modified_base (454)..(454): a, c, t, g, unknown or other
  misc_feature (454)..(454): n is a, c, g, or t
  modified_base (594)..(594): a, c, t, g, unknown or other
  misc_feature (594)..(594): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcgagtggttactactggagctggactccgccacgcccccgaggggaaggggcgtgggagtggagttaggggaaatcgaatcagtaggtaggaagcaacccaactaaccaacccgtccctgacggagtcgagtccacatatcagtacgacacgtaccaaagaacctagttcctacccgtagaacgctagacgtcctcgtgtcgacccgccgacggacgacggctgtnttacgttactgtgcgagagcggtatagttggtagtacgtacagtcgtgtctttagttttcggtccggttcggttcccggacccggtcgggtacccgaacgggtaccctcggtaccgtcccgtcctccgtacaccgtcccncccgtaacccgg

SEQ ID NO: 195677 - DNA, 644 bp, Homo sapiens
  misc_feature: GYAE6OF01CV48Z.48.65.F10.1.454.CMB.1.raw
  modified_base (168)..(168): a, c, t, g, unknown or other
  misc_feature (168)..(168): n is a, c, g, or t
  modified_base (397)..(397): a, c, t, g, unknown or other
  misc_feature (397)..(397): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcncaggactgttgaagccttcggagaccctgtccctcacctgcgtctttcagtgggtcggtccttcgagttggttacctacgtggagctggactccgcacgccccgagggaagggcgtggagtggagttgggaaatcgaatcatagtgaacgcaccaacacaaccctcctcaggacgtcgagtacacatactcagtagacacgtaccaacgaaccagtttccacctagaancgtagagtctcgtcggtacgacccggtccgacggtaccgacgggtcttaggtacgttactttaccgtgtacggacggaaggtaggacggtagtttaagtagggttaacgtacgttaaccgagtcgttagtctttaaggtttttggtcccggtagggtttccccgacccggttggggacccgtaacgggtacccgttcgggtaccctaccggttcctacccgtagaccggtcccacccgtaacccggg

SEQ ID NO: 195678 - DNA, 588 bp, Homo sapiens
  misc_feature: GYAE6OF01DUEHN.48.65.F10.1.454.CMB.1.raw
  modified_base (344)..(344): a, c, t, g, unknown or other
  misc_feature (344)..(344): n is a, c, g, or t
  modified_base (436)..(436): a, c, t, g, unknown or other
  misc_feature (436)..(436): n is a, c, g, or t
  modified_base (486)..(486): a, c, t, g, unknown or other
  misc_feature (486)..(486): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactggttgaagccttcggagaccctgtcccctcacctgcgtcttttcagtgggtcgggtccttcaggttggttactacgtggagctggactccgccagcccccgaggggaaggggctgggagtggagttggggaaatcgaatcagtagtggaagcacaactacaaccgtccncaggagtcgagtcacatatacagtagacacgtaccaaacgaacctagttcctaccctagaacgctagacgtctctgtcgaccgccgcggacncggctgtgtattactgtgcgagagcggattacgtaggtagtacgtaaccngtctagtctttagttttcggtccggttggttcccggacccgttgggggacctacggggaccttcgggcctacccgtctcctacncgtcccnccgtaacccgg

SEQ ID NO: 195679 - DNA, 613 bp, Homo sapiens
  misc_feature: GYAE6OF01BZMYC.48.65.F10.1.454.CMB.1.raw
  modified_base (168)..(168): a, c, t, g, unknown or other
  misc_feature (168)..(168): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (492)..(492): a, c, t, g, unknown or other
  misc_feature (492)..(492): n is a, c, g, or t
tcagagtatacatacacgaccggtgctcgatttagctacgctctaagggggcgtttctgagagtcatggacctcctgcacaagaacatgaaacacctgtggttcttcctcctcctggtggcagctcccagatgggtcctgtcccaggtgcagctacagcagtggggcncaggactgttgaagccttcggagacccgtgtcccctcacctgcgctttctagtggtgggtccttnagtggttactactgganctggatccgccagcccccagggaacggggctggacgtggattggggaaatcaatcataggtggagcaccaactacaacccgtccctcaggacgtccgagtcaccatactcagtacgacacgtccaagaaccagttcctacccgtgaaacgtctagacgcctcgtggtcggacccgcccggtacggaccgacggctacggttgtaattcgtgtcgcgagagcgatagttggtagtagtaccgngtctgtcttagttttcgtccgggttggttacccggtaccccgtggggtaccctaggggtaaccccgttgggtaccctaccccggttcttacccgtacgaccgtccccgtccgaaaccccgg

SEQ ID NO: 195680 - DNA, 658 bp, Homo sapiens
  misc_feature: GYAE6OF01CTX22.48.65.F10.1.454.CMB.1.raw
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagagtatacatacacgaccggtgctcgatttagctacgctctaagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccagcagtgatgttgggattataccttgtctctgtacangcaccgagacaacgccccaatcatgattangaganagtagccgctgtagggttctaagtcgtcttacgtcgtcggtactaccgaagtccgtacggaccaaccgtacccgggtaccctacccgtaggaacctaacttccgtaccgtcgggaccctacggaacggtcgtagggacggacgaggtacctaggtactttacgtacgtcggtactaggtacctagtaactacgtacgacgtaagtaacgttacgtaacgtcgtaaccttagtacgttggtacgggttaccgttcggggaaccgggtaaccgggaacccgtaacggtcccgttaaccgggtaacccggttacccggttaacggtacccgaacccggaccccggtaacgggccccgttaccccccggg

SEQ ID NO: 195681 - DNA, 774 bp, Homo sapiens
  misc_feature: GYAE6OF01E2TPM.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactgttgaagccttcggagaccctgtcccctcacctgcgtctttctatggtggtccttcagtggttactactggagctggatccgccacgcccccgaggggaacgggctggaggtggagttggggaaatcaatcataggtggaagcaccaactacaacccgtcctcaggagtcgagtcaccatactcagtagacacgtaccaagaacctagttcctacccgtaggaacgctaggacgtctcgtcggtcgacccggcccggaccggaaccgaccggtcttacggttgttaacttaccgtggttacggaccggtaaggaacggtcgggtaatttaacggttttagggttaacggttaacggtaaccccgtaaggtccgtttacgggttaccgtttttaaggttttttttccggggttccccggggttttacgggggtttacccccggtaacccccccggggtttcggggggggtacccccgttaaaccgggggggttaaacccccccgttttcgggggttaccccgttaaccccccgggtttccccgttacccccgttacccgaacccgggttccccccttaacccccggtaaaacccccgggg

SEQ ID NO: 195682 - DNA, 661 bp, Homo sapiens
  misc_feature: GYAE6OF01BWSH1.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgtctttctatggtcggtccttcagtggttactacgtggagctggactccgccacgcccccgaggggaacgggctggagtggagttaggggaatcaatcagtagtagagcaaccaactaccaacccgtcctacgacggacgtcgagtcaccatactcagtacgacacgtaccaaacgtaacctacgttacctacccgtagaacgtcgtagacgtctcgtgtacgacccgcggaccggacgacggcgttcggttagtactttaccgtgtacggacgaaggtacggacgtaattaggtttaggtaacgttacgtaccgtagtcttgttactttacgtttttcggtccgggtttcggttacccggtaccccggtcggggtacccgtacggggtaccccttcgggtacccgtacccggttcccttacccgtaccaccgtccccgtcccgaaccccggg

SEQ ID NO: 195683 - DNA, 767 bp, Homo sapiens
  misc_feature: GYAE6OF01BY106.48.65.F10.1.454.CMB.1.raw
  modified_base (168)..(168): a, c, t, g, unknown or other
  misc_feature (168)..(168): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcncaggactgttgaagccttcgggagacccttgtcccctcacctgcgtcttttcgtagtgggttcggttccttcaggttcggttaacctacgtgggagcgtggactcccgccacgccccgagggaacgggcgtggagtggagttaggggaatcgaatcagtaggtaggaacgccaaccaactaccgaacccgttccctacgacggacgtcgacgtcactatactacgagtacgacacgtaccaaacgaacctagttaccctacccgtagaacgtcgtacgtacgccttacgtcgtaccggaccccggcccggtaccggaacgtaccgggtcttagggttacgtttacgtttaaccgttcggttacggaccggagggacggtaccgggtatttaacgtttacggttaacgttacgtaaccgtaagtccgttaggtacgttttaacggtttttccgggtcccgggttttacgggtttacccccgggtaccccgggttcgggggtacccccggttaaacgggggttaccccgttcgggttaccccgtacccggtttacccgttcccgtaacccgaccggtacccccgtacccgtaaaccccggg

SEQ ID NO: 195684 - DNA, 712 bp, Homo sapiens
  misc_feature: GYAE6OF01CP0OW.48.65.F10.1.454.CMB.1.raw
  modified_base (168)..(168): a, c, t, g, unknown or other
  misc_feature (168)..(168): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcncaggactggttgaagccttcggacgaccctgtcccctcacctggctctttcagtgggtggtccttcagttggttactacgtggagcgtggactccgccgacgccccgaggggacgggcgtggaggtggagttagggaatcgaatcaagtaggtaggacgaccaaccaacctaccgaacccgtccacgaggacgtcgacgtaccacatactacgacgtagaaccacgtaacgaaacgaactacgttcctaccgtagaacgaccgtgacgtctacgtcggtaccgacccgccggtaccggactacgggtcttggtacgttaacttcgtgtcgacggaagcgacggtaattagttaaggtaacggttaacctaccgaggttcttacggttcgttttaacggtttttccgggtcccgggttcggggtttaccccgacccggggtttcgggggacccgtaacccggggttaaaccccttcgggtaccccgttacccggtttccctacccgttaccgacccggttccccgtaacccggtaaaccccgggg

SEQ ID NO: 195685 - DNA, 680 bp, Homo sapiens
  misc_feature: GYAE6OF01AYM5O.48.65.F10.1.454.CMB.1.raw
  modified_base (167)..(167): a, c, t, g, unknown or other
  misc_feature (167)..(167): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtcccctcacctgcgtctttctatgggtggtccttcagttggttactacgtggagctggactccgccacgcccccgaggggaacgggctggagtggagttaggggaaatcgaatcaagtaggtaggaagcaaccaactaccaacccgtccctcgaagggacgtcgacgtacaccgaatactcgaagtacgaaccgacgtaccgaaacgaacctacgttaccctacccgtaggaacgcgttagacgtctcgtgtcgaccgccgaccggacgacggcttaggtacgttactttacgtggttacgacgtaggaggtacggtattaagttaggttaaggtaacgttaccgaagtccttaggtcctttaagtttttccggtaccgggtttcggttcccggtacccgggtcggggtacccgtaaccggggtacccgttcggtacccgtacccgttccgtaccctacctaccggcccctacgtaaccccggg

SEQ ID NO: 195686 - DNA, 717 bp, Homo sapiens
  misc_feature: GYAE6OF01DPUOR.48.65.F10.1.454.CMB.1.raw
  modified_base (167)..(167): a, c, t, g, unknown or other
  misc_feature (167)..(167): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtcccctcacctgcgtctttctatgggtggtccttcagttggttactacgtggagctggactccgccacgcccccgaggggaaggggctgggagtggagttggggaaatcaatcataggtaggaacgcaaccaactaccaacccgtccctacgaggacgtcgagtccaacagtactcagtacgacacgtaccaaacgaacctagttcctcctagaagtctagacgctcgtcgtacgacccggccggacggacgaaccgggtcctaggttacgttaactttaccgtggtacggaccggtaaggacgggtcgggtaatttagtttacgggtaagttaacgtaacccgtaggtccttaggttcttttacgttttttcgggtcccgggtttcgggtttaccccggaaccccccgggttgggggaacccccgttaacgggggtaaaccccctttcggggtacccctaaccccggtttccgttacccccgtaccggtaacccggcccccgttccccgaaaccccgggg

SEQ ID NO: 195687 - DNA, 788 bp, Homo sapiens
  misc_feature: GYAE6OF01CWT9R.48.65.F10.1.454.CMB.1.raw
tcagagtatacatacacgaccggtgctcgatttagctacgctctaagggggctttctgagagtcatggacctcctgcacaagaacatgaaacacctgtggttccttcctcctcctggtggcagctcccagatgggtcctgtcccaggtgcagcctacagcgaggtggggcgacgaggacgtgttaggaacgtcccgttcgggacgacccgtcgtcccctcaccgtgcgtctttctagtggttcggtccttcgagttcggttactacgtggacgtcgtaggacgtccgaccgaccggaccccggaggggaacgggtccgtagggtacggtaggtaaggttaaggggaaactacgtaaacgtagtaaggttaggtaacggaaccgtaaccaaacccgtaaaccgtaacccgaaacccccgttcctacggaacgggtacgtacgagtaccaacctagtaactacgaagtacgaccacgtaccaaacgactacgtcctaccgtagacgtcgtagacgtctcgtacggaccgtacccgccggacgaaccgtacggtccttaggtaccgttaacgtttacgacggttacggacgtaaggtaggacggttaagtttacggttaagggttacgtaaaccgtacgtaacgtcgtttacgtacgttttacgttttccggggtaccggttaccgggttaccccgaccggggtccgggtacccggtaccgggtaacccgttccgggtaccttacccgtccctaccgtacgaccccggttacccgtcccggaaaccccggg

SEQ ID NO: 195688 - DNA, 617 bp, Homo sapiens
  misc_feature: GYAE6OF01ETM83.48.65.F10.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctanagcagtggggcncaggactgttgaagccttcggagaccctgtcccctcacctgccgcttttctatgggtcgggtccttcagtggtttactactggganctggatccgcacgcccccgagggaggggctggagtggagttggggaaatcaatcatagnggaagcaccaactaccaacccgtcctcaggagtcgagtcacatatcagtacgacacgtaccaaagaacctagttactccctagaagcgtgagtctctgtacgcccgcgcggacgacggctgtgtattacgtgtagcggagacggcggtaattagtttaggaacgttacgtaccgtagtcgtgtctttagttttcggttcccgggttagggttcccgtaacccccgggtgggggacccggtacgggtaaccccgttcgggtaccgacccggttccttcccgtaccacgtcccaccccgtaacccgg

SEQ ID NO: 195689 - DNA, 725 bp, Homo sapiens
  misc_feature: GYAE6OF01DNG4W.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactgttgaagccttcggagaccctgtccctcaccgtgcgtctttctagtggtcgggtccttcagttggttactacgtggagcgtggactccgccacggccccgaagggaacgggctggaggtggagttaggggaaatcaatcagtaggtggaagccaaccaactaccacccgtcctcaggacgtcgagtaccacatatcgaagtacgacacgtaccaaacgaaccagttacctacccgtagaacgtctagacgtcttacgtgtaccggaccgtcccggcggtaaccacgggtcgtaggttacgttacttaaccggtggtacggtaccggaaggtacggtccgggtaattacggtttacggttaacggtaaccgttacccggaaggttaccgttacggttacttttaacggtttttccggggtacccggttcgggtttaacccggaccccgggtttcggggggaccccgtaaacggggtaccccgttcgggtaaccccgtaaccggttccccgttacccgtaccgtaccgtcccccgttacccggaaacccggg

SEQ ID NO: 195690 - DNA, 630 bp, Homo sapiens
  misc_feature: GYAE6OF01CNL20.48.65.F10.1.454.CMB.1.raw
  modified_base (168)..(168): a, c, t, g, unknown or other
  misc_feature (168)..(168): n is a, c, g, or t
  modified_base (613)..(613): a, c, t, g, unknown or other
  misc_feature (613)..(613): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcncaggactgttgaagcctttcggagaccctgtcccctcaccgtgccgtctttctagtgggtgggttccttcgagtggttacctacgtggagctggactccgccacgccccgagggacgggcgtggagtggagttagggaaatcgaagtcagtagtggaacgcaaccaacctaccgaacccgtccctacgacggacgtacgacgtaccaacctatactacaagtacgacgaacgtaccaaagaacctacgttcctacccgtagacgtcgtagacgtactcgtacggtccgaccgccggacggacgacggtctgttagtacttcgtgtcgacggagacggtagattgtagtagtacgtcgagtcttaggtcttagttttcggtccggttcggtccgacccggttcgggacccgacgggtcccgtggtcctaccgtcctaccacgaccncccgtcccgtaacccgg

SEQ ID NO: 195691 - DNA, 975 bp, Homo sapiens
  misc_feature: GYAE6OF01BF535.48.65.F10.1.454.CMB.1.raw
  modified_base (167)..(167): a, c, t, g, unknown or other
  misc_feature (167)..(167): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtgggcncaggactgttgaagccttcggagaccctgtcccctcacctgcgtctttctagtgggtggtccttgagttcggttactacgtggagcgtaggactccgccacgccccgtaaggggacgggcgtggtagtggagttaggggaaactcgaatcgaagtaggtacggaacgccaaacctaactaacccaaccccgtccctacggaacgggtacgtaccggtaacgtacccaaccgtaactaacgtaccgtaaacgtaaacggtaacccgtaaaccgtttaacccgaaaacggtaaacccgtaacggtttacccttaaccccgtaacggtaaaaccgtcgttacgggtaacgtccgttaccgttacgggtacccggaccccgggtaacccgggaccccggggtaaaccgtaacccggggttccgtttaacgggtttaaccggtttaaacgttttaaaccccgggtgggtttaccgggaacggggtaaacggggttaacggtaacccggggtttaaagttttaaacgggtttaacgggtttaacggttaaacccgggttaaccgtaacgggttacccggtttaaccgggtttaccgttttttacgggtttttaccggggttaccccggggttttaccgggtttaaccccccgggggttaccccggggttacccggggggtaaccccgggttaaccccggggttaaacccccggtttacccggggttacccccgttaaccccgggttccccggtttaccccttaccccggtaacccggtaccccccggtttaaaccccggtaaaaccccccgggg

SEQ ID NO: 195692 - DNA, 753 bp, Homo sapiens
  misc_feature: GYAE6OF01B820A.48.65.F10.1.454.CMB.1.raw
  modified_base (169)..(169): a, c, t, g, unknown or other
  misc_feature (169)..(169): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcgaggtggggcncaggactgttcgaacgtccgttcggacgaccctgtcccctcaccgtgccgtctttctagtcgggttcggtccttcgagttcggttactacgtggagtcgtggactccgcccaccgccccggaaggggacgggcgtagggtacggtggaggttaggggaaactactaagtctagtaggtaggaacgccaaacccaactaacccgaaccccgtcctacgtaacgggactaccgacgtcccaacgaagttactacgaggtacgaaacctaccgtaaaccgaaacgtaaccgtaccgttccttacccgaggaaacctcgtagtacgtccgtcgttcggtcgaccccgtccgggacccgtacgaccggttcgtagttcgttaagttccgtgtacggacgaggtaacgcgtaagttacgttacggtacgttacgtaccgaagttccggttacgttacgttttaccggttttacgggttccgggttacgggttaccccgtacccggggttcggggtaacccgacgggttaacccgtccgtacgtaacccggttccctaccgtccgtacccgtcccgtcccgtaaccccggg

SEQ ID NO: 195693 - DNA, 950 bp, Homo sapiens
  misc_feature: GYAE6OF01EARX0.48.65.F10.1.454.CMB.1.raw
  modified_base (218)..(218): a, c, t, g, unknown or other
  misc_feature (218)..(218): n is a, c, g, or t
tcagagtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcacatctctgcacgtagaaccanctagtgattggttacggattactacttcgtctaccgtaggtaccaacgacgaccaacccgaggtaaccaaaaccgtaccccccaaaacttcaagttgtaagttttaagtaggaacgggtactaacggttaacgggcccgggtaccccgttacgggttaaacggggttttactaaaccgttccggttcctttccgtacggttccggtacccgttaacgtaaaccggttctaacgggaacccttaaacccggacccgggtccccttacccgggttagaaaccccgttaaacttacccgttccggggtttaccgggtaaccccctttacccggggaaaccggtttcccggtaaggggtaacggggaacgggtacgggtttacccgttaaagggtttaacctttttaaacggttttcccggtagttaccgtttccggttaccgttaacccgtaaagttttgaaccgggttaccaaaaggtttaaacgggttccgggtaaacttccgttacccggttaacggtttgggtttacgggttttaaacggttccccgggggtttaacggggtaaccccggggggttaaacggggaaaacccccgtttgggaaaccccccgggttttttaaacccggggaacccccccgttttaaccggggtttaacggggtaaccccccgaaccgggtttaaaccccccggggttaaaggtccccccgggtttaaaccccccccccggggg

SEQ ID NO: 195694 - DNA, 961 bp, Homo sapiens
  misc_feature: GYAE6OF01CQ3WY.48.65.F10.1.454.CMB.1.raw
  modified_base (148)..(148): a, c, t, g, unknown or other
  misc_feature (148)..(148): n is a, c, g, or t
  modified_base (168)..(168): a, c, t, g, unknown or other
  misc_feature (168)..(168): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtncagctacagcaggtggggcncaggactgtgaagccttcggagaccctcgtccctcaccgtgccgtcttttcagttgggttcggttaccttcgaggttaggttacctacgttgggagtcctgggtacctcccgccgaacccggacccccggaagggggtaacggggtccgtaggggtacggttaggggtacggttaacgggggaaaactaccgtaagtacgtaaggttaacggtaggtaaccggaaccctaaccccgaaaaccccgttaaaccccgtaaaccccccggttcccccgtaacggtaacgggtaaccggtttacccggaaccgttacccgaaacccgtaaactttacgtaccgtaaacgggttaaccgaaacccgtaaacccgtaaccccaaaaccggtaaacccgttaacggtttacccgtaaccccgttaaggaaccgttacccgtaggtaccggtccgttaccggtccggtaacccggaacccccgggtcccggtaccgggtaacccgtacgggtcctttacgggttaacggttaacgttttaacccggtggtaccgggtaacggtaacggtacgggtaacggttaacgtttaaggttttacgggtaacgttaacggtaccggttacgggtctttacggttcgttttaaacgggttttttccgggacccgggttttaaccgggttccccgggttaacccggggttccggggacccggttaacccggggttaacccgttcccgggttacccgttacccgttcccgttacccaccggtaccccgcccgttaccccggtaaacccgg

SEQ ID NO: 195695 - DNA, 888 bp, Homo sapiens
  misc_feature: GYAE6OF01DSF2J.48.65.F10.1.454.CMB.1.raw
  modified_base (159)..(159): a, c, t, g, unknown or other
  misc_feature (159)..(159): n is a, c, g, or t
  modified_base (171)..(171): a, c, t, g, unknown or other
  misc_feature (171)..(171): n is a, c, g, or t
tcagagtatacatacacgaccggtgctcgatttagctacgctctaagggggctttctgagagtcatggacctcctgcacaagaacatgaaacacctgtggttcttcctcctcctggtgcagcctcccagagtcgggtcctcgtcccaggtgcagctacngcgaggtgggcncaggtactgttgaacgtcgttcggacgtccctcgtccctcactggccttactttctaggttcgggtcggttacccttgacggtttcggttaactcggtggacgtcgtaggacctcccgaccgaccggaccccggaggggaacgggtcgtaggtaggtaggtaacggttaacgggaactacgtaacgtacgaagttacggtaacgggtaaccaacccgaaacccgtaaaccctacccggtaacccccgttacccgacgtaacggtaccggtacgtacgtaaccgactaacgtaactacggtacgtaacgtaacgaaccgtaacgaaacgtaacctacgtttaccaccgtaaggacgtacgtacgtacgtacgtccgttacggtacccgggaccgtcggtaaccggtaacgtaccggttcgtaagtttacggttacttaaccgggtgtacgtaccgggtagtacgggtacgttaacgtttagggttacggttaacggttaccgtaacccggttagttacccggtttacgtttaaccggtttttttacggttttcccgggggttaaccgggttccccgggtttaacccggggtaaacccccggggttcgggggttaaccccgttaaaccgggttccccgttaccgggttaccccgttaccccggtttccgtaaccccggttcgaaccccggtttccccgaacccccggttaaacccgggg

SEQ ID NO: 195696 - DNA, 718 bp, Homo sapiens
  misc_feature: GYAE6OF01DBKVE.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcagggtactggttgaacgccctttcgggaagacccctgtcccctcaccctgccgtcttttctagttcgggttcgggttcccttcgaggttggtttacctacgtgggacgcgtggactcccgcccgacggacccccggaagggggaacggggctagggaggtgggtagttaggggaaatacgaattcgaagtaggtaggaacgaccaacccaaacctaacccgaacccgtccctacgaacggtacgtacggacgtccaacctaatactaccgtaagtaacgaccgtacgtaccaaacgtaaccgtacgttccctaccgtagaacgtcgtagacgtctacgtcggtcgacccggccggcggaccgccgggtctaggttacgtacgttacgtggtcgaggaggacgtcgtaattgttagtaacgtacgtacgtgtcttcgttcgttttacgtttcggttccgggtccgggttaccgaccccgggttgggacccggacgggttacccgtcggtacccgtacccttcgtcccacgtccgcccgtaccgaacccgg

SEQ ID NO: 195697 - DNA, 720 bp, Homo sapiens
  misc_feature: GYAE6OF01EZRN2.48.65.F10.1.454.CMB.1.raw
tcagagtatacatacacgaccggtgctcgatttagctacgctctaaggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgactcacctatcctcctgccacgtggaacccagcctaggtgagttggttagggtactttaacttacctttgtctccgttaggtaaccaacacggaccaacccgacggaccaaaccgcccccgtaaactcagtcgtatttagaggaggacagtaacggccggtaccctcggtagggtttactaacgtcgtccttctcgtcggtcctacgtaagtcgtcggactaacgccgtcctaccctgacactcgtacgtcggcctacgacggacgtacggaggtacgacgggtacttaggtaactttacgttactcgtacttacggaccctttaaggacttaacgttccgagtaaacggtagttaacggtcgttacctaaccttgtaagtttcgggttaacggtttaccgggtacgggtaaccgggggaaaccggtaaccgtaacggtcccgttaaccgggtaaccccgtttaaccggtccggtttaaccgaacccgggttacccgtaaccgggtccccgttcccccgggg

SEQ ID NO: 195698 - DNA, 807 bp, Homo sapiens
  misc_feature: GYAE6OF01AN9T4.48.65.F10.1.454.CMB.1.raw
  modified_base (93)..(93): a, c, t, g, unknown or other
  misc_feature (93)..(93): n is a, c, g, or t
  modified_base (192)..(192): a, c, t, g, unknown or other
  misc_feature (192)..(192): n is a, c, g, or t
tcagagtatacatacacgaccggtgctcgatttagctacgctctaagggggctttctgagagtcatggacctcctgcacaagaacatgaaacncctgtgttcttcctcctctggtgcagctccagatcggtcctgtcccaggtgcagctacagcaggtgggcacaggtactggttgaacgtccgttcggacncccgttgtcccctcacctgccgtactttcgtagttcgggtcggttccttgaggttcggtttaacctcgtgggacgtcgtacggtacctcccgcccgaccggaccccggaaggggaacgggtcgtagggtacggtaggtaggtagggtaactctaagtcgtagtacggtagacgacctaaccgtaaccgtaaccgacccgtccgtagacggacgtacgtacgtaccaccgtatactcgaagtacgacgtacgtaacaacgaacctacgtccctacgtaggtacctcgtacggtacgtctacgggtacgtacccgggacccgtccgggaaccggtaccgtaccggtacgtttacggttacgttacgttacggtcgggttacgaccgggtagtacggtaccggttagttacggttaagggttcgtaaccgttaccgtacgtttagtttaccggttacgtttttaccgggtttcccggttaccgggtttcccggttacccgggtaccccggggttccgggtaacccgggtaaccggggttacccgtttccgggtaacccctttcccggtaccccgttcccgtaacccggtccggtaaccccgtacccgggtaaccccgg

SEQ ID NO: 195699 - DNA, 729 bp, Homo sapiens
  misc_feature: GYAE6OF01DD5WO.48.65.F10.1.454.CMB.1.raw
  modified_base (169)..(169): a, c, t, g, unknown or other
  misc_feature (169)..(169): n is a, c, g, or t
  modified_base (322)..(322): a, c, t, g, unknown or other
  misc_feature (322)..(322): n is a, c, g, or t
  modified_base (565)..(565): a, c, t, g, unknown or other
  misc_feature (565)..(565): n is a, c, g, or t
tcagagtatacatacacgaccggtgctcgatttagctacgctctaaggggggctttctgagagtcatggacctcctgcacaagaacatgaaacacctgtggttcttcctcctcctggtggcagctcccagatgggtcctgtcccaggtgcagctacagcaggtggggcnaggactgttgaagccttcgggacgaccctgtcccctcacccgtgccgtccttttctagtgggttcgggtccctttgacggttcggttactacgtgggagtcgttggactccgccacgccccgaggggagggctgggaggtggagtagggaatnaatcagtagtggaacgccaacctaactacccaaccccgtccctacgaacggtacgtcgacgtccaacctatactagaacgtacgacctacgtaaccaacgtaacctgttaccctccgtaagacgtcgtagtacgtctacgtgtaccggaccgacccggcggaccggtcgtacgttcggttagtactttacggtggtgacggtacggacggtacggtaattgttaaggttaaggtacgtaccgngttccgttcgttactttttacggtttaccggttccgggttaccgggtttccccggacccgggtcgggggtacccggttaacccggggtccccgttcgggtacccgttacccggttcccgttacccgaccggtcccggttcccccgaacccgggtaaaccccggg

SEQ ID NO: 195700 - DNA, 875 bp, Homo sapiens
  misc_feature: GYAE6OF01B2S92.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcgagtggggcgcgaggactgttagaacgtccgttcggacgacccgtgtccctcaccgtgccgtctttctagtgggtcgggttccttacgtaggttacggttacctacgtgggacgcgttacggactcccgaccacggacccccgagggggaacgggcgtgggtaggtaggtaggttacggggaaatacaacgtcgtaagtacggtaggaagaccaaccaaccgtaacccgtaaccccgtcccgtacgaacggacgtacggacgtaccaacataacgtcgaagtacgacgtaaccgtacaaacgtaacctacggttacctacccgtaggaacgctaggacgtcttacgtggtccggaaccccggccggtaccggaaccgtaccgggtcgtttacggttacggttaactttaccggttagggtacggacgggtaaacggtacggggaaccggttaagtttacggtttaaaggttaacggtttaaccggttaacccggtaacggttccgttaggttttaccgttttaaaccgggttttttcggggttaccccggtttaccgggggttttcccccggaacccccgggggtttaccgggggtaaccccgggtaacccggggttaaaccccggtttccgggtaccccccgttaacccgggttcccgttaccccccgtaccgggttaaccccgtccccccgttaaaccccggtaaacccccgggg

SEQ ID NO: 195701 - DNA, 1080 bp, Homo sapiens
  misc_feature: GYAE6OF01A96IU.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctaacagcaggtggggcgcaggactggttagaagccttcggacgaccctcgtccctcaccgtgccgtcttttctagttggggtcggttccttcgtaggttcggttaactacgtgggacgcgtagggactcccgccgaccggaccccccggaagggggaacggggtccgtagggtaggttagggtaggttaacgggggaaattacgaaatcgaagttaggtagggaaaccgacctaacccgaaactaaccgtaaccccggtacccgtacgaacgggtacggtacggtaacgtacctaacccgaattaacgtaccgtaacgggttaaacggaaccctaacccggtaacccgtaaaacggtaaaccccggttaaccggttttccccgtcccccggttaaggtaaaaaccgggtcccgttaacgggtaaaccgttcccgtttacccgtttaacggggttaccccggggaacccccccgggtacccggggaaccccggggtaaacccggtaaacccggggtttcctttaacgggggtttaacgggtttttaaaccgttttaacccgggtttaggggttaccgggaacccggggtaaaacggggtaaccgggttaacccggggtttaagttttaaaccgggttttaacgggtttaaacccgggtttaaacgtaacccccgttaagggttcccggtttaaacggttttccgtttttaacgggtttttttttacccgggggtccccggggttttttacggggtttaaccccccggggttaccccccgggggttaggggggtaaccccccggttaaaaccgggggggttacccccccgtttacggggtacccccgttaacccccgggtttaccccgttacccccgtttacccgggaacccccggttccccccgttaaacccccgggaaacccccgggg

SEQ ID NO: 195702 - DNA, 640 bp, Homo sapiens
  misc_feature: GYAE6OF01DCQ1I.48.65.F10.1.454.CMB.1.raw
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
tcagagtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcacgcctgcctccgtgtctgggtctccgtggacagtcgatcaccagtcctcctgcacgtcggaacngcagtgagttggtagggatttactaaccttcgtctccgtcggtaaccacagaccaccgaggaccaaaccgcccctaaactcatgtacttagngagacagtacgccgcctagtagggttctaagtcgtcttctacgtcgctactagtcgtcgacacgtaccgcctccagtactaacgtcgtacgtacggtcctaccgacggtacgtaggaacgggtacggtacggtactttaagtacgtttatttaccgagttccgtcggtacttacgtattacgacgtaacggaacgtagttacgaaccgtctaacgtcgtaggttacgttcggtaacgggtccgggacgggtaacggtacaacggtcccgttacggaccccgttacggtaccgtacgaccggaccgtaccggccgtcccccgg

SEQ ID NO: 195703 - DNA, 693 bp, Homo sapiens
  misc_feature: GYAE6OF01BN0YM.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactgttgaagccttcggagaccctgtcccctcacctgccgtctttctagtggtggtccttcagtggttactacgtggagctggactccgccacggccccgaggggaagggcgtggaggtggagttagggaactcaatcgagtaggtaggaagaccaaccgtaacctaaccgtaaccccgtccctacgaacgggtacgtacgacgtaccgaccgtaataacgtacgtaacggtacgaaccaccgtaacccaaacgtaaaccctaacttacctacccgtagaacgtcgtagacgtctacgtcgtccgacccgtccgacacgacgacgtcttacgtacttatacgtgtacgcggacccggacccgaggccgcggtacggttcgttaccgtttttagacgtttacggttcttagggtacgttagggttcgggtacgggggaaccgtaagggtaaccgtaggttcgggtaccctacccgggttcctacgttccgaccgccccgttaaccgacccgggtaacccggg

SEQ ID NO: 195704 - DNA, 835 bp, Homo sapiens
  misc_feature: GYAE6OF01BD7AN.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactgttgaagccttcggacgaccctgtccctcacctgcgtctttctagtggtggtccttcagttggttactacgtggacgcgtggactccgccacgtcccccgaggggaacggggctggagtggagttaggggaatcaatcaagtaggtaggaagccgaacctaacgtaaccaaccccggttcccctacgaaggtacggtaccgaacgtccgaacctaatactcgaagtacgaaccacgtaccaaagtaaccctagttccctaccgtagacgcgtagacgtcttctacggtaccggaccccggccggtaccgggaaccgacgggtcgtacggttacggtttaacttaacggttcgggtacggtaccggaaggtacggtaccggttaagtttaacgttttaaggttaacgggttaaaccggttacccgaaggttccgtttacgggttaccgttttttaacgggttttttccggggttacccgggggttttacccgggttttccccccgggtaaacccccgggggttcgggggggtaaccccccggtaaacccgggggttaaacccccgtttcggggtttacccccggtaacccgggtttcccccgttaaccccgtttacccgaaccccggttccccccgtaaacccccgggtaaacccccgggg

SEQ ID NO: 195705 - DNA, 883 bp, Homo sapiens
  misc_feature: GYAE6OF01EMV9Q.48.65.F10.1.454.CMB.1.raw
  modified_base (169)..(169): a, c, t, g, unknown or other
  misc_feature (169)..(169): n is a, c, g, or t
tcagagtatacatacacgaccggtgctcgatttagctacgctctaaggggggctttctgagagtcatggacctcctgcacaagaacatgaaacacctgtggttcttcctcctcctggtggcagctcccagatgggtcctgtcccaggtgcagctacagcaggtggggcncagggactggttgaacgccttcggacgaccctggtcccctcaccgtgccgtcttttcagttgggtcgggtcctttacgagttcggtttaacctacgtgggacgtcgtagggacctcccgccaaccgcccccggtaagggggaacggggccgtagggtaggtaggtaggttaagggggtaaactacgtaaacgttcgaagttaagggtacgggaaacgcccgaaacccgtaacccgtaaacccgtaacccccggttaccctacggaacgggtacggtaccggacgttaaccgaaccctaagttaactaccggtaaacggtaacgtaaccgaaccggttaaccccgaaaacggtaaaccccctacgggttttacccctaacccccgttaagggaaaccggtaccgttagggaacccgttccttacccgttacggttacccggggaaccccggtccccggggtaacggaaacccgacgggtcgttacgggttagtttaacgttacgtcggtaggaccggtaaggtacggacgggttaattaggttacgtaacgttacggtaactacgtcgttagttaccgttttacgttttcgggtacccgggttcgggttacccgtaccccggtcggggtacccgaacccggggttaacccttcgggaacccgttcccggtacccttccgggaccctaccggtcccctaaccccggtaaacccggg

SEQ ID NO: 195706 - DNA, 903 bp, Homo sapiens
  misc_feature: GYAE6OF01A0E2P.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtgggcgcgaggactgttgaacgccgttcggacgaccctgtcccctcaccgtgccgtctttctagtgggttcggtccttcgtagttcggttacctacgtggagcgtaggactcccgaccgaccgcccccggaggggaacgggcgtagggtaggtaggtaggttaggggaaatacgaatcgagtaggtaggaacgaccaaccgtaacctaccgaaccccgtacccgtacgaacggtacggtaccgacgtaccacctaatacgtaccgaaggtacgaaccgtaaccggtacccaaaacggtaacccgttacgttacccctacccgtaggtaaccgtacgtacggtacgtcccgttacgtacgggtaccgggaccccggacccggtacccgggaaccgtaccgggttcgtttacggttacgtttaacgtttaccggtaggtaccggtacgggtaagggtaccggtaacgggttaactttaaggtttaccggttaaacgggtaccgttaacccggagtttaccgttaggtttacccgttttaggttttttacccggggcccgggttttaccggggttccccccggttaaaccccgggggtttccggggggtaacccccgggttaaacccgggggttaacccccggtttaccgggttacccccggttaaaccccccggttccccgttaacccccggtaccccgttaaccccggtccccccgttaaacccccgggtaaaccccccgggg

SEQ ID NO: 195707 - DNA, 738 bp, Homo sapiens
  misc_feature: GYAE6OF01BJI7W.48.65.F10.1.454.CMB.1.raw
  modified_base (609)..(609): a, c, t, g, unknown or other
  misc_feature (609)..(609): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcgaggtggggcgcgaggactgttgaagtccgttcggacgaccctcgtccctcacctgccgtctttctagtcggtcggttcctttcgaggttcggttactacgtggagtcgtacggactcccgaccgaccggtacccccggaaggggaacgggcgtaggaggtacgggtagttaaggggaaatacgaagtacgtagtaggaggaactaccgaacctaacctaaccaacccgtaccctagtaaggacgtacgacgtaccacagtacacgtacgtaacgaaccaccgtaaccgaaacgtaacccgtagttacccgtacccgtagaacgtccgtaggacgtcgttaccgtgtacccggaaccccgtccggacccggacgaccgtcgttaggtacgtttaattccgtggtacgaccggtaaggacgcgttaagttagttagtaacggtacgtaccgngttcttacggttacttttacgtttccgggtacccggtttcggtacccggttcccgggtgggtaccccggaacgggtacccggttcgtacccgtcctccgttcccacgcccgttacccgtcccgacccgg

SEQ ID NO: 195708 - DNA, 775 bp, Homo sapiens
  misc_feature: GYAE6OF01C8MJV.48.65.F10.1.454.CMB.1.raw
  modified_base (168)..(168): a, c, t, g, unknown or other
  misc_feature (168)..(168): n is a, c, g, or t
  modified_base (467)..(467): a, c, t, g, unknown or other
  misc_feature (467)..(467): n is a, c, g, or t
tcagagtatacatacacgaccggtgctcgatttagctacgctctaagggggctttctgagagtcatggacctcctgcacaagaacatagaaacacctgtggttcttcctcctcctggtggcagctcccagatgggtcctgtcccaggtgcagctacagcaggtgggcncaggactgttgagtccttcggacgaccctgtccctcaccgtgcgtctttctagtggtcggtccttagagttacggttactacgtggagcgtgggacttccgaccgaccgaccccggtaggggaacgggcgtagggaggttagggtaaggttacggggaaactactaacgttacaaggtaggtaaggaacgtccaaaccgtaacctaccgaaccccgtccacgtaggactacgacgtaccaacgtatactcgaacgtacgacaaccgtacaaacgactacgttaccctacgtacggaaancgttacgacgtccgttacgtcggtacccggacccggtacccggggacggtacccgtaacgggtccttcgggtacgtttaacgttaccggtggttacgaacgggaacgggttacggacggtaacgtttaaggtcggttaacgggttaaccgtaccgaagttcgttacggtttacgttttacggtttttccggacccggggttcggttacccggtcccgggttacgggtaccccggtaccgggtacccgttaggtcccccgtacgttcccgtaccgtaccaccccggtaccctaaccccggtaacccggg

SEQ ID NO: 195709 - DNA, 763 bp, Homo sapiens
  misc_feature: GYAE6OF01D9YVO.48.65.F10.1.454.CMB.1.raw
  modified_base (169)..(169): a, c, t, g, unknown or other
  misc_feature (169)..(169): n is a, c, g, or t
tcagagtatacatacacgaccggtgctcgatttagctacgctctaagggggctttctgagagtcatggacctcctgcacaagaacatgaaacacctgtggttcttcctcctcctggtggcagcctcccagatgggtcctgtcccaggtgcagctacagtcagtggggcncaggactgttgaagccttggagaccctgtcccctcacctgcgtctttctagtggtgggttccttcagttcggttactacgtggagcgtggactccgccgacgccccgaggggaacgggctggagtggtagttgggaaatcaagtcaagtaggtaggaagccaaccaactaccaaccccgtcctacgacggacgtacgacgtaccacaatactacgaacgtacgaaccgtaacgtaccgaaacgaacctacgttaccctaccgtaggaacgtcgtacgacgtccttacgtcgtaccgacccggccgaccggaaccgtacgggtcttaggtacgttaacgttacgtcggtacggaccggagtacggtacggtaactttaggttacggtaacggttacgtaaccgtaggttccgttacgttaccgttttaaggtttttccgggccccggggttttaggttacccccgggttaccccggggttacgggggtaaccccgggttaaaccgggttaacccccggttcgggttaaccccgtaccccgttcccggtttaccccgtacgtacccgggttaccccctacccggtaaaccccgggg

SEQ ID NO: 195710 - DNA, 833 bp, Homo sapiens
  misc_feature: GYAE6OF01EL81K.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggacttgttgaacgcccttcgggacgaccccttgtccccctcaccgtgccgtctttctagtggtcggctccatcagcagctagtacttacgttcgtgggctggctcccgccacgccccgaggggagggcgtggaggtggagttggggtagttacgtttaaccgacggtaggtggggacgcctaaccctacctaaccccgaaccccgtacccctaacgaaaaacggtccggaacggaccaaccgtaacgttaaccgtacccgtaagtaaccaaccggtaaccaaacggtaaaccctaacgtttacccttccccgtaagtaaccgtacgtaggtacgtacctacgtcggttaccggaccccgtcccggaccgtacggaaccgaccggtacgttaccggtttaccttaacgtttaccggttcggttacgggacccgggtacccggggtaccccccgacgggtacccggtacggtacgggtttcgggtttacgtttttacggtacgtttaccggttcccgttttagtaccggtttacgttaccgggggggtaccggggttaaaccgggaacgggtaaccggtttaaacggtacccggttacccggttacccccggttttccctacccggttttaccccgtaacccggtcccccgttaaaccccccggg

SEQ ID NO: 195711 - DNA, 941 bp, Homo sapiens
  misc_feature: GYAE6OF01A8BZG.48.65.F10.1.454.CMB.1.raw
  modified_base (165)..(165): a, c, t, g, unknown or other
  misc_feature (165)..(165): n is a, c, g, or t
tcagagtatacatacacgaccggtgctcgatttagctacgctctaagggggctttctgagagtcatggacctcctgcacaagaacatgaaacactgtggttctcctcctctggtgcagctccagatcgggtcctgtcccaggtgcagtctacagcacggtgggcncgaggtactcgttgaacgtccgttcggacgtccctcgtccctcaccgtgaccgtctttacgtagttcggttcggttccttagtacggttcggtttacctacgtggacgtcgtacggacctccgccgaccgacccccggaggggtaacggcgtagggtaggtacggtaggttaacgggaataccgtaactcgaagttaggtacggaacgtaccaaacctaaccgtaaccgtaacccggtccctacggtaaggtcgttaccggacgtaccgtaacctacgtaactcgtaacggtaacgacccgttaacccgtaaccgaaacggtaacctacgtttaccccgtaccgtaagaacggtacctaggtaccggttcttacggttaccgggaccggtaccccgggacccggtaaccgggaaccgtaccgggttcgttcgggttaacggtaccgttttaacggtaccgggttcgaaccgggtaggttaacgggtaccgttaagttttacggtttaacggttaacggtttaaaccgttaccccgggtaaaggttttcccgtttacggttttaaacccgtttttttacgggggtttttcccggggttccccggggtttaaacccgggttttccccccgggacccccggggtttacccggggggttaaccccgggaaccgggtttacccccgggtttaaccggttaccccttaaccccccggggttctttaaccccccggtaccccgtaaaccccgttccccccggtaaaccgggtaaccccccggg

SEQ ID NO: 195712 - DNA, 787 bp, Homo sapiens
  misc_feature: GYAE6OF01CPOEX.48.65.F10.1.454.CMB.1.raw
  modified_base (179)..(179): a, c, t, g, unknown or other
  misc_feature (179)..(179): n is a, c, g, or t
tcagagtatacatacacgaccggtgctcgatttagctacgctctaaggggggggtcacaagaggcagcgctctcgggacgtctccaccatggcctgggctctgctgctcctcactctcctcactcgaggacacgagggtcctgggccagtctgccctgactcacgtcctcgcctccgtntcgtacggtctccgtggactcgtcgactacaccgtactcctcctacgactacgtacgggaaacctcgtacgtagtagtacggtttcgggtagggtacttactacgttcgtcgtacgtacggtaacctaacgtaacgacccaaccgaacggacctaaaccgtaccccctaaatactaacgtacgtaactttagacggaacgtaacgtaggtaaccggccgggtaccttacgggttaaccggttactaacggttccgtacgttcctcgtcgtactaccgtaacgtacgtacgacgtaacccggaaccggtccctaccgaagtaacctaacgttcgtccgtacggtccctacgtacgggtcgtaagggacccggtacggacgtcgtactttagttaaccgttacgtccgtacgtacgtacgtctaacggttctaacgggtactaacgtaaccggtacgttccgaaccttaggtacggttaacgtcggggttaaacggtcggtaacgggtaaccgggtaaaccgtaacggtaaccggttccgtaaccccggtacggttaaccgtaaacgggtacccgtaccgggaaacctaccgggtccccgtaaccccggg

SEQ ID NO: 195713 - DNA, 809 bp, Homo sapiens
  misc_feature: GYAE6OF01BPFJH.48.65.F10.1.454.CMB.1.raw
  modified_base (153)..(153): a, c, t, g, unknown or other
  misc_feature (153)..(153): n is a, c, g, or t
  modified_base (168)..(168): a, c, t, g, unknown or other
  misc_feature (168)..(168): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagagtgggtcctgtcccaggtgcagntacagcaggtgggcncaggactgttcgaagtccgttacggacgaccctgtcccctcacctgccgtctttcgagttgggtcggtaccttgagttcggttactacgtggagtctggactccgccgaccggaccccggaggggaacggggtctagggacgtgggtagttacgggggaaactcgtaaactacggtaagttaacggtaacggaaccgtacccgaaaccgtaaaccctaacccggtaaaccccgttccccgtaacggaacgggttaacgtaccggaaccggttaccaaacccgtaatttacgacgtaaacggtacgaaccgtaccgtaaccgaaacgtaaccgtaccgtttaccctaccggtagaaccgtcgtagacgtccgttaccgtcggtaaccgtacccggtacccggacggtaccgtaacgggtcgttggtacggtttaacttacgggtggtcggtacggtaagggtcgtaccggtaatttaggtaggttaacgtaccggtacctagttccgttaggtaccgttttcggtttcgggttaccggtttccgggtacccgggtacccggtccgggtaacctaacccggggtccgtacggttacccctaccggtcccttacccgtaccgcctccccgcccgtaaacccggg

SEQ ID NO: 195714 - DNA, 576 bp, Homo sapiens
  misc_feature: GYAE6OF02J0KXB.48.65.F10.1.454.CMB.1.raw
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
tcagagtatacatacacgaccggtgctcgatttagctacgctctaaggggctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctttctatggtgggtccttcagtggttactactggagctggatccgccagccccaggaagggctggagtggattggggaatcaatcatagtgaagcacgaactacaacccgtcctcaggagtcgagtcaccatatcagtagacacgtccaagaccagttcnccctgaagctgagctcngtgacccgccgcggacacggctgtgtattacgtgttggcgagtagccgggtatacgtttggtaagtagtaccgagtcttggtccttaagttttttcgccggttggtttccggaccccgtgggggtacccctaggggtaaccccttgggtccacccggttctacccgttcaacgtcccctccgtaaccccgg

SEQ ID NO: 195715 - DNA, 563 bp, Homo sapiens
  misc_feature: GYAE6OF02IUW22.48.65.F10.1.454.CMB.1.raw
  modified_base (433)..(433): a, c, t, g, unknown or other
  misc_feature (433)..(433): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttcatggtggtccttcagtggttactactggagctggactccgccagcccccagggaacggggctggagtgggagttggggaaatcaatcatagtggaagcacaactacaacccgtcctcaggagtcgagtcacatatcagtagacactacaagaaccagttctccctagaagctgagctctgtgacccgccgcggacgcggctgtgtattactgtgcgagngcggatagttgtagtagtaccagtcttgtcttagttttcgtccgggttggtttccgaccccggtggggaccaagggtaccccgtggtaccacccgttcttcccgtaccgtacgtcccctaccgaacccgg

SEQ ID NO: 195716 - DNA, 566 bp, Homo sapiens
  misc_feature: GYAE6OF02H13UZ.48.65.F10.1.454.CMB.1.raw
  modified_base (167)..(167): a, c, t, g, unknown or other
  misc_feature (167)..(167): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctttcatggtgggtccttcagtggttactactggagctggatccgccagcccccagggagggctggagtggattggggaaatcaatcatagtggaagcaccaactacaacccgtcctcaggagtcgagtcaccatatcagtagacacgtaccaaagaaccagttcctccctagaagctgacgctctgtcgaccgccgcggacacggctgtgtattactgtgcgagagcggatagttgtagtagtaccagtctgtcttagtttttcgtccggttggtttccgacccccggttgggggaccctacggggtaaccccttgggtccacccggttctcccgtcacggtccctaccaacccgg

SEQ ID NO: 195717 - DNA, 540 bp, Homo sapiens
  misc_feature: GYAE6OF02IBPEP.48.65.F10.1.454.CMB.1.raw
  modified_base (258)..(258): a, c, t, g, unknown or other
  misc_feature (258)..(258): n is a, c, g, or t
  modified_base (349)..(349): a, c, t, g, unknown or other
  misc_feature (349)..(349): n is a, c, g, or t
tcagagtatacatacacgaccggtgctcgatttagctacgctctaaggggggggtcacgaagaggcagcgctctcgggacgtctccaccatggccctgggctctgctgctcctcactctcctcactcaggacacagggtcctgggcccagtctgccctgactcagcctgcctccgtgtctgggtctcctggacagtcgatcaccatctcctgccactggaccagcagtgatgtggattataactgtctctggtacacngcacccagcaagccccaaactcatgatttatgagacagtaacgcggcctgagggtttcaatcgcttcgtctggctcgaagtctggacaacncgcctcctgacaatctcgtggctccaggctgaggacgaggctgattattactgctgctaccatcgtgacctagtactacgttacgcctaacgtacagttcggtggttacgttccgggacgggaacgggaaccaaggtccgtacggacccgtccgtaacgggtaccacggtacccgagggtcccttccccgg

SEQ ID NO: 195718 - DNA, 584 bp, Homo sapiens
  misc_feature: GYAE6OF02GQF16.48.65.F10.1.454.CMB.1.raw
  modified_base (151)..(151): a, c, t, g, unknown or other
  misc_feature (151)..(151): n is a, c, g, or t
  modified_base (154)..(154): a, c, t, g, unknown or other
  misc_feature (154)..(154): n is a, c, g, or t
  modified_base (157)..(158): a, c, t, g, unknown or other
  misc_feature (157)..(158): n is a, c, g, or t
  modified_base (160)..(160): a, c, t, g, unknown or other
  misc_feature (160)..(160): n is a, c, g, or t
  modified_base (162)..(163): a, c, t, g, unknown or other
  misc_feature (162)..(163): n is a, c, g, or t
  modified_base (166)..(166): a, c, t, g, unknown or other
  misc_feature (166)..(166): n is a, c, g, or t
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (195)..(197): a, c, t, g, unknown or other
  misc_feature (195)..(197): n is a, c, g, or t
  modified_base (199)..(200): a, c, t, g, unknown or other
  misc_feature (199)..(200): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
tcagagtatacatacacgaccggtgctcgatttagctacgctctaaaggggaaagggagaacttgacaaaactttggactggtcgttaccatcgttacccgcccatcctgatattgtatacctctgagcggctggcaacggcgcaactagnganatnntncnntcncancnctntntntncgagagncnctcncnnngnncngngtntgananctactntntagtacaagacgacgngcgcgcncncgcncncatngntncacacacgacgcgcgngcacacacgactcgtgngngngtgtggtcgacggacgactactctactactacctacacacacgacgacgtacgacgtacgtacgtaacgtaacgtacgttacgtttacgtttacgttacgtacgtacgtacgtacgtacgtacgttacgttacgtacgtacgtccgtccgtaccgttaccgttaccggttaccgggtacgggtacggtacggtacggacggaacgtacgtaacgtaaccggtaacgtcggtacggtaccgtacgtaccgtaccgtacgttacgttacgttcttaccttaccgtaccg

SEQ ID NO: 195719 - DNA, 578 bp, Homo sapiens
  misc_feature: GYAE6OF02I9XHL.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggactccgccacgcccccgaggggaagggctgggagtggagttggggaaatcaatcatagtggaagcaccaactacaacccgtcctcaggagtcgagtcaccatactcagtacgacacgtacaaagaaccagttctcccgtagaacgtctagacgcttctgtcgaccgccgcggacacggctgtgtattacgtgtgcgagagcggtattagttgtagtagtaccagtctgtacttgttttcgtccggttggttaccgaccccggttggggacccgtaacggggtaccctcggtccgtaccggtcctccgtacacgtccctcctaacccgg

SEQ ID NO: 195720 - DNA, 577 bp, Homo sapiens
  misc_feature: GYAE6OF02FHFRZ.48.65.F10.1.454.CMB.1.raw
  modified_base (167)..(167): a, c, t, g, unknown or other
  misc_feature (167)..(167): n is a, c, g, or t
  modified_base (204)..(204): a, c, t, g, unknown or other
  misc_feature (204)..(204): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (458)..(458): a, c, t, g, unknown or other
  misc_feature (458)..(458): n is a, c, g, or t
  modified_base (556)..(556): a, c, t, g, unknown or other
  misc_feature (556)..(556): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagcctttcggagaccctgtcccctnacctgcgctttcagtggtggtccttcagtggttactactggagcctggactccgccagcccccagggaacggggcnggagtggattggggaaatcgaatcatagtgaancgaccaactaccaaccgtccctcaggagtcgacgtcaccatactacagtacgacgtaccgtacccaaacgaaccagttacctcccgtagaacgtctgacgtctacgtcgtcgacccgccgcggaccaccggtctgtgtacttcgngtgcgagacgcggattagtgtagtacgtacagtctgtctttagtttcgccggttgtccgtacccgtggggccgacggtaccctgtccgccgtctcccncgaccgtcctaccgaacccgg

SEQ ID NO: 195721 - DNA, 638 bp, Homo sapiens
  misc_feature: GYAE6OF02I1859.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactgttgaagcccttcggagaccctgtcccctcacctgcactgtctctggtgctcatcagcagcagtacttcttcgtgggctggactccgccacgacccccggaggggaacggggcgtggaggtggagttggggagttacttaccgacgaggtggacgctacctaacaccgacccgtcctacaaacgtcgaacgcacatactaccgtacgacaccgtacgaacgaacctaattcctcctagaacgctagacgtctcgtgtacgaccgccgacgtacgacgtacggctacgttacttacgttacgtcgtacggaccggaccggtcccgacgtccgcgtacggttcgttacttttaggactcgttccgtttagtacgttaggttcggtaaccggggaccgtaaacgggacctaaacggttccggtaccgttaaccccggttcgttacccgttaccgaccgtaccccgg

SEQ ID NO: 195722 - DNA, 587 bp, Homo sapiens
  misc_feature: GYAE6OF02ISEZ5.48.65.F10.1.454.CMB.1.raw
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgtctttctatgggtgggtccttcaggtggttactactggagctggatccgccagcccccaggggaagggctggagtggagttggggaaatcaatcatagtggaacgcaaccaactaccaacccgtccctacaggagtcgagtcactatatcagtanacacgtaccaacgaaccagtctccctagaacgctgagctactgtacgaccgccgcggacacggntgtatatacgtgcgcgagngcggtatagttgtagtacgtacagtctgtacttaagtttttcggaccgggttggtttcccgacccggtgggtacccgtacgggtaacccgttggtaccgtacccggtccttcccgtcgaccgtccctaccgtaacccgg

SEQ ID NO: 195723 - DNA, 538 bp, Homo sapiens
  misc_feature: GYAE6OF02GI0Q0.48.65.F10.1.454.CMB.1.raw
  modified_base (418)..(418): a, c, t, g, unknown or other
  misc_feature (418)..(418): n is a, c, g, or t
tcagagtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgaggacagtaagcggcctcaggggtttctaatcgcttctctggctccaagtctggcaacacggcctccctgacaatctctgggctccaggctgaggacgaggctgattattactgctgctnatatgcagatagtagctactctagtgtggttagttccgggacgggtaacgggaaccgaagtccgtacggtacccgttaccgttacgggtaccacggaccccgtaacggccgttaccccgg

SEQ ID NO: 195724 - DNA, 575 bp, Homo sapiens
  misc_feature: GYAE6OF02FF3HD.48.65.F10.1.454.CMB.1.raw
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
tcagagtatacatacacgaccggtgctcgatttagctacgctctaagggggctttctgagagtcatggacctcctgcacaagaacatgaaacacctgtggttcttcctcctcctggtgcagctcccagatgggtcctgtcccaggtgcagctacagcagtggggcgcaggactgttgaagccttcggagaccctgtccctcacctgcgctttctatggtgggtccttcagtggttactactggagctggactccgccagccccccaggggaagggggctgggagtggattgggggaaatcaatcatagtggaagcaccaactacaacccgtccctcaggagtcgagtcaccatatcagtagacacgtccaaagaaccagttctccctgaacgctgagctcngtcgaccgccgcggaccncggctgtgtattactgtgcgagagcggaattgtagtagtataccagctgtcttagtttttcgccggtttggttccgacccggttcggggccctaacggggtaaccccttgggtaccgacccggttccttcccgtccgacgtcccgtcccaacccgg

SEQ ID NO: 195725 - DNA, 571 bp, Homo sapiens
  misc_feature: GYAE6OF02I6H6K.48.65.F10.1.454.CMB.1.raw
  modified_base (247)..(247): a, c, t, g, unknown or other
  misc_feature (247)..(247): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctttctatggtgggtccttcagtggttactactgganctggatccgccagcccccagggaaggggctggagtggattggggaaatcaatcatagtggaagcaccaactacaaccccgtccctcgaggagtcgagtccaccatatcagtacgacacgtccaaagaccagttcctcccagaacgctgacnctctgtcgacccgcggcgacncggctgtgtattactgtgcgagngacggtatagttntaggtacgtacgagctgctttagttttcggccggttggttccgtacccggtggggaccctacggggaacccttcgggtaccctaccgtcttccctcgacgtccctaccgaacccgg

SEQ ID NO: 195726 - DNA, 559 bp, Homo sapiens
  misc_feature: GYAE6OF02GQB96.48.65.F10.1.454.CMB.1.raw
  modified_base (293)..(293): a, c, t, g, unknown or other
  misc_feature (293)..(293): n is a, c, g, or t
  modified_base (423)..(423): a, c, t, g, unknown or other
  misc_feature (423)..(423): n is a, c, g, or t
tcagagtatacatacacgaccggtgctcgatttagctacgctctaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataccttgtctcctggtaccacagcaccaggcaaacgcccccaaatcatgatttangaggacagtaagcggcctgagggtttcaatcgcttcgtctggcctacaagtctcggcaacaccggcctccctgacaactctcgtgggcctccgaggccgtaggacggacgacggctagatttattacgtncgttgctctagtatcgacagtagtagtacgactactcagttcgtaggttacgtccgggagggaacgggaccaacggtccgtaccggtacccgttccgtacgggttaccaccggtaccccgacggtcctacccccgg

SEQ ID NO: 195727 - DNA, 644 bp, Homo sapiens
  misc_feature: GYAE6OF02FZ9PH.48.65.F10.1.454.CMB.1.raw
tcagagtatacatacacgaccggtgctcgatttagctacgctctaagggggctttctgagagtcatggacctcctgcacaaagaacatgaaacacctgtggttcttcctcctcctggtggcagctcccagatgggtcctgtcccaggtgcagctacagcagtggggcgcaggactgttgaagccttcggagaccctgtccctcacctgcgtctttctatggtggtccttcgagtcggttactacgtggagctggactccgccacgcccccgaggggaaggggcgtgggagtggagttggggaaatcaatcagtagtggaagacaccgaactaccaacccgtccctacgaggacgtcgagtccaccatatacagtacgacaaccgtacaaacgaccagttcctccctagaacgctagcgtactctcggtcgacccggccggacggaccacggtcgtgtcgttaacttacgtggtcggacgagtaggtggagttagttagttaagtacgtacctaggtcttagtctttaggtttttcgtccgggtttcggttcccggtaccccgggtcggggtaccctacgggggtaaccccgttgggtaccctaccgggttccctcccgtccgaccgtccccgtacccaacccgg

SEQ ID NO: 195728 - DNA, 699 bp, Homo sapiens
  misc_feature: GYAE6OF02JOWIP.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgtctttctatggtggtccttgagtggttactacgtggagcgtggactccgccacgccccgagggaacgggctggagtggagttaggggaaatcaatcgagtaggtaggaacgcaaccgaactaaccaaccccgtccctacgaaggtacgtacgtacgtaccaaccgtatactacaagtacgacgacgtaccaaacgaacctacgttacctacccgtagaacgtcgtacgaacgtctacgtgtaccgacccgtccggacggaccacggtctcggttagtacttacgtgtacgtacggagtacggacggtaattagttacggttacgttaacggtaaccgtaggtcttgttacgttttaacgttttcgggttacccgggtttcgttacccgggtaccccggttcgggggaccttaacccggggtaacccgttcgggtacccgttaccggttcccttcccgtaccgtaccggtccccgtacccgtaaccccggg

SEQ ID NO: 195729 - DNA, 538 bp, Homo sapiens
  misc_feature: GYAE6OF02GDPXD.48.65.F10.1.454.CMB.1.raw
  modified_base (435)..(435): a, c, t, g, unknown or other
  misc_feature (435)..(435): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttcatggtggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttcctccctgaacgctgacgctctgtgacccgccgcggacacggctgtgtattactgtgcgagngcggattagttgtagtagtacagctgcttattttcgccggttgttccgcccgtgggccacgggtaacctggtccgaccgtctcctcgcgtccctccaacccgg

SEQ ID NO: 195730 - DNA, 576 bp, Homo sapiens
  misc_feature: GYAE6OF02GDEI1.48.65.F10.1.454.CMB.1.raw
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
tcagagtatacatacacgaccggtgctcgatttagctacgctctaagggggcgtttctgagagtcatggacctcctgcacaagaacatgaaacacctgtggttcttcctcctcctggtggcagctcccagatgggtcctgtcccaggtgcagctacagccagtggggcncaggactgttgaagcctttcgggagaccctgtcccctnacctgcgctttctatggtgggtcctttcagtggttactactggagctgggatccgccagcccccagggaagggctggagtggattggggaaatcgaatcatacgtggaagcaaccaactaccaacccgtccctcaaggagtccgagtccaccgatatcagttacacacgtccaaagaaccagttccnccctagaacgctagacgctctgtcgacccgcgcggacacggctgngttattacgtgttgacgagngcggtatattgtagtacgtaccngctgtcttagttttcgtcggttggttccgacccggttggggccctaggggtaaccctggtccaccgttctccgtcacggtccctcccaacccgg

SEQ ID NO: 195731 - DNA, 599 bp, Homo sapiens
  misc_feature: GYAE6OF02IJFLP.48.65.F10.1.454.CMB.1.raw
  modified_base (448)..(448): a, c, t, g, unknown or other
  misc_feature (448)..(448): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttggagaccctgtcccctcacctgcgtctttcatgggtggtccttgagtggttacctactggagctggactccgccagccccccaggggaaggggctgggacgtggattggggaaatcaatcatagtggaagcaccaactacaacccgtcctcaggagtcgagtcaccatatcagtagacacgtaccaaagaacctagttctaccctgaagctagacgtctctgtcgaccgccgcggacacgggctgtgtattactgtcgcgagngcggatagttggatagtaccagcgtgtctttagtttttcgtccgggttaggtttccggaccccgttgggggacccctaacgggggtaaccccttgggttacccgtacccggttccgttcccgtccgacgtcccccgtaccgtaaccccggg

SEQ ID NO: 195732 - DNA, 587 bp, Homo sapiens
  misc_feature: GYAE6OF02HCV8O.48.65.F10.1.454.CMB.1.raw
  modified_base (295)..(295): a, c, t, g, unknown or other
  misc_feature (295)..(295): n is a, c, g, or t
  modified_base (476)..(476): a, c, t, g, unknown or other
  misc_feature (476)..(476): n is a, c, g, or t
tcagagtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttagggattataaccttgtctctggtaccaacagcaacccaggacaaacgcccccaaactcatnatttactgaggacagtaacgcggcctcgagggtttcaagttcgcttctcgtgctccaagtctgcaaccgacggccctccctagaacctaatcctcgtagggccttccgagggtcctggacggacgtaggctaggatttagttactgtactgctacatattcggactaagtattacggtaanccgtaaccttcgaatttacgggtgttacgttacggggcggtaacgggacctaaggtccgttacggacccgttaccgtagggtccaacggtcccgaacgggtctaccccggg

SEQ ID NO: 195733 - DNA, 607 bp, Homo sapiens
  misc_feature: GYAE6OF02HUHU1.48.65.F10.1.454.CMB.1.raw
  modified_base (304)..(304): a, c, t, g, unknown or other
  misc_feature (304)..(304): n is a, c, g, or t
tcagagtatacatacacgaccggtgctcgatttagctacgctctaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttgggattactaaccttgtctcctgtaccaacagcaccaggacaaacgcccccaaaactcatgtattttanggaaggacaagtaacgccggtaccctcgtaggggtttactaatcggtcttctcgtggccttacaagttctacggacaaaccgcggtccctaccctgacctaaatcgtcgtcgggcctccgaggctggaggacgagctagtattattcgtagctgctctaagtatcggactagattaggactactactactaagtggttaggttacgttcgggaccgggaacgggtacctaaacggtccgttaacggtacccggttaccgttacggggacctaacgggtacccctacgggtcttaccccccggg

SEQ ID NO: 195734 - DNA, 811 bp, Homo sapiens
  misc_feature: GYAE6OF02GBDF0.48.65.F10.1.454.CMB.1.raw
  modified_base (425)..(425): a, c, t, g, unknown or other
  misc_feature (425)..(425): n is a, c, g, or t
tcagagtatacatacacgaccggtgctcgatttagctacgctctaagggggctttcgtgagagtcatggacctcctgcacaagaacatgaaacacctgtggttcttcctcctcctggtggcagctcccagatgggtcctgtcccaggtgcagctacagcaggtggggcgcaggactgttgaacgccttcggagaccctggtcccctcacctgcgtcttttctagtcggttgggtcctttacgagttcggttactacgtcgggtagcgttgggacttccgcccgacgccccccgaggggaacggggctgggacggtgggacgttaggggaaactcgaatcgaataggtaggaagccaactaaccgtaaccaaccccggtccctacgacggtacgtacgtacgtaccacgattacgtacaggtaacnccgtaacgtaccaaacggaacctacgtttaccctccctagggaaacgtacgtaggtacgtccgtcgttacggtaccggaacccggcccggtaccgggaaccggtaacgggtccgttaggttacggttaactttaccggtacggtcggtaacggtacgggaacggtaccgggttaagtttacggttaacgttaacggtttaaccgttaacccgtaacgggttcttaacggtccgttttttaaacgtttttcgggttacccgggtttaccgggttacccggtaccccgggtttacggggaacccgggttaaccggggtaccccggttacggttaccccggtaccggttccctaccgtacccgacgttcccccgacccgtaaccccggg

SEQ ID NO: 195735 - DNA, 646 bp, Homo sapiens
  misc_feature: GYAE6OF02JFPF0.48.65.F10.1.454.CMB.1.raw
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgtctttctatcggtcggtcctttcgagttcggttaactacgtgggagctggaactccgccacgcccccgaggggaacgggctgggagtcggagttggggaaatcgaatcaagtaggtggaacgcaccaactaccgaacccgtccctacgaggtacgtacgatccacgactatcagtacacacgtcaaanacctagtcctacctagacnctagacgctcgngtacgacccgcgacggacacggtctcgtagtacttcgtgngcgagacgatatgttactactatgtaactaccgtaaggtccggtactccctaacgttccggtacggggtacccgtaacggggaacccgttcgggtacccgtaacccggttcccgttaccccgtacccgggtaaccgttacccccgtacccgaaccccggtaacccgggtacccccgg

SEQ ID NO: 195736 - DNA, 810 bp, Homo sapiens
  misc_feature: GYAE6OF02GSQ0J.48.65.F10.1.454.CMB.1.raw
  modified_base (222)..(222): a, c, t, g, unknown or other
  misc_feature (222)..(222): n is a, c, g, or t
tcagagtatacatacacgaccggtgctcgatttagctacgctctaagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttagggattataaccttgtctccgtgtaccaacacgccaccaggacaaacgacccccaaatcatagtatttaagtgaggactaagtacgccggcctacggtaggggtttactaatccggtactttcgtcgttcggtaccttaccgtaagttccgtacgggtaccaaccggtacccgggtaccccttaccccgttacgaacccgttaaacctttcccgttaccggttaccggggtaccccgtttacccggaacggggttaccccggttaggggaaccgggggtaaccgggtaacggggttaccgttagggttaaacgttttaaacgtttacggtccgggttaccttcgggtaccttactaaacgttacggtcgtaaccgtaaggtaaactttacgggtaacctactaacccgttagtagtttagggtacgggtttaaacggttccgggggtaacggggaaacccggggttaacccgtaacggttaaccggtaccccgggttaacccggttcccggggttaaccggttacccggtaccccggttaacccgggtaacccgggtcccgtttaaccccccggg

SEQ ID NO: 195737 - DNA, 676 bp, Homo sapiens
  misc_feature: GYAE6OF02FV99A.48.65.F10.1.454.CMB.1.raw
  modified_base (168)..(168): a, c, t, g, unknown or other
  misc_feature (168)..(168): n is a, c, g, or t
tcagagtatacatacacgaccggtgctcgatttagctacgctctaaggggggctttctgagagtcatggacctcctgcacaagaacatgaaacacctgtggttcttcctcctcctggtggcagctcccagatgggtcctgtcccaggtgcagctacagcagtggggcncaggactgttgaagccttcgggagacccctgtcccctcacctgcgtcttttcagttgggtcgggttccctttcaggttcggtttactactgggagcgtggatcccgccacgcccccaggggaacgggctggagtggagttagggaaatcaatcataggtggaagcaccaactacaacccgtcctacaggagtacgagtaccaccatatcgaagtacgaccaccgtacaaacgaacctagttacctcccgtagaacgctaggacgtctcgtcggtacgacccggccggaccgggacgtacgggtcgttaggttacgttaactttaccgtggtcgacgaggacggtcggtaattggttaggtagtacgtaccgagtccgtagtacgtttagtttttcggtccggttacggttacccggacccggttgggggacccgtaacgggggttaaccccgttgggtacccgtacccgttcctacccgttccgaacgtccccgtacccgaacccggg

SEQ ID NO: 195738 - DNA, 671 bp, Homo sapiens
  misc_feature: GYAE6OF02GWITU.48.65.F10.1.454.CMB.1.raw
  modified_base (166)..(166): a, c, t, g, unknown or other
  misc_feature (166)..(166): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtgggcncaggactgttgaagccttcggagaccctgtcccctcacctgccgtcttttctagtgggttcgggttaccttcgaggttcgggttaacctacgtgggacgtcgtggactccgccacgccccgagggaagggcgtggagtggagttaggggaatcaatcagtagtaggaagtccaaccaacctaaccaaccccgttcccacgaacggtacgtacgacgtcgaaccatactacaagtacgaacctacgtaccaacgaacctacgttaccctcctagtaacgtctagacgctcgtcggtacgaccggtccggacggacgtaccggcgttaggttcgttacttacgtgtcgacggtagacggcggttaattacgttagttacgtactacgacgtcttgttactttagtttcgggtccggttacggttacccggtcccgggtcgggacccgtacggggtaacccgttcggtaccgtcccgtccttccgaccgtacgtcccctcgaacccgg

SEQ ID NO: 195739 - DNA, 772 bp, Homo sapiens
  misc_feature: GYAE6OF02JWJWI.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgtcgtctttctagtggtcgggttcccttcgaggttcggttactacgtgggtacgcgtcggactcccgccaccggcccccgagggggaacggggcgtacgggaggtacgggtaggttaacgggggtaaactcgtaagtacgtaagtagggtacgggaaacgaccgaaacccgtaaaccgtaaccgtaacccccggtcccgtacggtaacgggacgttacggaaccgtaccacctaagtactacgaagtacgaactaccgtaaccaaacggacctacgttcctacccgtagacgtacgtcgaacgtcttacgtcggtacggaccgccggccggtcgacggtcgtcggtctaacgttctaggtcgtacggacggtagaccggtattacggttagtacgtacgtacgtacttcgttagtcccgttttagttttcggggttaccggttccggggtttaccctacccggggggttcgggacccgggtttaaaccgggtcccgttaaccggggttcccgttaacggttccccgttaccgtcccggtaccgttaccccgtacccggtaacccggg

SEQ ID NO: 195740 - DNA, 556 bp, Homo sapiens
  misc_feature: GYAE6OF02HRKQR.48.65.F10.1.454.CMB.1.raw
  modified_base (167)..(167): a, c, t, g, unknown or other
  misc_feature (167)..(167): n is a, c, g, or t
  modified_base (356)..(356): a, c, t, g, unknown or other
  misc_feature (356)..(356): n is a, c, g, or t
  modified_base (538)..(538): a, c, t, g, unknown or other
  misc_feature (538)..(538): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctttctatggtgggtccttcagtggttactactggagctgggatccgccagcccccagggagggctggagtggattggggaaatcaatcatagtggaagcaccaactacaacccggtccctcaggagtcgagtcaccatatcagtanacacgtccaagaaccagttcctccctagaagctagacgtctccgtgtcgaccggtcccgcggacacgggctggtgtattaccgtgtgcgagagcggattatggtagtagtaccagctgtacttattttgccggttgttcgacccgttggggaccctagggacccctggtctaccgtctcccncgacgtccctcaacccgg

SEQ ID NO: 195741 - DNA, 492 bp, Homo sapiens
  misc_feature: GYAE6OF02HQQ1M.48.65.F10.1.454.CMB.1.raw
  modified_base (220)..(220): a, c, t, g, unknown or other
  misc_feature (220)..(220): n is a, c, g, or t
  modified_base (295)..(295): a, c, t, g, unknown or other
  misc_feature (295)..(295): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
tcagagtatacatacacgaccggtgctcgatttagctacgctctaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggagttataaccttgtctcctggtaccaacagcaccaggcaaagccccaaactcatgatttangaggacagtaagcggccctcaggggtttcaagtcgcttctctggctccaagtctggcaacacggcctccctgacaatctctggctccagctgnggacaggctgatattactgcagctnatatgcaggcagcaacatcgtgtagttgcgaggaccaaggctaggaccgtcctaggcagcccgaagctcgccccctcgg

SEQ ID NO: 195742 - DNA, 1039 bp, Homo sapiens
  misc_feature: GYAE6OF02IWEZL.48.65.F10.1.454.CMB.1.raw
tcagagtatacatacacgaccggtgctcgatttagctacgctctaaggggctttctgagagtcatggacctcctgcacaagaacatgaaacacctgtggttcttcctcctcctggtggcagctcccagatgggtcctgtcccaggtgcagctacagctaggtgggcgacaggactgttgaagtccttcgggagtacccctggtccccttcaccgtgaccgtccttttcgtagtgggttcgggttacccttgagttacgggtttacctacgttggggacgtcgtgggtacttccccgccgtaacggccccccgaaggggtaacggggtccgtacgggtacggtcgggtaagttacggggggtaaaactcgtaaaacgttaccgtaagttaacggggttaggaaacgggtaccctaaacccgtaaacccgttaaaccccggtaaccccccggttacccccgttaccggaaacgggtacggttaaccggtacgtacccgtaaacccgtagttaactaccgtaacggtaaccggtaacccgtaaccggtacccgtaaaacgaaacccgttaacgtttaccccgtacccgttacggtaaacgtcgttacggtaaccggtccgttaccgtttacgggtaccgggaaccccggtccccggtaaccggggtaacccgtaccggggttaccgttaccggttacggggtttaaaccgtttaccggttaacgggtttaccgggaaccggggttaaaccggtacgggttaacccgggttaaaggttttaaccgtttaacgggttaaaaccggttttaccggttaaacccggtacgttcccgttttaacgggtttaaccggttttttaaccgtttttttaccggggttacccccggggtttccgggttttacccccgggtaccccgggttttaaccggggaccccgggtttaaccggggttaaacccccgttcccggggtttaccccttaacccgggtttccccgttacccgttacccgacccggtttacccccaacccccgggtaacccgg

SEQ ID NO: 195743 - DNA, 793 bp, Homo sapiens
  misc_feature: GYAE6OF02H5AGB.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtggggcgcaggactggttgaacgtccttcgggagaccctgtccctcacctgcgtctttctagtcgggtcgggttccttcaggttggttacctacgtgggagtcgtggactcccgccaccggccccgaggggacgggcgtaggtaggtggaggttaggggaaatcgaatcagtaggtggaacgccaaccaacctaccaaccccgtccctacgacggtactacggatccaacattacgtacagtacgacctacgttaccaaacggaacctagtttaccctacccgtaggaaacgccgttacgacggtacgttcgtacggtcggaaccccggccgggacccgtaaccggaccgggtccgttagggtacgtttacgttaacggttcggttcggacggtaaggacgggtaccggtacgtttaggttacggttaacggttacgtaacccgtaggtccgtttaacggtcgtttttaaggttttttcccgggttaccggggtttccgggtttaccccggtaccccggggtcggggggttaaccccggtaaccgggggttaacccccgttgggtttacccccgaccggtttccccgttcccgacccggtaaccggtcccccgttaaccccggtaaccccgg

SEQ ID NO: 195744 - DNA, 778 bp, Homo sapiens
  misc_feature: GYAE6OF02HQ80Q.48.65.F10.1.454.CMB.1.raw
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccgaggtgcagctacagcgaggtggggcgcgaggtactgttagaagtccgttacggacgaccctcgtccctacacctggccgtctttactagtcgggtcggttccttgaggttggttactacgtgggagtcgtggactccgccgaccgcccccggaaggggaacgggccgtgggaggttcggtagttaacggggaaattacgagtaccgtagtaggtacggaacgacctaaaccgaactaacccgaaccccgtccgtacgaaggtacgtacgtacgtaccactaatacacgtaacggtactaccgaccgtaaccaaacgaaacccgttacgttacccgtaacccgtagtaacggcgttacgaacggtcctacggtcggtaacggccccggacccggaccgggaccgaaccgggtcgtacggttaggtttaacgttacgtcggtacgcggtaaacggtaggtaccggtaatttacggttacggttaaagtaccgtaacgtacgtacgtcggtttaaactttgtttttccgggtaccggtttcgggttacccggtacccgggtccgggtaaccggtacggtaaccccgttggtacctacccgttccgtcctaccgacccggtcctacccgtaacccggg

SEQ ID NO: 195745 - DNA, 590 bp, Homo sapiens
  misc_feature: GYAE6OF02GI9LO.48.65.F10.1.454.CMB.1.raw
  modified_base (414)..(414): a, c, t, g, unknown or other
  misc_feature (414)..(414): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatcgggtcctgtcccaggtgcagctacagcagtggggcgcaggactgttgaagccttcggagaccctgtccctcacctgcgtctttctatggtggtccttcagttggttactattggagcgtggactccgcctagcccccgaggggaagggctggagtggattggggaatcaatcataggtggaagccaccaactaccgaacccgtccctcgaggacgtcgacgtccaaccactacgtcaagtagaccacgtaccaacgactacgttcctccctagacgctgacnctctgtacgccgcgcggacacggctgtgtactactgtgacgagcggcgatgtaggtagtcgtaccagcgtgtctttagttttcgccggttggttccgaccccggttgggacccgtacgggtaacccttcggtccgtacccgttccttacccgtcgaccgtcccttccgaaacccgg

SEQ ID NO: 195746 - DNA, 569 bp, Homo sapiens
  misc_feature: GYAE6OF02G7R28.48.65.F10.1.454.CMB.1.raw
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagacccctgtcccctcacctgcgctttcatggtgggtccttcagtggttactactggagctggatccgccagccccccgagggaaggggctggacgtggattgggggaaatcgaaatcatagnggaagcaccaactacaaccccgtccctcaggagtcgagtccaccatatcagtagacacgtcaagaaccagtcctccctgacgctgagctcngtgacccgccgcggacacgggtctgtgtacttactggtgcgagagcggatgttagtagtacgtacgagtctgtcttagttttcgccggttggttccgacccggttggggccctacggggaacccgttggtccgtacccggtctccctcgacgtcctcccgaacccgg

SEQ ID NO: 195747 - DNA, 891 bp, Homo sapiens
  misc_feature: GYAE6OF02GJQXU.48.65.F10.1.454.CMB.1.raw
  modified_base (754)..(754): a, c, t, g, unknown or other
  misc_feature (754)..(754): n is a, c, g, or t
tcagagtatacatacacgaccggtgctcgatttagctacgctctaagggggctttctgagagtcatggacctcctgcacaagaacatgaaacacctgtggttccttcctcctcctggtggcagcctcccagatcgggtcctcgtcccgaggtgcagctacaggcaggtgggcgacgaggtacttggttagaacgtccgttacgggacgtaccccgttcgtccccttcgaccgtcgtccgttccttttacgttacggttcggggttcgggttccctttacgtaggttacggtttaccttacggttcgggaacggtccgtaggtaccgttcccggcccgtaccggcccccggtaagggggaccgggtcggtagggtacggttacgggtaaggttacgggggaaactaccgtaaacgttacgaacggttacggggtaacggaaccgtacccgaaacccgtaaaccgtaacccgtaacccccggttcccgtaacggtaacggtaacgttaccggtacgtaaccgtaacctacgttaacgtaccgtaaacggttaaccgaaccgtaacccgaccgtaaaaccgtaaacccgttacgttcccgttaccgttaaggaaccgttaccgtacgtccgtacgtttacgtacggtaccgacccggtacgggaccgaacgtccggtacgttacgtagtttacgtacgtacggtacgaccgggtacgacgttacggtaattttggacggttacgtaacgttaccggngttacccgttagtttaccgttttcggtttacgggttccggtttcgtacccgggtacccggttcgggaacccgtttaccgggtaccgttccggtacgtacccgtttccgccgttaccgccgtcccgtaacgtacccgg

SEQ ID NO: 195748 - DNA, 790 bp, Homo sapiens
  misc_feature: GYAE6OF02FYWHH.48.65.F10.1.454.CMB.1.raw
  modified_base (167)..(167): a, c, t, g, unknown or other
  misc_feature (167)..(167): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatcgggtcctgtcccaggtgcagctacagcagtgggcncaggactggttgaacgtccgttcggacgaccctcgtcccctcgaccgtgcgttcctttacgtagttcgggtacgggttcctttacgaggttcggttaacctacgtagggacgtcgttggactccccgaccgaccgcccccggaggggaacggggctagggtacgtgggtaagttaggggaaactcgaatccgtaagtaggtaggaacgccaaccgaacctaaccgaaccccgtccctacgacggtacgttacgacggtaccacctagtactcgtaacgttacgaaccgacgttacccgaaaacgtaaccgacgtttacctcccggtaagtaacgtcgtacgtacgtaccgtgtcgtacggaccccggcgtaccggaccgacggtccttggtacgttacttacgtggtacgtacggagtacggtacggtaagtttagttacggttacgtaacgtttaccgacgttccgttgtacgtttttccggttttacggtccgggttttaccgtacccggtacccggggttacgggaaccccggttaacccggggtaacccgttacggtaccccggtacccgtttcccgtacccgtacccggtacccgtacccgtaccccgtaacccgggg

SEQ ID NO: 195749 - DNA, 637 bp, Homo sapiens
  misc_feature: GYAE6OF02F616I.48.65.F10.1.454.CMB.1.raw
  modified_base (167)..(167): a, c, t, g, unknown or other
  misc_feature (167)..(167): n is a, c, g, or t
  modified_base (233)..(233): a, c, t, g, unknown or other
  misc_feature (233)..(233): n is a, c, g, or t
  modified_base (383)..(383): a, c, t, g, unknown or other
  misc_feature (383)..(383): n is a, c, g, or t
tcagagtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcaggtgggcncaggactgttgaagccttacggagaccctgtccctcacctgcgtctttctatcgggtggtccttgngttaggttactacgtggagctggactccgccacgcccccgagggaacgggcgtggagtggagttggggaaatcaatcagtagtaggaagcaaccaactaccaaccgtcccagagagtcgagtacaccatatcagagaacacgtacgaaanaaccgtagttacctacctagaacgtcagtacgctcgtgacgtccgaccggtcgaccgtacggcttagtacgttcgttacgtgtacggtacgaggtacgacggtattagttggtaagtaaccgtacgtagtcttagtccgtttaagttttcgggtaccggtttggttacccgacccgggtcgggaccgtaaccgggtaaccgtcgggttaccctaccggttctacccgtacgtcccgacccgtacgtaaccccgg

SEQ ID NO: 195750 - DNA, 826 bp, Homo sapiens
  misc_feature: GYAE6OF02IU2TQ.48.65.F10.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
tcagagtatacatacacgaccggtgctcgatttagctacgctctaaggggggctttctgagagtcatggacctcctgcacaagaacatgaaacacctggttggttcttccctcctctggtgcagctccagagtcggtctcgtccaggtgcagctacgagcaggtggggcncaaggtctgttagaacgtccgttgggaatcccccgtggtacccctntaacccgtggtctcctttcttaagtcggggttacgggttccccttaggaaggttttcggtacttaacggtgggacgtcgtaggctcccgaccaccgaccccggaaggggtacgggcgtaggtaggtaggtaggttaacggggaaaactacgaacgtacgaaagttaggaacggaaacggcctaaaaccctaaccgttaaaccccgtaaaccccgttccccgtaaggtaaacggggtacggttaaccggaacgtaaccccgtaaacgacgttaaacgttaccgaaaggtacccgtaaaacccgtaaccggttaaacccgaaaaaggtaaccccgttaaggtttcccaaccggtacgtaaacgtaccgttaggacgtacgttagtaaccgtacggccgtaccggaccggaacgtaccggtagtctaggttactaacgttgtacgagtacggagacggttagtattacggttaagtacgtaccgtagttccgttagtactttcgtttacgggttccgttacgggtaccgtacccgggtcggaacccggtacgggttaccccgtacggtcccgtaccgttcctaccggtactccgtacccgaccgtaacccggg

SEQ ID NO: 195751 - DNA, 435 bp, Homo sapiens
  misc_feature: GYAE6OF01C1TVW.13.17.B06.1.454.CMB.1.raw
  modified_base (415)..(435): a, c, t, g, unknown or other
  misc_feature (415)..(435): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagagtggggcacgactattttgagaggtgtacgtggggccagggacgccccggtcaccgtctcctcacgccctccaacccgaacgggccccaagttccgggttcccttccccccgtgggccctcccctggccctccgaaggaccgaccacccgttccggaagacgccaaccgacggccggaccccgtgggcctgccgtggacctaaacggccttactccgtaagtccgtagacgtggacgggccgggtctaggacgaaggccgatagagnnnnnnnnnnnnnnnnnnnnn

SEQ ID NO: 195752 - DNA, 375 bp, Homo sapiens
  misc_feature: GYAE6OF01B80VZ.13.17.B06.1.454.CMB.1.raw
  modified_base (367)..(375): a, c, t, g, unknown or other
  misc_feature (367)..(375): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgactattttgtagaggtgtactggggccagggacgccccggtcaccgtctcctcagcctccaccgaacgggcccatccggtcccttccccccgtggcccgccctcgcctccgaggcgcacctccggagacgccacagccggccctgggctgcctggacaaggactacttcctaggtacgtgacgtgacggcgggctggcgaaggcgcatgnnnnnnnnn

SEQ ID NO: 195753 - DNA, 349 bp, Homo sapiens
  misc_feature: GYAE6OF02F3GFD.13.17.B06.1.454.CMB.1.raw
  modified_base (343)..(349): a, c, t, g, unknown or other
  misc_feature (343)..(349): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttcccctggcgccctgctccaggagcacctccgagagcacagcggccctgggctgcctggtcaaggctacttcctagtacgtgactgagcgggctggcaaggcgcatagnnnnnnn

SEQ ID NO: 195754 - DNA, 357 bp, Homo sapiens
  misc_feature: GYAE6OF02H93HO.13.17.B06.1.454.CMB.1.raw
  modified_base (211)..(211): a, c, t, g, unknown or other
  misc_feature (211)..(211): n is a, c, g, or t
  modified_base (351)..(357): a, c, t, g, unknown or other
  misc_feature (351)..(357): n is a, c, g, or t
tcagtcacgtactacacgaccggtgctcgatttagtcgatagtgaagggccgattcgaccatctccagagacaacgccaagaactcactgtatctgcagatgaccagcctgagagtcgaggatacgggctgtgtattattgtgcgagagatggggcacgacattttgtagaggtgtactggggccagggagccccggtcaccgtctccctnagcctccaccaagggcccatcggtcttccccctggcgcccctgcctccaggagccacctccgagagcacagcggccctgggctcgcctggtcaaggactactcctagtacgtgactgagcgggctggcaaggcgcatagnnnnnnn

SEQ ID NO: 195755 - DNA, 366 bp, Homo sapiens
  misc_feature: GYAE6OF02HVYZT.13.17.B06.1.454.CMB.1.raw
  modified_base (356)..(366): a, c, t, g, unknown or other
  misc_feature (356)..(366): n is a, c, g, or t
tcagtcacgtactacacgaccggtgctcgatttagtcgatagtgaagggccgagttcaccatctccagagacaacgccaagaactcactcgtatctgcagatgacccagcctgagagtcgaggatacggactgtgtatttattgtgcgagagatggggcacgacattttgtagaggtgtactggggccagggacgccccggtcaccgtctccgtcagcctccaccaagggcccatcggtcttccccctggcgccctgcctccaggagcacctccgagagcacagcggccctgggctgcctggtcaaggacctacttcctagtaccgtgactgagcgggctggcaaggcgcagtagnnnnnnnnnnn

SEQ ID NO: 195756 - DNA, 368 bp, Homo sapiens
  misc_feature: GYAE6OF02JYKOA.13.17.B06.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (351)..(351): a, c, t, g, unknown or other
  misc_feature (351)..(351): n is a, c, g, or t
  modified_base (358)..(368): a, c, t, g, unknown or other
  misc_feature (358)..(368): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtnaccgtctcctcagcctccgaccaagggccccatccggtcttccccctggaccnccctgactccaggcgcacctcgagagccactagcggccctgggctcggaccttggcaaggctacttcctagtacgtgacttgacgcgggctggcaagggcncagtagnnnnnnnnnnn

SEQ ID NO: 195757 - DNA, 401 bp, Homo sapiens
  misc_feature: GYAE6OF02FVGF6.13.17.B06.1.454.CMB.1.raw
  modified_base (391)..(401): a, c, t, g, unknown or other
  misc_feature (391)..(401): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgagaggtgtacgtggggccaggggacgccccggtcaccgtctcctcagcctccaccagggcccagtccggtccttcccctggccgtcccctgcctccgagggacgccaccctcgagacgccacgaggcccggccccgtggggcccttggcccgttgggtaccaacggtccttaccttcccgtaagtaccgtgacctggacggcgggtactgggccaaggcacagtgnnnnnnnnnnn

SEQ ID NO: 195758 - DNA, 426 bp, Homo sapiens
  misc_feature: GYAE6OF02FXPD2.13.17.B06.1.454.CMB.1.raw
  modified_base (394)..(395): a, c, t, g, unknown or other
  misc_feature (394)..(395): n is a, c, g, or t
  modified_base (399)..(401): a, c, t, g, unknown or other
  misc_feature (399)..(401): n is a, c, g, or t
  modified_base (405)..(426): a, c, t, g, unknown or other
  misc_feature (405)..(426): n is a, c, g, or t
tcagtcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagagtggggcacgactattttgagaggtgtacgtggggccagggcgccccggtcaccgtcctcctcacgccctaccaccgaacgggccccattcccgggtcccttccccccgtggcccgcccctcgcctccgaggacgccaccctcgagacgcaccaggccggcccctgggcctcgaccgtgggtacaacggtcttaccttcctagtacgttgactaggacgccggggctgggacaggtccgctagtgnnagcnnnctgnnnnnnnnnnnnnnnnnnnnnn

SEQ ID NO: 195759 - DNA, 288 bp, Homo sapiens
  misc_feature: GYAE6OF01D2Z9A.14.2.A02.1.454.CMB.1.raw
  modified_base (283)..(288): a, c, t, g, unknown or other
  misc_feature (283)..(288): n is a, c, g, or t
tcagcgtctagtaccacgaccggtgctcgatttagactcatctacccgggaatccgggtccctgaccgattcagtggcagcgggtctgggacagatttcactctcaccatcagcagcctgcaggctgaagatgtggcagtttattactgtcaacaatattataataatccatttaattcggcggaggaccaaggtggagatcaaacgactgtggctgcaccatctgtcttcatcttcccgcatctgagtactagacgctgagcgggctggcaaggcgcatagnnnnnn

SEQ ID NO: 195760 - DNA, 296 bp, Homo sapiens
  misc_feature: GYAE6OF01DC0BA.14.2.A02.1.454.CMB.1.raw
  modified_base (282)..(282): a, c, t, g, unknown or other
  misc_feature (282)..(282): n is a, c, g, or t
  modified_base (288)..(296): a, c, t, g, unknown or other
  misc_feature (288)..(296): n is a, c, g, or t
tcagcgtctagtaccacgaccggtgctcgatttagactcatctacccgggaatccggggtcccgtgaccgattcagtggcagcgggtctgggacagatttcactctcaccatcagccagcctgcaggctgaagatgtggcagtttattactgtcaacaatattataataatccatttaattcggcggaggaccaaggtggagatcaaacgactgtggctgcaccatctgtcttcatcttcccgcatctgatactagacgctgagcgggtctggcaaggccgntatagnnnnnnnnn

SEQ ID NO: 195761 - DNA, 294 bp, Homo sapiens
  misc_feature: GYAE6OF01BIEB6.14.2.A02.1.454.CMB.1.raw
  modified_base (287)..(294): a, c, t, g, unknown or other
  misc_feature (287)..(294): n is a, c, g, or t
tcagcgtctagtaccacgaccggtgctcgatttagactcatctacccgggaatccgggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccatctgagtactagacgctgagcgggctggcaaggcgcatagnnnnnnnn

SEQ ID NO: 195762 - DNA, 291 bp, Homo sapiens
  misc_feature: GYAE6OF01AQ5UV.14.2.A02.1.454.CMB.1.raw
  modified_base (284)..(291): a, c, t, g, unknown or other
  misc_feature (284)..(291): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaattcggcggaggaccaaggtggagatcaaacgaactgtggctgcaccatctgtcttcatcttcccgcatctgagtactagacgctgagcggctggcaaggcgcatagnnnnnnnn

SEQ ID NO: 195763 - DNA, 531 bp, Homo sapiens
  misc_feature: GYAE6OF01CVQFB.14.2.A02.1.454.CMB.1.raw
  modified_base (515)..(515): a, c, t, g, unknown or other
  misc_feature (515)..(515): n is a, c, g, or t
tcagcgtctagtaccacgaccggtgctcgatttagactcatctacagggggagtttccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaaggttatggatatagttttacaaactactggatcggctgggtgcgccagacgccgggagaggcctggagtggatgggaatcatctatcctaatgactctgataggcatacagcccgtctccaaggccaagtccaccatctcagtcgacacgtaccagaacgtaccgcctacctgacaagtggagcagccgtgaacggcctacggaccaccgcgtacgtattacgtgtcgcgagtaccggtcttgtccagtgacgtagttggagtcgcctattacgtaccggcncctcccctgtcttacg

SEQ ID NO: 195764 - DNA, 296 bp, Homo sapiens
  misc_feature: GYAE6OF01DS6Y7.14.2.A02.1.454.CMB.1.raw
  modified_base (288)..(296): a, c, t, g, unknown or other
  misc_feature (288)..(296): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagttttattactgtcaacaatattataataatccatttaatttcggcggagggaccaaggtggagatcaaacgactgtggctgcaccatctgtcttcatcttcccgccatctgagtactagacgctgagcgggctggcaaggcgcatagnnnnnnnnn

SEQ ID NO: 195765 - DNA, 516 bp, Homo sapiens
  misc_feature: GYAE6OF01C4102.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaagggttatggatatagttttacaaatactggatcggctgggtgcgccagacgcccgggagaggcctgggagtggatggggaaatcatctatcctaaatgactctgataggcgatacagcccgtctcaaggccaagtcacatctcagtcgacacggtccaagaagtaccgacctacctgacaatggagcacgcgtcgaaggcctcggacaccgccgtgtatactgtgcgagacggtctgtccatgactattggagtgcctattactacggcgtcctcccctgtac

SEQ ID NO: 195766 - DNA, 295 bp, Homo sapiens
  misc_feature: GYAE6OF01D0O2B.14.2.A02.1.454.CMB.1.raw
  modified_base (290)..(295): a, c, t, g, unknown or other
  misc_feature (290)..(295): n is a, c, g, or t
tcagcgtctagtaccacgaccggtgctcgatttagactcatctacccgggaatccgggtccctgaccgattcagtggcagcgggtctgggacagatttcactctcaccatcagcagcctgcaggctgaagatgtggcagtttattactgtcaacaatattataaataatcctaatttaatttcggcgaagggaccaaaggtgagatcaaaagactgtgctgcaccatctgtcttcatcttcccgcatctgagtactagacgctgagcgggctggcaaggcgctaagtagnnnnnn

SEQ ID NO: 195767 - DNA, 544 bp, Homo sapiens
  misc_feature: GYAE6OF01EOP6Z.14.2.A02.1.454.CMB.1.raw
  modified_base (413)..(413): a, c, t, g, unknown or other
  misc_feature (413)..(413): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaagggttatggatatagtttacaaactactggatcggctgggtgcgccagacgcccgggagaggcctggagtggagtgggaatcgatctatcctaatgactctgataggcgatacacgcccgtccttccgaaggccaagtcaccatctcagtcgacacggtaccagaacgtaccgcctaccncgacaatggagcagcctagaacggcctcggacaccgccgtgtattactgtgcgaggacggtccttgtcctagtcgacttagttggagttcgaccttagttacgtacccggtcgccgttccccctgttaccg

SEQ ID NO: 195768 - DNA, 293 bp, Homo sapiens
  misc_feature: GYAE6OF01CI0JH.14.2.A02.1.454.CMB.1.raw
  modified_base (287)..(293): a, c, t, g, unknown or other
  misc_feature (287)..(293): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaattcggcggagggaccaaggtggagatacaaacgaactgtggctgcaccatctgtcttcatcttcccgcatctgagtactagacgctgagcgggctggcaaggcgcatagnnnnnnn

SEQ ID NO: 195769 - DNA, 535 bp, Homo sapiens
  misc_feature: GYAE6OF01EH1GK.14.2.A02.1.454.CMB.1.raw
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (518)..(518): a, c, t, g, unknown or other
  misc_feature (518)..(518): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaagggccggggagtctctgaagatctcctgtaaggttatggatatagttttacaaactactggatcggctgggtgcgccaggaccgcccgggagacggcctggagtggagtgggatcatctatcctaatgactctgagtaggcgatacgacgccccgtcttccaacggccaagtcaccatctcagtcgacagtccagaacgtacccgcctactgcaatggacncagcctggacgcctcggacnccgcgtgtattctgtcgcgagcgggtcttgacctatcgacttattggagtcgtcctagtttaccgacccggtcncccttccccgtgttacc

SEQ ID NO: 195770 - DNA, 293 bp, Homo sapiens
  misc_feature: GYAE6OF01AJTER.14.2.A02.1.454.CMB.1.raw
  modified_base (184)..(184): a, c, t, g, unknown or other
  misc_feature (184)..(184): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (286)..(293): a, c, t, g, unknown or other
  misc_feature (286)..(293): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagttttattactgtcaacaatattataataatccatttaattcggnggaggaccaaggtggagatcaaacgaactgtggctgcaccatctgtcttcatccttcccgcatctgatactagacgctgacgcgggntggcaaggcgnatgnnnnnnnn

SEQ ID NO: 195771 - DNA, 543 bp, Homo sapiens
  misc_feature: GYAE6OF01BBHNG.14.2.A02.1.454.CMB.1.raw
  modified_base (409)..(409): a, c, t, g, unknown or other
  misc_feature (409)..(409): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaagggttatggatatagttttacaaactactggatcggctgggtgcgccagacgcccgggagaggcctggagtggatgggaatcgatctatcctaatgactctgataggcgatacagcccgtcttcaaggccaagtcaccatctcagtcgacaggtccagaacgtaccgaccctaccngacaatggagcacgccgtgaacggcctacggacaccgccgtgtacttactgtgcgacgtaccgggtccttcgtccagtcgtacttattgtacgttgaccttattactaccggtcgtcccttcccccgtgttccg

SEQ ID NO: 195772 - DNA, 613 bp, Homo sapiens
  misc_feature: GYAE6OF01A94E2.14.2.A02.1.454.CMB.1.raw
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccgggagtctctgaagatctcctgtaagggttatggattattagttttaacaaactactggatcggctgggtncgccagacgcccgggagaggcctggagtgatggatnatctatcctaatcgactctagataggactataacncggcccgtaccttaccaacggccaagtccaaccgtntcctcgtagtcaaccgacgtaccagtaacgtacccgaccctacgtacgactaatgggacgtcgaacgcgtacggacggtccctacggacccgtaccggccgttaggtacttacgtcggtacgaccggtacgtccgggttcttaccgtcctaagtacgacctttaggtacggtacgtccggttacttaacgttacccgtacccggcccttcccgtccccgttgttaccg

SEQ ID NO: 195773 - DNA, 608 bp, Homo sapiens
  misc_feature: GYAE6OF01D7YQP.14.2.A02.1.454.CMB.1.raw
  modified_base (239)..(239): a, c, t, g, unknown or other
  misc_feature (239)..(239): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaaggttanggatatagtttacaaactactggatcggctgggtgcgccagaccgcccggggagacggcctggagtggagtgggaatcatctatcctaatgactctgataggcatacgacgtcccgtccttacgaacggccaagtccaccgtatcctcgaacgtcgaacgtacggtaccaagaacgtacccgcctacctgacaagtcggagcacgcctaggaacggcccgtacggaccaccggtccgttagttacgttacgtcggttcggacgtacggtacccgggttccttggtaccctagttcgtaacttaggttgggtacgttcgtacctttaacgttacgtacccgggccttaccccttcccccgttgttacccg

SEQ ID NO: 195774 - DNA, 1178 bp, Homo sapiens
  misc_feature: GYAE6OF01CFI24.14.2.A02.1.454.CMB.1.raw
  modified_base (156)..(156): a, c, t, g, unknown or other
  misc_feature (156)..(156): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggngtctgtgccgaggtgctaggttggtgcagtcgtggacgcgaggagggtaaggaaaaacggggccggggatctcgtagaagtactccgttacgttagggttaagggttagtagggtaattaagtttaacgtttttaaaccaaacgttacggtagggtacgttcgggtcggttgggggtaccgccggaccgaacgggaccccggggacccggggaagggaccggggtcccggttagggggtagggttacggggtagggttaacggggtaaacctttccgtaagtttacccggtttaaacctttaaccccgtttaaaggttccggttaacccgtttcggttaagggttaacgggttaaccgggggtaaccgttaaccggttaaaccccgggtaccccgggttacccccccgttttaaccccgtttaaccccgggaaaacccgggtaccccgttaaaaccggttacccctaaaccccgttaccgtttacccgttaacccggttaaccgggtttaaccccggtaaacccgggttaacccgggtttaaaccccggtaaaaccgggttaaaaccccgggtttacccccccggtaacccccgtttaaaccggtaaccccggtaaacggttaaaccgggttaccggggtaaaccggtaacccggtaacccggggttaaccccgttaaccgggggaaacccccggggtttaccccgggttaaacccccggggtaaccccgggttaacccccggggtttacccgggttttaaccggttttaaacccgggttttccgggttacggggttaacccccccgggttaggggttaaccccgggggtttaccccggggttttaccccggttaccggttaaccccgtttaaacggttaccggttttaacgggtttacgggtttaacggggttaccggttcccggttaaaccgtttttaaacccgggtttaacccccgggtaacccccgggttccccccggttttaccccccgttcccccggttttccggtttaacccggg

SEQ ID NO: 195775 - DNA, 835 bp, Homo sapiens
  misc_feature: GYAE6OF01EYIYP.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtagaaaagggccgggagtctctgaagatctccgtagtaagggttatggattattagttttaacaaacttcgtggtatcggcgtgggtcgccgccgagaccggcccggggagacggccgtagggacggtgggagtgggaattcgagtcgtattacctaagtcgtacttcgtaggtaagtacgggacgtaacgtaaccgaccgtcccccggtttaccctttaaccggaaaccgggtaccctaaaacggttcccgaacccgttagttaccccgttaaccggtaacgggttacccgaaccggtaacgggttacccgaaacgggttaaaccgttacccccgggtaccctttaaacccggtggtaacccgtaaagggttacggggaccaaccggaaccggtaccccgttaaggggaaacccgggtccccgtaaccgggggaacccctaaccccgggtttaccggtttaaggttaaccgttaaccgggttcggtacgggaccgggttaaccggggtttacccgggttcctttacggttacccgagtttaccggtaacgttttacggtagggtaccgttacggttaccctttaaacggtttacccgggacccggtaccccttccccggtttccccgtggtttaaccc

SEQ ID NO: 195776 - DNA, 782 bp, Homo sapiens
  misc_feature: GYAE6OF01AKXOU.14.2.A02.1.454.CMB.1.raw
  modified_base (254)..(254): a, c, t, g, unknown or other
  misc_feature (254)..(254): n is a, c, g, or t
tcagcgtctagtaccacgaccggtgctcgatttagactcatctacagggggaggtctccctcactgcccacgctgggatctcgagggcttccagtctctcgtcctccaccatcatggggtcaaccgccatcctcgccctcttcctggctgttctccaaggagtctgtgccgaggtgcagttggtgcagtcgtggagcaggaggtaggaaaaagggccggggagtctcgagaagactctccgtggtaacgggttntggatagttacgtttacaactacgtaggactcggcgtgggtcgccgcgaaggccggcccgggaagcggccgtagggagttcggagtagggaatcgactcgtaactaccgtaagtcgtaatccgtgacgtaggacgtacgtaaccgcgtacccgtccgtaaccgaacggacctaaggtacccacgtaacttcgaacgacgtacggacgttcgggaacctacggaaaccgtcccgtaccctacgcgaacgtaggtacggaccgacgtaccggtccgtaacggaaccggtcccgtaaacccggacccgtaacccgggtacggtttacgttaaaccgggtccgttagggtaccgggaccgggtttaacgggtcccccgggttttcttaaccgggtaccttaagggttcccgttaaaccggttttaggggtacccggtaacggtttaccccggaccgttttttaaccggaaccccggttccccggggttaacccccgtttccccccgttaacccggttggttttaaaccccgg

SEQ ID NO: 195777 - DNA, 854 bp, Homo sapiens
  misc_feature: GYAE6OF01DVK35.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctccgccctcttccctggcttgttctccaaggagtctgtcgccggaggtgcagttggtgcagtctggagcaggaggtacggaaaaagggccggggagtctcgtagaagtactccttaccgtaggttaaagggttatgggtaattatttagttttaacaaacttacgtggagtcggcgtgggtcgcgaccgacggaccggccgggaggacgggtcgtagggtaggtagggtaacggtggggtaactacgtactttcttaactttaaccgttaaatcggtaaccttccgttaggtaacggttaacggacgtaactaacccgacgtccccggttaccctaaccgaacgggaccctaacgtaccaccttacgtcctacgacggtccgaaccggtaaccgtaccgaagggtaaccgtccccgtacccttaccgtacgacgtacggtacgggtacgacccgtacgtcccgtaagggaaaccgggtccccgttaaccgggaacccgttaccccgggtacggttttaacgttttaaccggtttaccgggtcgggtacccggtaacggggtaacccgggtttacccggggttacccttttaccggggtaaccctaaggtttacgggttaaaccgtttacggggtttacggtaacgggtttcccttaaaccgttttaacgttttaaacccgggaccccggttccccgtttaccccctttccccggttaaggtttaccc

SEQ ID NO: 195778 - DNA, 858 bp, Homo sapiens
  misc_feature: GYAE6OF01BJ3HR.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcaggttggtgcagtctggagcaggaggtagaaaaagggccggggagtcctctaggaagtatccgtaccgtaggttaaggggttatgggtattagttaggttttaacaaacttacgtaggtagttcggtccgtgggggtcgccggaccaacgggtaccgggaccccgggggaggtaccgggtacccggttagggggtaagggttaggggtaggtacggggggtaacttaccgtacgttaccgttaatttaccccgttaaacgttcgggtaaacctttcgtaacgggtaacgtaacggggtacggtaaaccgttaccggtaaccggtcccccgggttaccccttttaaccggaaaccgggggtaccctaaacgtcccgtaaacccctagttaccccgtacgtaaccggttaccgaacccgtaacggggttaacccgaacggtaaaccggttacccgtacccgtaaccgtcgaccgaacggttcgggaacgtacgaccggtacccgtacggaacgggtcccgaccgggacctacccgggtacccgttaggttaacgtttacggtaggtacggtcccgggacggttcccggggttaaccttcggtaccctcgtaacggtacgttagttcgggtcggtaccgttaccgttacgttaccggtaccggtcccgtacccttcccgttggttaccg

SEQ ID NO: 195779 - DNA, 680 bp, Homo sapiens
  misc_feature: GYAE6OF01EHBS9.14.2.A02.1.454.CMB.1.raw
  modified_base (219)..(219): a, c, t, g, unknown or other
  misc_feature (219)..(219): n is a, c, g, or t
tcagcgtctagtaccacgaccggtgctcgatttagactcatctacaggggggagtctccctcactgcccagctgggatctcagggcttcagtctctgtcctccaccatcatggggtcaaccgccatcctcgccctcttcctggctgttctccaaggagtctgtgccgaggtgctagttggtgcagtctggagcagaggtagaaaagggcgggatctcgngaagatctccgtagtaagggttatggtattagttaagttttaacaaactcgtaggacgtcgggtctggggtcgccgccgaggaccggaccggggagacgggccgtagggaggtgggagtaggggaactcgaacttcgtaactaccgttaatgtaccttacgtagtagtacggtacgtactaaccgaccgtcccccgttacttacccgaacggaccctaaggtaccacctatcctacgaggtaccgaactacgggaccaacggtaacgtcccgacccttacgtcgaacgtaacgtcgggaacgcgacgaccgtacggaacggtcccgtaccggaccgacccggtcgttacgttacttacggtggtacggcggtacggtccggttccgttcgacctagtgtacgttagttcgggcttacgtacttaacgttacgcccggaccctcccgtacccgtgttacccg

SEQ ID NO: 195780 - DNA, 788 bp, Homo sapiens
  misc_feature: GYAE6OF01BUWJP.14.2.A02.1.454.CMB.1.raw
  modified_base (456)..(456): a, c, t, g, unknown or other
  misc_feature (456)..(456): n is a, c, g, or t
tcagcgtctagtaccacgaccggtgctcgatttagactcatctacagggggagtctccctcactgcccagctgggatctcagggcttcagtctctgtcctccaccatcagtggggtccaaccgccatcctcgccccttcttcctgggcttgttcctaccgaaggtcgttcgtggtcggccggtaggtgcgtagttggtgccgtaggtcgtggagctaggaaggtaaggaaaacgggccgggtagtctacgtagaacgtacgtcctcgtaggttaaggtttataggtaatttaagtttaacgtttaacaaacgttacggaggtacgtccggtcggtagggtacgccgtaacggacggaccggacccggggagacggtccggtagggtagggtcggaaggttacgggatacgtacgttactaacttacgtaatcggtaattcgagtaggtaccggtanaacgttaacgcccgtttcccgtaccgttaacggaccgtaaccgtaacgtacccaaccgttctaccggtacgtacggtacgaacgttacggtaaccgtaacggtaaccgtacccgtacgttacaggacgtaacggtaggaccgcgtaacggtcgaacgggtccgacccgtaccgggaacctccggttacgttaacgtttcgtacgttaggtaccggtacggtaccggttccgggttcttacccggtagttaacggtcgtttaacggttaggtcgggttactaccgtacttttaacggcccgttacccggtccttccccgttcgttcgttacgg

SEQ ID NO: 195781 - DNA, 296 bp, Homo sapiens
  misc_feature: GYAE6OF02GPAPF.14.2.A02.1.454.CMB.1.raw
  modified_base (287)..(296): a, c, t, g, unknown or other
  misc_feature (287)..(296): n is a, c, g, or t
tcagcgtctagtaccacgaccggtgctcgatttagactcatctacccgggaatccgggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccatctgagtactagacgctgagcgggctggcaaggcgcatagnnnnnnnnnn

SEQ ID NO: 195782 - DNA, 295 bp, Homo sapiens
  misc_feature: GYAE6OF02FR8HB.14.2.A02.1.454.CMB.1.raw
  modified_base (286)..(295): a, c, t, g, unknown or other
  misc_feature (286)..(295): n is a, c, g, or t
tcagcgtctagtaccacgaccggtgctcgatttagactcatctacccgggaatccgggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcatctgagtactagacgctgagcgggctggcaaggcgcatagnnnnnnnnnn

SEQ ID NO: 195783 - DNA, 295 bp, Homo sapiens
  misc_feature: GYAE6OF02GZLOM.14.2.A02.1.454.CMB.1.raw
  modified_base (291)..(295): a, c, t, g, unknown or other
  misc_feature (291)..(295): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcagcagtataataactggcctccgtggacgttcggccaagggaccaaggtggaaatcaaacgaactgtggctgcaccatctgtcttcatcttcccgccatctgagtactagacgctgagcgggctggcaaggcgcatagnnnnn

SEQ ID NO: 195784 - DNA, 533 bp, Homo sapiens
  misc_feature: GYAE6OF02HP8F7.14.2.A02.1.454.CMB.1.raw
  modified_base (332)..(332): a, c, t, g, unknown or other
  misc_feature (332)..(332): n is a, c, g, or t
  modified_base (432)..(432): a, c, t, g, unknown or other
  misc_feature (432)..(432): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgccagttggtgcaggtctggagcagaggtagaaaaaggccggggagtctctgaagatctcctgtaagggttatcggatatagttttacaaatactggatcgctgggtgcgcagacgccgggagaggcctggagtggatgggaatcatctatcctaatgactntgataggcgatacagcccgtcttcaaggccaagtcacatctcagtcgacaggtccaagaacgtaccgcctacctgcaagtggaagcacgcctgaacgccncggacacccggccgtcgtattaccgtgtagcggagacgggtccttggtccatgactattggagtgccgttattacgtaccggtcgtccttcccctgttccg

SEQ ID NO: 195785 - DNA, 292 bp, Homo sapiens
  misc_feature: GYAE6OF02IWBUZ.14.2.A02.1.454.CMB.1.raw
  modified_base (279)..(279): a, c, t, g, unknown or other
  misc_feature (279)..(279): n is a, c, g, or t
  modified_base (285)..(292): a, c, t, g, unknown or other
  misc_feature (285)..(292): n is a, c, g, or t
tcagcgtctagtaccacgaccggtgctcgatttagactcatctacccgggaatccggggtccctgaccgattcagtggcagcgggtctgggacagatttcactctcaccatcagcagccctgcaggctgaagatgtggcagtttattactgtcaacaatattataataatccatttaattcggcggaggaccaaggtggagatcaaacgaactgtggctgcaccatctgtcttcatcttcccgcatctgagtactagacgctgagcggctggcaaggcncatagnnnnnnnn

SEQ ID NO: 195786 - DNA, 300 bp, Homo sapiens
  misc_feature: GYAE6OF02ID18K.14.2.A02.1.454.CMB.1.raw
  modified_base (292)..(300): a, c, t, g, unknown or other
  misc_feature (292)..(300): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctagaagatgtggctagtttattactgtacaacaatattataataatcctatttaattcggcggaggaccaaggtggagatacaaacgactgtggctgcaccatctgtcttcatccttccgcatctgagtactagacgctgaggcgggctggacaaggcgcaatagnnnnnnnnn

SEQ ID NO: 195787 - DNA, 539 bp, Homo sapiens
  misc_feature: GYAE6OF02GNL03.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaagggttatggatatagttttacaaactactggatcggctgggtgcgcagacgcccgggagacggctggagtggatgggaatcatctatcctaatgactctgataggcgatacagcccgtccttcaaggccaagtcaccatctcagtcgacaggtccagaacgtaccgacctacctgacaatggacgcacgcctagaacggcctcggaccaccgccgtgtacttacgtgtcgcgagtacgggtccttgtccatcgacttagttggagttgccttagttacgtaccggccgcccttcccccgtgttccg

SEQ ID NO: 195788 - DNA, 766 bp, Homo sapiens
  misc_feature: GYAE6OF02HMS3K.14.2.A02.1.454.CMB.1.raw
  modified_base (335)..(335): a, c, t, g, unknown or other
  misc_feature (335)..(335): n is a, c, g, or t
tcagcgtctagtaccacgaccggtgctcgatttagactcatctacaggggaggtctccctcactgcccagctgggatctcagggcttcagtctctgtcctccaccatcatgggtcaaccgccatcctcgccctcttcctggctgttctccaaggagtctgtgccgaggtgcagttggtgcagtctggagcagaggtagaaaaagggccgggagtctacgtgaagatctcctagggtaaggttagtggtatagttagttttaacaaaactactaggagtcggcgtgggtgcgtcgaggacgccgggagaggcctgggagtggagtggaatcacgtntataccgtaatgactctagataggactagacacgtacccgtccctttacgacggacgtacgtacaaccctagtcctacgtacggttccgaacgtaccgggttccaaacgggtaaaccgtaacccggtacccgttaaacccgtccggtaacgtaaacggtacggtaacggaccgacggtccgtaacggaaaccggtccggtaacccgggaacccgtaaccccgggtaccgttacggttaacccgtttaaccgtcgggtttagacccggggtaaaggttaccccggggtttaccgttacccgggttaccctaacggggtttaccgtaacgtttaacgggtttcgggtaacgggtttaacccgtaccgttttaaaccgttacgggtaacccccgggttacccgtccccgttttacccccgtacccggtttacgg

SEQ ID NO: 195789 - DNA, 582 bp, Homo sapiens
  misc_feature: GYAE6OF02G1ZEP.14.2.A02.1.454.CMB.1.raw
  modified_base (345)..(345): a, c, t, g, unknown or other
  misc_feature (345)..(345): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctctgtaaggttatggatatagttttacaactactggatcggctgggtgcgccagaccgcccgggagaggcctgggagtggatggggaatcatctatcctaatgactctgataggcatacncgcccgtccttaccaacggccaagtccaccatctcagtcgacaggtccagaacgtacccgcctacctgaccaagtggagcacgccgtaggacggccctaccggaccaccggacccgttgtacttacgtgtcgccggaggtaccgggttccttacggtccagtacggtaaccttaggttacgggacgttcgtaccgttactttacgtacccggtccgtcccttacccccgtgttaccg

SEQ ID NO: 195790 - DNA, 629 bp, Homo sapiens
  misc_feature: GYAE6OF02HGJ58.14.2.A02.1.454.CMB.1.raw
  modified_base (452)..(452): a, c, t, g, unknown or other
  misc_feature (452)..(452): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtagaaaaagggccggggagtctctgaagatctcctgtaaggtatggatatagtttacaaactactggatcggcgtgggtgcgccaggaccggcccgggagacggccgtgggagtggagtgggaatcatctatcctaatgactctgagtaggcgatacgacgccccgttccttaccgaacggtcccaagtccaacctatcctacacgtcgacgacggtaccaaggaacgtacccgacctaccgtgactaagtggacncgacgtccgtagaacggccctaccggaccacccggtaccgttacgtattaccgtggtacgaccggtacggtccgggtttcccttcggtacccgtaagtacggtaacttaggtttacgggacgttcgtaccgttaacgtttaccggacccggcccttccccgttccccgttgttaccg

SEQ ID NO: 195791 - DNA, 600 bp, Homo sapiens
  misc_feature: GYAE6OF02GP8OX.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgaagatctcctgtaaggttatggatatagttttacaaactactggatcggctgggtgcgccagacgcccgggagaggcctggagtggatgggaatcatctatcctaatgactcgtgagtaggcatacacgtcccgttccttaccgaaggccaagtcaccatctcagtccgacacggtccaagaacgtaccgcctaccgtcgacaagtggaagcgacgccgtagaacggcctacggaccaccggccgttacgtacttacgtcgtacggcgacggtaccgggttccttacggtacctagtcggtaacttaggttcgggtacgttacgtaccgtttaacgttaccgtacccgggtcccgtaccccgttcccccgtagtttacccg

SEQ ID NO: 195792 - DNA, 300 bp, Homo sapiens
  misc_feature: GYAE6OF02JYQGK.14.2.A02.1.454.CMB.1.raw
  modified_base (283)..(283): a, c, t, g, unknown or other
  misc_feature (283)..(283): n is a, c, g, or t
  modified_base (288)..(300): a, c, t, g, unknown or other
  misc_feature (288)..(300): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaatttcggcggaggaccaaggtgagatcaaacgaactgtggctgcaccatctgtcttcatccttcccgcatctgatactagacgctggagccgggctggcgaaggcgnatagnnnnnnnnnnnnn

SEQ ID NO: 195793 - DNA, 673 bp, Homo sapiens
  misc_feature: GYAE6OF02H5268.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtagaaaaagggccggggatctctgaagatctctgtaagggttatggatatagttttacaaactactggtatcggctgggtgcgcagacgcccgggagacggctgggagtggagtgggaatcatctatacctaatcgtactctgaatggacatacacgtccccgtctttaccgaacggtacctaagtccaccgtatcctacgacgttaccgacgacggtaccgaaggtaaaccgtacccgtaccctacccgtgaaccaagtacgggacgaccgacgcccgttaggaaaccgggtcccgtaacgggaaccgtaccccggtccggttacgttactttacgttggtacgtaccggacgggttaccgggttccgtttaccgtacctaacgttcggtaaccttaacggtttagggtaacgttccggtaacctttacgtttaaccgtaacccgggtcccgtaccccttcccccgttgttacccg

SEQ ID NO: 195794 - DNA, 292 bp, Homo sapiens
  misc_feature: GYAE6OF02INBF3.14.2.A02.1.454.CMB.1.raw
  modified_base (285)..(292): a, c, t, g, unknown or other
  misc_feature (285)..(292): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaattcggcggagggaccaaggtggagatcaaacgaactgtggctgcaccatctgtcttcatcttcccgcatctgagtactgacgctgagcgggctggcaaggcgcatagnnnnnnnn

SEQ ID NO: 195795 - DNA, 290 bp, Homo sapiens
  misc_feature: GYAE6OF02H3PLM.14.2.A02.1.454.CMB.1.raw
  modified_base (285)..(290): a, c, t, g, unknown or other
  misc_feature (285)..(290): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaattcggcggaggaccaaggtgagatacaaacgaactgtggctgcaccatctgtctttatcttcccgcatctgagtactagacgctgagcgggctggcaaggcgtcatgnnnnnn

SEQ ID NO: 195796 - DNA, 738 bp, Homo sapiens
  misc_feature: GYAE6OF02I620B.14.2.A02.1.454.CMB.1.raw
  modified_base (181)..(181): a, c, t, g, unknown or other
  misc_feature (181)..(181): n is a, c, g, or t
  modified_base (228)..(228): a, c, t, g, unknown or other
  misc_feature (228)..(228): n is a, c, g, or t
  modified_base (397)..(397): a, c, t, g, unknown or other
  misc_feature (397)..(397): n is a, c, g, or t
  modified_base (572)..(572): a, c, t, g, unknown or other
  misc_feature (572)..(572): n is a, c, g, or t
tcagcgtctagtaccacgaccggtgctcgatttagactcatctacagggggagtctccctcactgcccagctgggatcgtcagggcgttcagtctctgtcctccaccatcatgggtcaaccgccatcctcgccctcttcctggctgttctccaggagtctgtgccgaggtgctagttggtncagtctggagcagaggtagaaaagggccgggtagtcgtctagaacgntcgttccgtaggtaagggttatggtatagttaagttttacgaaactacgttggacttcggtcgtgggtagccgtaccaggaccgtacccgggagacgggtacctgggagttcgggaacgtcgggggaacttcggttcgttccgtggtacgacgttcaaggaaacccgtnaacgttaccgacgtcccgttaccttacggaacggttccgaggtacaactcgtataccgtacggacccgtaacgtacggttacccgtaacgtaacccgtaccggtaccttaacggtcgacggtaggttacggagtaccgacgtacccggtacggacggccgttacgacccgttacnccgttaatcgtaaacctcgttcgaaccgttcgacttcccgacttaacccgactaaccggttaatttcgttttacggtaccgtttacggtacccggggtaccgtacccgggtaacttaacggtcgtttaacccggttcccgtaacggtttaccctaccggtaacccg

SEQ ID NO: 195797 - DNA, 695 bp, Homo sapiens
  misc_feature: GYAE6OF02ITFDT.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgctaggttggtcgcagtctggagcaggaggtaggaaaaagggccggggagtctcgtagaagtactcgtaccgtaggttaagggttagtaggtattaagttaagttttaaccaaaacgttacgtaggtacgtcggtacgtgggtcgccggaccacgggaccggacccggggaggacggccgtgggacggttgggacgtagggaactacgtagttctacttacctaagttcgtacctcgtagagacggactagtaccgacggtccccgtaccgttacgaacggtcctaaagtaccacctactccgtcgaacgtccgaacgacggtaccgaaaggtaaccgtaccgtcctactcgaacagtgacgtcagccgagacgaccgccggacgacccgtcgttagtacttcgtacgtcggacggtacggtaccgttcgttaccgtaccgtagtaccgtaacgtttaggttagtcgttaccgtacctttaacgttaccggttacccgtacggtcccccttacccgttgttaccg

SEQ ID NO: 195798 - DNA, 657 bp, Homo sapiens
  misc_feature: GYAE6OF02HLTFQ.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtgaaaaaggccggggagtctctgagatctccgtgtaagggttatggatattagttttaacaaactactggatcggctgggtgtcgccaggacgcccgggagacggccgtggagtgggagtgggaatcattcgtatacctaatgactctgataggcgatacacgcccgttccttaccgaacggacctaagtccaacatcctactacgtacgacgtacggtaccaacggaaacgtacccgtacctaccgtgaacaagtggacgcacgccgtaggaacggtccgtaccggaccgacccgtcggttacgttaacgttacgttgggttgaccgggtacggaccggggttttcccttacggtacctacgttacggtaaccgtttaggtttacgggtaagttccgtaaccgttttacgttaaccggtacccggtccccggtcccctttcccccggttagtttaccccg

SEQ ID NO: 195799 - DNA, 661 bp, Homo sapiens
  misc_feature: GYAE6OF02I78RJ.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcaggaggtagaaaaagggccggggagtctctagaagatctccgtaggtaagggttatggatattagttttaacaactacgtggatcggcgtgggtcgccgaccgaggaccggcccggggagacggtccgtgggaggtggagtgggaatcatcgtactacctaatcgactcgtagagtaggacgtatacgacgtcccgttccgttaccgaacggcctaacgtccaacctactacctcgacgtaccgacgtacggtaccaacggtaaccgtacccgtacccttaccgtacgacgtaacgtcggacgaccgacgtccgtacggaccggcccgtaccgggaccaccggtccgttacgttacttacgtgtacggacggtacgggtccggttccgttcgccgtagtacgtacgttagttcgggtacgttcgtaccgttacgttacgtacccggtccgtcccgttccccgtgttaccg

SEQ ID NO: 195800 - DNA, 809 bp, Homo sapiens
  misc_feature: GYAE6OF02ITPTQ.14.2.A02.1.454.CMB.1.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcagaggtagaaaaaggccggggagtctctgaagactctcctgtaagggttntggatatagtttacaactactggatggctgggtncgaccagcgcccgggagcggcctggagtggacgtaggggaatcgattactatacctaatcgacttcgtgaagtacggcgtaactacgacgtccccgtaccgtttaccgaacgggtaccctaaagttaccgaacctaacgttccgtaacctacgggttaccgaaccgtacgggtacccgaaacggaaaccggttaaccccggtcccgttaaaccgttacggaaccgtaaaccgttaggggaacccgtacgtaaccgggtaccgttacgggaaacccgggtacccgtaccgggtaacccggtaaccccgggtaccggttaacgtttaacgtttaacccgttcgggttaccggtaccgggtaaacccggggtttaacccggggtttcccggttaaccggtttacccgacgtttaccgggtaaccttttaacggtttacggggtaaccgttcgggtttaacccctttacggttttaacgttaaccccccggggtcccggtttacccccgttacccccccggttagggtttttaacccc

SEQ ID NO: 195801 - DNA, 295 bp, Homo sapiens
  misc_feature: GYAE6OF02GD0NI.14.2.A02.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (286)..(295): a, c, t, g, unknown or other
  misc_feature (286)..(295): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagttttatactgtcaacatattataataatccatttaattcggcggagggaccaaggtgagatcaaacgactgtggctgcaccatctgtcttnatctcccgcatctgagtactagaccgntgaggcgggctggacaagggcncatagnnnnnnnnnn

SEQ ID NO: 195802 - DNA, 854 bp, Homo sapiens
  misc_feature: GYAE6OF02I5PZM.14.2.A02.1.454.CMB.1.raw
  modified_base (153)..(153): a, c, t, g, unknown or other
  misc_feature (153)..(153): n is a, c, g, or t
  modified_base (260)..(260): a, c, t, g, unknown or other
  misc_feature (260)..(260): n is a, c, g, or t
tcagcgtctagtaccacgaccggtgctcgatttagactcatctacagggggagtctccctcactgcccagctgggatctcagggcttcagtctctgtcctccacatcatgggtcaacgccatcctcgccctcttcctggctgttctccaaggngtctggtgccgaggtgctagttggtgcgtagtcgtggagcaggaggtaggaaaacgggccggggtagtcctacgtggaagtactccgtaccgtaggttaaagggttntaggtattagtttaacgttttaacaaaccgttcgtaggtagtccgggtacgttggggtcgccgaccgaacggaccgggacccgggaggtaccggccgtagggaggtcggaggtagggaatcgatacgtacttacctagtcggtactacgtagtacgtacggtacgtaacgtaccgtaccggtccccgttaccttaaccggaacggtacctaaacggtcccaaacccgttactacccgttaccgtaccgggtaaccggtaccggtaaccgggtacccgtaaagggttaaacccggtaccccggtacccttaaaccggttcgaaccgggttaaacgtcgggaaccggtaccgtaacgggtacccgttaaacgggacccggtaccccggttacccgggaaaccccggttcccgggtaccggtttaaggtttaaccctttacgggttaccggacgggttcccgggtaaacggggttcccgggtttaccgttagtacccgttagtaaccggtaactttacggggttacgtaccggttaccgtacccgttttagtaacccggtacccggtcccctaccctttaccccggttgttaaccgg

SEQ ID NO: 195803 - DNA, 851 bp, Homo sapiens
  misc_feature: GYAE6OF02H2NCO.14.2.A02.1.454.CMB.1.raw
  modified_base (155)..(155): a, c, t, g, unknown or other
  misc_feature (155)..(155): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgcctcttcctggctgttctccaaggngtctgtcgccgaggtgctagttggtgctagtcgtggagcaggaggtaggaaaacgggccggggatctcgagaagatcctcgtaggttaagggttataggtacttattacgttttaacaaactacgtaggagtaccgggtcgtaggggtcgccgccgtaaggacccgggcccggggtaggaacgggtccgtagggtacggtagggtacggtaggggtaactacgtaacttaccgtaacttaacccgttaagtcgtacgtacgttaggtaacggttacgggtcgtaactaaccggtaccgtacccccggtttaccgtttaacccgaaacgggtaccctaacgggtacccaacctaacgtcctacgtaccggtaccgtacggacggtacccgtaaaggtaaccgtacccgtaccgttaaccgtacgtaacgtaacggttacggaacgttaccggacggtacccgtacgggtaacccggtacccgtaacccgggtaacccgtacccgggtaccggttaacgtttaccgtttaaacgggttcggtaaccgggtaccgggtacgggtaaccccgggtttcgttaccggtaccttacggttacggtaactttaacggttcgggtacgttaccgggttaacgttaacgtttacccgggtaacccccggttccggtacccccctttccccgggtagtttacccgg

SEQ ID NO: 195804 - DNA, 296 bp, Homo sapiens
  misc_feature: GYAE6OF02GOWS3.14.2.A02.1.454.CMB.1.raw
  modified_base (237)..(237): a, c, t, g, unknown or other
  misc_feature (237)..(237): n is a, c, g, or t
  modified_base (287)..(296): a, c, t, g, unknown or other
  misc_feature (287)..(296): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtctttancttcccgcatctgagtactagacgctgagcgggctggcaaggcgcatagnnnnnnnnnn

SEQ ID NO: 195805 - DNA, 829 bp, Homo sapiens
  misc_feature: GYAE6OF02IC7SM.14.2.A02.1.454.CMB.1.raw
  modified_base (451)..(451): a, c, t, g, unknown or other
  misc_feature (451)..(451): n is a, c, g, or t
tcagcgtctagtaccacgaccggtgctcgatttagactcatctacagggggagtctccctcactgcccagctgggatctcagggcttcagtctctgtcctccaccatcagtgggtcaccgccatcctcgccctcttcctggcttgttctaccaggagtctgtgccggagtgcgtagttggtgcctagtcgtaggagcaacggtaaggtaggaaaaaacggggccggggtaagtcctcgtaggtaagtacttccttaccggttaggtaaacgggttagtaggtaacttattaacgttttaaacaaaaccttcgtacggtaacgtcggtccgttgggtacgccgaccgtaggacccgggtaccgggaggaccgggtaccgtaggggtacggttagggtaacggtacgggtaaactcggtaacttacgttaaccttactaagtcgtaacttcgnggtaacgtacggacgtaacgtacgtaccggtccccgttaccgttaaccgtaaacgtacccgtaaacgtacccgtaaactaccgttccgtaaccgcggttaacgaaccggtaccggtaacgtaaacccggtaaacggtaaccccgtaccgttaaacctacggaacctaacggtacggaacggtaccgtaaccgtcggaaacggtaccgtccggtaaccggtacccacccgggtaccgttacgttacttaccggtagtccgaaccgggtacggacccggtttccgttacgtacgttacacggtttaacttacggtcggtaagttaccgtacccgttagtacccggtacccgtaaccgttcccctaccccgtttggtaccg

SEQ ID NO: 195806 - DNA, 848 bp, Homo sapiens
  misc_feature: GYAE6OF02F6TBR.14.2.A02.1.454.CMB.1.raw
  modified_base (229)..(229): a, c, t, g, unknown or other
  misc_feature (229)..(229): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtctggagcaggaggtaagaaaacgggccgggagtctcgtagaacgngtacctccgttaggtaaagggttatggtaattaagtttacgtttttaaaccaaaaccttacgtaggtacgttccgggtcgttagggggtcgccggacccgtaacgggaccccgggtaccccggggtaaggaccgggtcccgtaggggtaaggttggggtaagttacggggtaaactacgtaacttacgtaacttaccttaaagtccgtaccgttacgtaggtaagttacgggacgtaacgtaccgtaccggtacccccgtttacgtttacccgaacggtaaccgaacggtaccaacccgttacgttcttaccgaacgttaccggaaccgtaccggtaaccggtaaacgtaaccggtttaaccccgacccgttacgttacgaacgtaacgtgggaacgtaaccgaccgccgttaacgggaacggtccgtaccgggacccgtacccggtaccgttacggttaccgttacggttacggtaccgggtaacggtaccgggttacccgggtttaccgttccgttacccgtaacgtcggtaacgtttaggtaaccggtgttacccgttaccgttaaccggtttaccggacccggttacccgtccccgtttacccgttaccgttacg

SEQ ID NO: 195807 - DNA, 304 bp, Homo sapiens
  misc_feature: GYAE6OF02GA3EL.14.2.A02.1.454.CMB.1.raw
  modified_base (289)..(289): a, c, t, g, unknown or other
  misc_feature (289)..(289): n is a, c, g, or t
  modified_base (294)..(304): a, c, t, g, unknown or other
  misc_feature (294)..(304): n is a, c, g, or t
tcagcgtctagtaccacgaccggtgctcgatttagactcatctacccgggaatccggggtccctgaccgattcagtggcagcgggtctgggacagatttcactctcaccatcagcagcctgcaggctgaagatgtggcagttttattactgtacaacaatattaataataatccatttaattcggcggagggaccaaggtggagataccgaaacgaactgtgctcgcaccatctgtctcatcctcccgcatctagatactagaccgctagaggcgggctggcaaggtcncatgnnnnnnnnnnn

SEQ ID NO: 195808 - DNA, 839 bp, Homo sapiens
  misc_feature: GYAE6OF02GE7BM.14.2.A02.1.454.CMB.1.raw
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaaggagtctgtgccgaggtgcagttggtgcagtcgtggagcaggtaggtaggaaaaagggccggggagtctctagaagatctcgtaggtaaggttagtggatagttagtttaacaactacgtggacgtcggtcgtgggtcgccgaccgaggaccgggacccggggaaggtaccgggtccggtaggggtacgggttagggaacggttagggggaaacttcgtaacgttaccgttaacgttaccgttaaagttcgtaaccttcggttagtaacggttacgggacgtaacgtaccgtaacccgggttcccccgtttaccgttacccggaaacggtacccgtaaacggttaacccaaccctacgttcccgtaccgtaacggttaccggaacggttaaccggtacccgaaaggtaaacccggtacccgtacccgttaaccgtcggaaactaaggtacggtaacgccgtacgtccgtacggaaccggtcccggtaccggtaacccgcccggttacggttacgtttaacgttacggttcggtacggtaccggacgggttacccgggttcttaccgtaccgtcgttacggttaaccgtttagggttaccggtacggttaccgttaaccgtttaacgtttaacccgggttcccccgtaccccgggtttcccccttaccccggttacggttttacccg

SEQ ID NO: 195809 - DNA, 859 bp, Homo sapiens
  misc_feature: GYAE6OF02JMCR3.14.2.A02.1.454.CMB.1.raw
  modified_base (197)..(197): a, c, t, g, unknown or other
  misc_feature (197)..(197): n is a, c, g, or t
tcagcgtctagtaccacgaccggtgctcgatttagactcatctacagggggagtctccctcactgcccagctgggatctcgagggcttcagtctctgtcctccaccatcagtggggtacaaccgccatccctcgccccttcttcccgtggcttcgttcctaccgaaggcgtctgtcgccgagggtgcgtaggttggngactaggtcgtagggagcgaggaagggtaaggaaaaacgggcgggggattcgtcgtagaacgtcttccgtacgtaggtaagggttagtacggtaattagtttaacgtttaaccaaacgttacgtcggtaacggtcgggtacggttggggtacgacccggccggaacggtaccccggggacccgggggaacggtccggggtcggtacggggtacgggttaagggtacgggtacgggtataccgtacttacgttaacgttacccgttaaggtcgtaccttacgggtaagtaccgttaagggaccgtaacgtacccggtttaccccggtaccccgtttacccgaaccggaacggtaaccctacggtacctacccgtacgttccctaggaccgttaaccgacggtaacgtaccgaacgttaacccggtccctaccgtacgacgtacgacgtacgacgaaccgtccggtaccgtaacgggaaccgtaccgggtaccggtaaccgtccgggtaccttaggttaccgttaccggtcgttaaccgggcgggttaacggttcccgttaaccgttcggtaccgtagttacgttaaccggttggttacggtacggtacgttaccgttaacggttccgtacccggtcctaaccccgtttccggttaccgttccg

SEQ ID NO: 195810 - DNA, 719 bp, Homo sapiens
  misc_feature: GYAE6OF02GVDDT.14.2.A02.1.454.CMB.1.raw
  modified_base (286)..(286): a, c, t, g, unknown or other
  misc_feature (286)..(286): n is a, c, g, or t
  modified_base (714)..(714): a, c, t, g, unknown or other
  misc_feature (714)..(714): n is a, c, g, or t
tcagcgtctagtaccacgaccggtgctcgatttagactcatctacagggggagtctccctcactgcccagctgggatctcaggcttcagtctctgtcctccaccatccagtgggtcaaccgccatcctcgccctcttcctggctgttcctccaaggatctgtgccgaggtgctaggtttggtgctagtcgtggagcagaggtagaaaagggccggggatctctaggaagattctcctaggttaagggttatggattagttacgttttaacaaactacgtgatcggngtgggtcgcgcaggaccggccgggagacggccgtaggagtggagtacgggaattcgatctaactactaagtcgtacctgtagagtacggctaacgtacgaccggtcccgttacccttaaccgaacggtaccctaacggttacccaaccgtacgttcccgtacgtacgtaccggaccgtacgggtacccgaaaggtaacccggtaccccgtacccttaccgtacgaaccgtaggtcggaaccgacgaccggtccggtaacggaaccgggtccgtaaccggacccgtacccggggttcgttaacgttactttccggtaggtccgaccgggtaccggtaccgggtttacctcggtaccacgttcgtaacgtggttacggtacgttccgttatttaacgtcccggtacggtacccgtccccgttacccgttntaccg

SEQ ID NO: 195811 - DNA, 680 bp, Homo sapiens
  misc_feature: GYAE6OF02G8BBK.14.2.A02.1.454.CMB.1.raw
  modified_base (536)..(536): a, c, t, g, unknown or other
  misc_feature (536)..(536): n is a, c, g, or t
  modified_base (614)..(614): a, c, t, g, unknown or other
  misc_feature (614)..(614): n is a, c, g, or t
tcagcgtctagtaccacgaccggtgctcgatttagactcatctacagggggagtctccctcactgcccagctgggatctcagggcttcagtctctgtcctccaccatcatggggtcaaccgccatcctcgccctcttcctggctgttctccaggagtctgtgccgaggtcgcgacgttggtgctagtctggagcaggaggtacgaaaacgggcccggggagtcctactgaagactccgtccgtaggtaaggggttactaggtaattagtttacgtttaacaacgttacgtaggtaccgtaccggcggttgggtacgccggtccgacggaccggacccgggggcgtacggccggtaggaggttggagtacgggaactacggtacttacgtactaccgtaaatcgtaacctcgtaggtatagggtccgtaacgtcccgacggtccccgttaccctaccggaacggtcctacggtaccacctaccgttctaccgtagtacccgtaacgtacgtaccaagtaccgtaccctactaccganacacgtacggctacgacgtacgtgacgtccgcggaccgtcgtaccgttgtacccgttgcggtcgagtcggcgtttacncttccgatccggtaatggttacgtggtccctagtttcgcggtacccgtctccccgtccgtcgttcg

SEQ ID NO: 195812 - DNA, 974 bp, Homo sapiens
  misc_feature: GYAE6OF02H0KKV.14.2.A02.1.454.CMB.1.raw
tcagcgtctagtaccacgaccggtgctcgatttagactcatctacagggggagtctccctcactgcccagctgggatctcagggcttcagtctctgtcctccaccatcatgggtcaaccgccatccctcgccccttcttcccgtggccttcgttcctaccgaagggtcgtcttggtcggccggaggtgctaggttggtcgactgtcgtgggagcgaggtaggtaaggaaaacggggccgggtagttctacgtaggaacgtcttccttacggttaggttaagggttagtacggtaatttagtttaacgttttaaacaaacgttacggtaggtacggtcggtacggtggggtcgaccggaccgacgggtacccgggaccggggtaggaccggtcggtaggggtaacggtagggtaaggtacgggtaacttaccgtacgttaccgttaaccgttaaccgtaaacggttcgttaaccgttcgttaagtaacggtacgggtaaccgtaaccgtacccgtacccggttaccccgttaccgttaacccggaacggtaacctaccgtacaaccgttacttcgtacgtacggtaccggtaacgtaccggtaaacccgtaaacggttaaccccggtacccgttaccgttaccggtaaccggtaccgtaagggtaacggtaccgacggtacccggtacggtaacccgggtaaccgggtccccggaacccgggtacccgttaacccggggttaccggtttacctttaaaccgggttcggtaccgggtttaaccgggtacccgggttaccgggtttaacccgggtttacgtttaccggttacccgttacgggttaaccgttaacgggtttacggttaacggggttacgttaaccccggtttaaccggtttaaacccggttaccccgggttaccccggtttaacccccggtttcccccggtttacccccgtttaggtttaaccccggg

SEQ ID NO: 195813 - DNA, 368 bp, Homo sapiens
  misc_feature: GYAE6OF01DHL0H.19.42.D09.1.454.CMB.1.raw
  modified_base (361)..(368): a, c, t, g, unknown or other
  misc_feature (361)..(368): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaccgtctcctcagcctccaccaaggcccatcggtcttccccctggcgccctgctccaggagcacctccgagagcacagcggccctgggctgcctggtcaaggactacttcccacgagagtactgagcgggctggcaaggcgcatagnnnnnnnn

SEQ ID NO: 195814 - DNA, 420 bp, Homo sapiens
  misc_feature: GYAE6OF01BM55A.19.42.D09.1.454.CMB.1.raw
  modified_base (369)..(369): a, c, t, g, unknown or other
  misc_feature (369)..(369): n is a, c, g, or t
  modified_base (373)..(379): a, c, t, g, unknown or other
  misc_feature (373)..(379): n is a, c, g, or t
  modified_base (381)..(381): a, c, t, g, unknown or other
  misc_feature (381)..(381): n is a, c, g, or t
  modified_base (383)..(420): a, c, t, g, unknown or other
  misc_feature (383)..(420): n is a, c, g, or t
tcagtactctcgtgcacgaccggtgctcgatttagacacatacgcagggaagggccgattcaccatctccagagacaattcccaggaacacggtgtttctgcaaatgaacagcttgagacctggacgacacggctgtctattactgtgcgaaggagtttcgcacccaagtacaactccgaaccatactttgactactggggccagggaaccctggtcaccgtctcctcagcctcaccaagggcccatccggtcttccccctggccgccctagctcccaggagcacctccgagagctacagcggccctgggctgcctggtcaaggctacttccacgagacgtactggagcgggctggcaaggcgcatagnagcnnnnnnnangnnnnnnnnnnnnnnnnnnnnnnnnnnnnnnnnnnnnnn

SEQ ID NO: 195815 - DNA, 451 bp, Homo sapiens
  misc_feature: GYAE6OF01A9KD0.19.42.D09.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(396): a, c, t, g, unknown or other
  misc_feature (395)..(396): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (408)..(451): a, c, t, g, unknown or other
  misc_feature (408)..(451): n is a, c, g, or t
tcagtactctcgtgcacgaccggtgctcgattttagacacatacgcaggggaagggccgattcaccatctcccagagacaattccaggaacacggtgtttctgcaaatgaacagcttgagacctgacgacacggctgtctatttactgtgcgaaggagtttcgcacccaagtacaactccgaaccatactttgactatggggccagggaaccctggtcaccgtctccgtcagcctccaccgaacgggcccatccggtcttccccctggccnccctgcctccaggngccaccctccggagtancacagcggccctgggcctggccctgggtccaaggcctacttccgacgagagttctgnggacgggctggccaaggcgacagtaagnagancnanncgtnangtnacnnnnnnnnnnnnnnnnnnnnnnnnnnnnnnnnnnnnnnnnnnnn

SEQ ID NO: 195816 - DNA, 428 bp, Homo sapiens
  misc_feature: GYAE6OF01CLFYQ.19.42.D09.1.454.CMB.1.raw
  modified_base (410)..(410): a, c, t, g, unknown or other
  misc_feature (410)..(410): n is a, c, g, or t
  modified_base (412)..(428): a, c, t, g, unknown or other
  misc_feature (412)..(428): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactacgtggggccagggaaccctggtccaccgtctcctcagcctccaccgaagggcccagtccggtccttcccccgtggccgccctgcctccgaggacgccacctccgagacgcacgacggccggccgtggggctcggccgtgggtccaaacggtacctaccttacccgacggacgtacggtactggacggcggggtctcgggaccgaaggcgactagtagnannnnnnnnnnnnnnnnn

SEQ ID NO: 195817 - DNA, 607 bp, Homo sapiens
  misc_feature: GYAE6OF01DDVLC.19.42.D09.1.454.CMB.1.raw
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (588)..(589): a, c, t, g, unknown or other
  misc_feature (588)..(589): n is a, c, g, or t
  modified_base (594)..(598): a, c, t, g, unknown or other
  misc_feature (594)..(598): n is a, c, g, or t
  modified_base (600)..(600): a, c, t, g, unknown or other
  misc_feature (600)..(600): n is a, c, g, or t
  modified_base (602)..(603): a, c, t, g, unknown or other
  misc_feature (602)..(603): n is a, c, g, or t
  modified_base (605)..(606): a, c, t, g, unknown or other
  misc_feature (605)..(606): n is a, c, g, or t
tcagtactctcgtgcacgaccggtgctcgatttagacacatacgcagggaaagggtgtacacctgtggttctcggggctgcccttttggttttggagatggttttctcgatgggggctggagtgggtgggagttctgtcatatgatggaagtataaatactttggagactccgtgaagggccgattcaccatctccagagaacaattccaggaacacggtgtttctgacaaatgaacagtcttagagacctagacgacacggctgtactattactggtgacgaaggtagttcgacaaccaagtacaactaccgaacaacttacttcgactacgtcgggacacggaaccgtggtccaccgtcgtcctcgacgtcctacccaaccgaacggcccagtacccggtccttacccccgtggcccgcccncgtcccgtaccgacgggacncccgaccgtaccgacggacgacgaccacggccggacccgtggaccgtcgccgtggaccgtaaacggaccttacccgtaccgacgaagacgtacgacggacggcgggcgtagggacgaagggcgacgtaagaggtnacncgacgnngtgannnnncnanngnng

SEQ ID NO: 195818 - DNA, 696 bp, Homo sapiens
  misc_feature: GYAE6OF01EJX9Z.19.42.D09.1.454.CMB.1.raw
  modified_base (168)..(168): a, c, t, g, unknown or other
  misc_feature (168)..(168): n is a, c, g, or t
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
tcagtactctcgtgcacgaccggtgctcgatttagacacatacgcagggaaagggtgtacacctgtggttctcggggctgtccctttggttttggagattggttttctcgagtgggggctgggagtggggtgggagttctgtcatatgatggaagtataatcttgganactcgtgaggcattcacatctcaganacatcagacncgtnttcngacaaatgaacagtctagacgacctgaccacgacggcttagtactattactggtgacggaaggtcgttcgacaacccaagtacaactccgaactatcttcgactacgtcgggaccaggacctgtcaccgtctcctcgacncctccgaaccgaacggccctacgttccggtcccttccccgnggtcccgtacccgttcgccgtaccgacggtaaccgcccggtacccgtacggtaacggaccgttacccgaaaccgccggggtacccggtccccggtacgggtccttaccgggtcccgttaccgggtaaccgtaaccgggtaaccctttaacccggttaccccgaaccggtaaggtaaccggttaccggtaacgggttaccgggacccggggttcgtacggggtaacccggtaaacgggtccgtaacgaacgggttacgacgacgttacgcgtcgcgtagagcgacgcacgtcgacgancngngc

SEQ ID NO: 195819 - DNA, 760 bp, Homo sapiens
  misc_feature: GYAE6OF01ADCD6.19.42.D09.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (730)..(730): a, c, t, g, unknown or other
  misc_feature (730)..(730): n is a, c, g, or t
  modified_base (745)..(745): a, c, t, g, unknown or other
  misc_feature (745)..(745): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
  modified_base (757)..(760): a, c, t, g, unknown or other
  misc_feature (757)..(760): n is a, c, g, or t
tcagtactctcgtgcacgaccggtgctcgatttagacacatacgcagggaaagggtgtacacctgtggttctcggggctgtcccttttggttttggagattggtttttctcgatgggggctggagtgggtggtagttctgtcatatgatggaagtataatctttggagactccgtgaaggcattcacntctccagagacaattccgaggaactacggtgtttcngacaaagtgaactgccttaggacgtaacgcgaaccgacgtacggtcttgtcttaattcgtggtacggaacggtaaggtaccgttaccggacctaaacccgtaacgtaacccgaaccgttaccggaaacccttaacgtttaaccgtttacggtaaccgtacggtaccggggaccgtaaaccggggtaacccgttcgggtaaccctacccgggttcctaccctaccggacccgtaccgttacccgaacccggtaaccggggtccctacggttcccggttcccgtccccggtaggtccccgccgttcgtacccgtaccgtacggaccgtaccgaccggtaccgaacgccgacaccggtaaccggcccggtacccggttggaccgttacggaccggttacgaacggttaaccgcccgtttaaaccgtcccgtaacgggacgtaaacgggttcccggtagggtaccggtaccgggttacgacgggtaaccggacggtctaacggtagtcgngtcacgtgcaagcancgacntncnatnnnn

SEQ ID NO: 195820 - DNA, 601 bp, Homo sapiens
  misc_feature: GYAE6OF02JA6AT.19.42.D09.1.454.CMB.1.raw
  modified_base (567)..(567): a, c, t, g, unknown or other
  misc_feature (567)..(567): n is a, c, g, or t
  modified_base (590)..(601): a, c, t, g, unknown or other
  misc_feature (590)..(601): n is a, c, g, or t
tcagtactctcgtgcacgaccggtgctcgatttagacacatacgcagggaaagggtgtacacctgtggttctcggggctgccctttggttttggagatggttttctcgatgggggctggagtgggtgggagttctgtcatatgatggaaggtataaatactttggagactccgtgaagggccgattcaccatctccagagacaattccaggaacacggtgtttctgcaaatgaacagcttgagacctgacgacacggctgtctattactgtgcgaaggggtcgtcgacccaacgtaacgaacctaccgtaacccgaactacttttacgttacgtaaccttacggggtccggaccgggaacccggtaccggttcggtacccgtaccgttccctcccgtacgaccgtccctacccaaacgggacccggacctacggtccgtttcccccttcccggcggccccgtccgtcgtccctacggacggccaccctacccgtacggagccaccacggcgggccccgtcgggcgtcgccgtcggtcgaacgacgtacttcccaccgagagtactgngcggccgtgcgacgacgcatagnnnnnnnnnnnn

SEQ ID NO: 195821 - DNA, 363 bp, Homo sapiens
  misc_feature: GYAE6OF02F4O38.19.42.D09.1.454.CMB.1.raw
  modified_base (359)..(363): a, c, t, g, unknown or other
  misc_feature (359)..(363): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaccgtctcctcagcctccaccaagggcccatcggtcttccccctggcgccctgctccaggagcacctccgagagcacagcggccctggctgcctggtcaaggctacttcccacgagagtactgagcggctggcaaggcgcatagnnnnn

SEQ ID NO: 195822 - DNA, 391 bp, Homo sapiens
  misc_feature: GYAE6OF02FVEKB.19.42.D09.1.454.CMB.1.raw
  modified_base (370)..(391): a, c, t, g, unknown or other
  misc_feature (370)..(391): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaaccgtctccgtcagcctccacctaagggccccaatcggtcttccccctggccgcccctgctccacggagcacctccgagtagcacagcggccctgggctgcctggtcaaggctacttcccagagagtactgagcggggctggcaaggcgcatagnnnnnnnnnnnnnnnnnnnnnn

SEQ ID NO: 195823 - DNA, 489 bp, Homo sapiens
  misc_feature: GYAE6OF02FT30L.19.42.D09.1.454.CMB.1.raw
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
  modified_base (476)..(489): a, c, t, g, unknown or other
  misc_feature (476)..(489): n is a, c, g, or t
tcagtactctcgtgcacgaccggtgctcgatttagacacatacgcagggaaagggtgtacacctgtggttctcggggctgccctttggttttggagatggttttctcgatgggggctggagtggggtgggagttctgtcatatgatggaaggtataaatactttggagactccgtgaagggccgattcaccatctccagagacttttctcagaacacactgtctcttcaaatgaacagcctgagggccgaggacacggccgtctattattgtgtgagagtttatggcgatggctggtggacagatcactggggccagggaccctgggtcaccgtctcctcagcctccaccaagggcccatcggtcttcccccnggccgccctgctccaggancacctccgagacgcacagcggccctgggctgctggtcaggctactcccagngtctgagcgggctgggcaagggcgacagtacgnnnnnnnnnnnnnn

SEQ ID NO: 195824 - DNA, 529 bp, Homo sapiens
  misc_feature: GYAE6OF02G0M9E.19.42.D09.1.454.CMB.1.raw
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (485)..(485): a, c, t, g, unknown or other
  misc_feature (485)..(485): n is a, c, g, or t
  modified_base (506)..(507): a, c, t, g, unknown or other
  misc_feature (506)..(507): n is a, c, g, or t
  modified_base (510)..(511): a, c, t, g, unknown or other
  misc_feature (510)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (521)..(529): a, c, t, g, unknown or other
  misc_feature (521)..(529): n is a, c, g, or t
tcagtactctcgtgcacgaccggtgctcgatttagacacatacgcaggggtaaaggggtgtacacctgtggttctcggggctgccctttggttttggagatggttttctccgatgggggctgggagtgggtgggagttctgtcatatgatggaaggtataaatactttggagactccgtgaagggccgattcaccatctccagagacaattccagggaaccacggtgtttctgcaaaattgaacgagctttgaagtacctggaccgacacggctgtctaattactgtgaccgaagggagttcgccacccaaagtaccaactccgaaccatacttgactactgggccagggaccctggtccaccgtctcctcngcctccaccgaggccagtcgtctccccngccncctgctccagcncnctcgancgcacagcgacctggctgctggtcaaggcctacgttcccagagacgtactggacgccgggntcggctaacggcgacgatagnnganngnangnacgnnnnnnnnn

SEQ ID NO: 195825 - DNA, 383 bp, Homo sapiens
  misc_feature: GYAE6OF02GNYEA.19.42.D09.1.454.CMB.1.raw
  modified_base (263)..(263): a, c, t, g, unknown or other
  misc_feature (263)..(263): n is a, c, g, or t
  modified_base (362)..(362): a, c, t, g, unknown or other
  misc_feature (362)..(362): n is a, c, g, or t
  modified_base (369)..(383): a, c, t, g, unknown or other
  misc_feature (369)..(383): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaccgtctcctcagcctccaccaagggcccatcggtcttccccctggccnccctgctccaggagccacctccgagagcacagcggccctggggctgcctggtcaaggctactcccaacggagacgtactgagccgggtctggcaaggcncaatggnnnnnnnnnnnnnnn

SEQ ID NO: 195826 - DNA, 396 bp, Homo sapiens
  misc_feature: GYAE6OF02FYGVX.19.42.D09.1.454.CMB.1.raw
  modified_base (366)..(396): a, c, t, g, unknown or other
  misc_feature (366)..(396): n is a, c, g, or t
tcagtactctcgtgcacgaccggtgctcgatttagacacatacgcagggaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaccgtctcctcagcctccaccaaggcccatcgtcttcccctggccgccctgctccaggacgctacctccgagagcacagcggccctgggctgcctggtcaaggctactcccacgagacgtactgaggtcgggctaggcaaggcgacatagcnnnnnnnnnnnnnnnnnnnnnnnnnnnnnnn

SEQ ID NO: 195827 - DNA, 751 bp, Homo sapiens
  misc_feature: GYAE6OF02IHBQE.19.42.D09.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (719)..(719): a, c, t, g, unknown or other
  misc_feature (719)..(719): n is a, c, g, or t
  modified_base (739)..(739): a, c, t, g, unknown or other
  misc_feature (739)..(739): n is a, c, g, or t
tcagtactctcgtgcacgaccggtgctcgatttagacacatacgcagggaaagggtgtacacctgtggttctcggggctgccctttggttttggagatggttttctcgatgggggctggagtggggtgggagttctgtcatatgatggaagtataaatactttggagactccgtgaagggccattcaccatctccagagacaattccaggaactacggtgtttcngacaaatgaacngcttganacctgacgacacggctgacttattactgtgcggaaggtagttccgcaccccaaagtacaactccgaaccattactttcgactacgtcggggaccacgggtaaccctggtcacccgtctccctcacgtccctcaccgaagggcccaacgtcgtccttccccgtcggccgtccgcgtcctacccgaggacgtaccacccctccggaacgacgtaccgaacccgtacgggacccgggaccccgttcgggggtcctcccgggtaccccggtttacggggttaacccggaaaaccgggttaacccccgtttaaaccccgttttacccccccggaaaaggggtacccggggttaaaacggttaaccccggtttacgggggaaacccggggtacccggggggttcccgttaaaccgggggaacccggtaaaggggggtccccgtaacgtaaacgttaaacgggctacgagccgaagttcggngacgcgacgtgacgacgacncgtacgcgcacg

SEQ ID NO: 195828 - DNA, 121 bp, Homo sapiens
  misc_feature: GYAE6OF01EB3LL.13.24.C02.1.454.CMB.1.raw
  modified_base (121)..(121): a, c, t, g, unknown or other
  misc_feature (121)..(121): n is a, c, g, or t
tcagtcacgtactacacgaccggtgctcgatttagtacagatcgttagggaaggtgtgcacgctgcctggtcaaggactacttcctagtacgtgactgagcgggctggcaaggcgcatagn

SEQ ID NO: 195829 - DNA, 711 bp, Homo sapiens
  misc_feature: GYAE6OF01B8I18.13.24.C02.1.454.CMB.1.raw
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
tcagtcacgtactacacgaccggtgctcgatttagtacagatcgttagggaaaggggctgggagaggagccccagccctgagattcccaggtgtttccattcagtgatcagcactgaacacagaggactcaccatggagttgggactgagctggtattttcctttggctaattttaaaaggtgtccagtgtgaagtgcagctggtggagtcgtgggggaggcttggtacagccgtggccgggtccctgagactctcctgtgtagtttctgggcttctacgtttgtgatcgtgccatgcacgtgggtcccacaaagtccgaggggacggcctgggagtgggtctagaggttactttagngggaaacaggtagaaaagagtagggtanggcggactgtagtggaagggccgtattccacctagtctacgagacgaacgaaccgaccaaacgtaaccttacccttaccgtttttacgaacctaaacgtacggtaaacctacgttacctaacgtaaaacgtacggaacggtaaccgttaccggtacctttaacgttaactttaaccgttacgttaacctaacgtaaaaggtaaaagttaaagtaaacggttacgggggtacgttaccgggtaaccgttaacgggtcgggggacccgtaacgggggtaccgtacccggttacggtacccgtaacccggttccgtcccgtaacccgg

SEQ ID NO: 195830 - DNA, 121 bp, Homo sapiens; identical to SEQ ID NO: 195828
  misc_feature: GYAE6OF01D0VU8.13.24.C02.1.454.CMB.1.raw
  modified_base (121)..(121): a, c, t, g, unknown or other
  misc_feature (121)..(121): n is a, c, g, or t

SEQ ID NO: 195831 - DNA, 156 bp, Homo sapiens
  misc_feature: GYAE6OF02HCHN3.13.24.C02.1.454.CMB.1.raw
  modified_base (154)..(156): a, c, t, g, unknown or other
  misc_feature (154)..(156): n is a, c, g, or t
tcagtcacgtactacacgaccggtgctcgatttagtacagatcgttagggaaagggaccaaggtggaaatcaaacgaactgtggctgcaccatctgtcttcatcttcccgccatctgatagtacgtgactgagcgggctggcaaggcgcatagnnn

SEQ ID NO: 195832 - DNA, 154 bp, Homo sapiens
  misc_feature: GYAE6OF02GDNN7.13.24.C02.1.454.CMB.1.raw
  modified_base (154)..(154): a, c, t, g, unknown or other
  misc_feature (154)..(154): n is a, c, g, or t
tcagtcacgtactacacgaccggtgctcgatttagtacagatcgttagggaaagggaccaaggtggaaatcaaacgaactgtggctgcaccatctgtcttcatcttcccgccatctgatagtacgtgactgagcgggctggcaaggcgcatagn

SEQ ID NO: 195833 - DNA, 155 bp, Homo sapiens
  misc_feature: GYAE6OF02FSA3X.13.24.C02.1.454.CMB.1.raw
  modified_base (154)..(155): a, c, t, g, unknown or other
  misc_feature (154)..(155): n is a, c, g, or t
tcagtcacgtactacacgaccggtgctcgatttagtacagatcgttagggaaagggaccaaggtggaaatcaaacgaactgtggctgcaccatctgtcttcatcttcccgccatctgatagtacgtgactgagcgggctggcaaggcgcatagnn

SEQ ID NO: 195834 - DNA, 123 bp, Homo sapiens
  misc_feature: GYAE6OF02HRM3R.13.24.C02.1.454.CMB.1.raw
  modified_base (121)..(123): a, c, t, g, unknown or other
  misc_feature (121)..(123): n is a, c, g, or t
tcagtcacgtactacacgaccggtgctcgatttagtacagatcgttagggaaggtgtgcacgctgcctggtcaaggactacttcctagtacgtgactgagcgggctggcaaggcgcatagnnn

SEQ ID NO: 195835 - DNA, 176 bp, Homo sapiens
  misc_feature: GYAE6OF02GU5UZ.13.24.C02.1.454.CMB.1.raw
  modified_base (171)..(176): a, c, t, g, unknown or other
  misc_feature (171)..(176): n is a, c, g, or t
tcagtcacgtactacacgaccggtgctcgatttagtacagatcgttagggaaaggggctgggagaggagccccagccctgagattcccaggtgtttccattcagtgatcagcactgaacacagaggactcaccatggagttgggactgagcgggctggcaaggcgcatagnnnnnn

SEQ ID NO: 195836 - DNA, 485 bp, Homo sapiens
  misc_feature: GYAE6OF01DGMDK.16.68.G02.1.454.CMB.1.raw
  modified_base (443)..(443): a, c, t, g, unknown or other
  misc_feature (443)..(443): n is a, c, g, or t
  modified_base (469)..(469): a, c, t, g, unknown or other
  misc_feature (469)..(469): n is a, c, g, or t
tcagtgtactactccacgaccggtgctcgatttagtcgatagtgaagggaaggggcaggagtcagacccagtcaggacacagcatggacatgaggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtggggtcccatcaaggttcagcggcagtggatctgggacagaattcactctcactatcaccagcctgcaacctgatgatttgctaacttattactgccaacagtatcatcatcattgtaatttcggnggaggacaggtgaggtcaaagactgngctgcacatctgtctc

SEQ ID NO: 195837 - DNA, 481 bp, Homo sapiens
  misc_feature: GYAE6OF01BUXAU.16.68.G02.1.454.CMB.1.raw
  modified_base (329)..(329): a, c, t, g, unknown or other
  misc_feature (329)..(329): n is a, c, g, or t
  modified_base (436)..(436): a, c, t, g, unknown or other
  misc_feature (436)..(436): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
tcagtgtactactccacgaccggtgctcgatttagtcgatagtgaagggaaagggggcgaggagtcagacccagtcaggacacagcatggacatgaggtccccgctcagctctgggctcctgctgctctggctcccaggtgccagatgtgacatccagatgacccagtctccttccaccctgtctgcatctgtaggagacagagtcaccatcacttgccgggccagtcagaatataatagtgttgctggtatcagcagaaaccaggaaagcccctaaggtcctgatatatgagacttctactttagaaagtgggtccatcaagttcagngcagtggatctgggacagaattcaactctcactatcaccagcctgcaactgatgattttgactaacttattactgcaacagtatcatcatctaattgtaatttcggngtaggacaaggtggagtcaaagactgngctgcacatctgtntacg

SEQ ID NO: 195838 - DNA, 508 bp, Homo sapiens
  misc_feature: GYAE6OF01B4JWO.16.68.G02.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagtgtactactccacgaccggtgctcgatttagtcgatagtgaagggaaagggggcgaggacgtcagacccacgtcaggacacagcatggacattgagggtccccgctcagctcctggggctcctgctgctctcggctcccaggtgccagatgtgacatccagatgacccagtctccttccaccctgtctgcatctgtaggagacaggagtcaccatcacttgccgggcagtcagatattaataggtgttgctggtatcagcagaaccngggaagccctaaggtcctgatanactgagacttctactttagaagtggggtcccatcaaggttcagcgcagtggatctgggacaggaacttcactctcactatcaccagcctgcaacctgatgattttgctaacttacttactgaccaacagtatcatcatcattgtaatttcggtggaggtaccaggtggaggtacaaacgattggtaggtcgtgcgacgagttcttgtctttacg

SEQ ID NO: 195839 - DNA, 563 bp, Homo sapiens
  misc_feature: GYAE6OF01CZH67.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagatataataggtgttgctggtatcagcagaaaccagggaaacgcccctaaaggtcctgatatatgagtactttctactttagaaagtggggtcccatcaaggttcagcggcagtggatctgggacagaattcactctacactatcaccagcctgcaacctgatgtattttgactaactttacttactagacctaactagttactactaatctaattactatttagttaagttttcgggtagggtaacgggtaaccgaagggttaggaaggttacaaacggtaacgttgggacggtacttacggacctaaccgtagttccgtgttcctttaccg

SEQ ID NO: 195840 - DNA, 543 bp, Homo sapiens
  misc_feature: GYAE6OF01C6F0W.16.68.G02.1.454.CMB.1.raw
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtcccctcacctgcactgtctctggtggctccttcagcagttactactggagctggatccgtcagctcccgagggaaggctggagtggattgcctatatctcttacagtgggancagcaactacaacccctcctnaagngtcgagtcgacatattagagacacgtaccaaagacctagtttcccngagctgagtctgtgaccgntgcggacacggtcctttatctgtgcgcgacggccctagtccgagtcgactagtcgactcccgacggtcccttgacctccgtcggggccacgggtaccctggtccaccgtctccctcacgcctcccgaaccgg

SEQ ID NO: 195841 - DNA, 637 bp, Homo sapiens
  misc_feature: GYAE6OF01CVM73.16.68.G02.1.454.CMB.1.raw
  modified_base (318)..(318): a, c, t, g, unknown or other
  misc_feature (318)..(318): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcgggagaccctgtccctcacctgcactgtctctggtggctccttcagcagttacactggagctggatccgtcagctccgagggaaggactggagtggattgcctatatctctacagtggancagacaactaccaacccctccctacaacgagtcgagtcgaacatattagtagacacgtacaaagaacctagtttccctagacggtcgtgtaggttctgtacgaccgtcgtacggccggacgaccgggtcccttttaagtaccgtggtacgccggtacggacgggtcccctagtccggagttcgacttacgtcgtactacccgtacgttcccctttggacccgttccggtcggggacccctaacgggggtaacccccttcgggttaccccacccggttcccttacccgtaccgaccgtccccgttacccgaaaccccggg

SEQ ID NO: 195842 - DNA, 593 bp, Homo sapiens
  misc_feature: GYAE6OF01DL0YT.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaacgcccctaaggtcctgatatatgagacttctactttagaagtgggtcccatcaaggttcagcggcagtggatcgtgggacagatcactctcactatcaccacgctgaccaacctgatgtattttagctaactttattactcgaccaactagtaatacaattccaattcctaatttagtttaagttttaccgggttagggtaacggggtaaccgtaaagggggttgggtaaacggggttaacctaaaaacgggtaacgttacggtacgggtacctacgggtacccaacccggtaattcccgttggttccctttaccg

SEQ ID NO: 195843 - DNA, 562 bp, Homo sapiens
  misc_feature: GYAE6OF01B4RHF.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagatcaccatcacttgccggcagtcagaatattataggtggtgcctggtatcagcagaaaccagggaaacgccccgtaaggtcctagatatatgagtacttctactttagaaagttcgggtcccagtcgaaggttcagcgcagtgatcgtaggacagtattcactctacactactcaccagcctagctaaccctgacttagtattttacgacttaactttattacctacgacctaactagttaactctaactactatactatttacgttaagtttcgggtaaggtacgggtaaccgtagggttagggaacggtacgtaaacgtacgtcggtgtacgcgtacacgtatcttgtccttacg

SEQ ID NO: 195844 - DNA, 496 bp, Homo sapiens
  misc_feature: GYAE6OF01D8GZ1.16.68.G02.1.454.CMB.1.raw
  modified_base (449)..(449): a, c, t, g, unknown or other
  misc_feature (449)..(449): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatcgtgggacagaattcactctcactatcaccagcctgcaacctgatgattttgactaacttattactgaccaacagtatcatcatcattgtaatttcggnggaggaccgaaggtggaggtacaaagatgtggctgcacatctgtctc

SEQ ID NO: 195845 - DNA, 504 bp, Homo sapiens
  misc_feature: GYAE6OF01EAXB3.16.68.G02.1.454.CMB.1.raw
  modified_base (416)..(416): a, c, t, g, unknown or other
  misc_feature (416)..(416): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatataatagtggtgctggtatcaacagaaacaggaaagcccctaaggtcctgatatatgagacttctactttagaaagtgggtacccatcaaggttcagcggcagtggatcgtgggacagaattcactctcactatcaccagcctgacaacctgatgtatttgactaactttattactgaccaanagtatcatcatctatttgtaatttcggtggaggtacaagggtggaggtacgaaacgtaatggtgctgacaccgtatcttcgtctctac

SEQ ID NO: 195846 - DNA, 532 bp, Homo sapiens
  misc_feature: GYAE6OF01EXXZ9.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatattaataggtggttggcctggtatcagcagaaaccagggaaagcccctaaggtcctgatatatgagacttctactttagaagtgggtccatcaaggttcagcgcagtgatcgtgggacagtaactcactctcactatccaccacgcctgcaacctgattgtattttgactaactttattactgacctaacagtactcaatcattctattagttaatttcgggagaacgggtaccgtaagggtggtaaggtacgtaaaacggtagtcggtaggctcggacacctattccttgtccttacg

SEQ ID NO: 195847 - DNA, 644 bp, Homo sapiens
  misc_feature: GYAE6OF01DWGZI.16.68.G02.1.454.CMB.1.raw
  modified_base (261)..(261): a, c, t, g, unknown or other
  misc_feature (261)..(261): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttcgccgggccagtcaagaatataagtaggtggtgctggtatcancagaaccaggaaacgcccctaaggtcctgatatatgagtacttctactttagaaaggtcgggtaccatacaaggttcagcggcgagtggactgtagggacagtaattcacttctacacttactccaccacgtcctgactaacctgagttcgtagtttttcgaacttaacttttaactttacgtacgtaacctaaccgtagttaacttactaacttactaactttacttaacgttttacggtttaacgttttacgggggttagggtaaaccggggtaaccggtaagggggttaagggtaacgggttaaaccgtaaaaacggttacggttaacgggtacggtcgttaccggacctaacccgttattccgttcgttcgtttacccg

SEQ ID NO: 195848 - DNA, 605 bp, Homo sapiens
  misc_feature: GYAE6OF01CI89Z.16.68.G02.1.454.CMB.1.raw
  modified_base (202)..(202): a, c, t, g, unknown or other
  misc_feature (202)..(202): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccgaggtgccagatgtgacatccagatgacccagtcctccttccaccctgtctgcatctgtagganacagagtcaccatcacttcggccggcagtcagaattataagtaggtggtgccgtggtatcagcaacgaaacgaagggaacgaccccgtaaggtcctagaatactagtgaacgttactttacttaacgtttaaggaaggtcgggtacctagtacgtaaggttcgagcggacgtaggtggtactcggagggaactagtacttcactcctacactactaccaaccncgcctanaactacctgtattagtattttcgacttaactttactacgtacgaacctaagtacgttatacctatacattactagtttagttacgtttgggtacggaacgggtacgtaagggttagaacggtacgaaaacggtattcgggacgtcttacgcgtaactattcttcgtttcctac

SEQ ID NO: 195849 - DNA, 733 bp, Homo sapiens
  misc_feature: GYAE6OF01BJCR6.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtcctccttccacctgtctgcatctgtaggagacagagtccacctatcacgttcggcccggccagtcaagtaatagttaagtaggtggtcgctggtatcgagacaacgaaacgagggaacctacccgtaaggtcctagattagtatagtacgtactttacttaacgttaagaacggttcgggtacctagtacgtaacggtcgacggcggacgtaggtaggactacggtaggtaactaacgtacttctactactactactactacccaccgtacgtaccgtactaacctaacgtgtaacgttagtttactttacgaactttaacgtttataaccgtactaacccgttaaactacgtttaactaccgttaacttacgttaacgtttaaccgtttaagggtttttacggttaacgggttttacggggaaacggggttaaaccgggtaaacgggtaaaggggttaaccgggtaaaacggttaaaccgtaaaacgggttcggtttacgggtaccggttaccaccgttacccgttaccgttacgtttcccgttaccgttccctttaacccg

SEQ ID NO: 195850 - DNA, 502 bp, Homo sapiens
  misc_feature: GYAE6OF01CBNGM.16.68.G02.1.454.CMB.1.raw
  modified_base (427)..(427): a, c, t, g, unknown or other
  misc_feature (427)..(427): n is a, c, g, or t
  modified_base (482)..(482): a, c, t, g, unknown or other
  misc_feature (482)..(482): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccaggggaaagccccctaaggtcctgatatatgagacttctactttagaaagtggggtcccatcaaggttcagcggcagtggatcgtgggacagaattcactctcactatcaccagcctgccaacctgatgtattttgactaacttattactgaccaanagtatcattcatcattgtaattcggtgagggacaggtggaggtacaaagacgtgnggctgcacctatctgtcttc

SEQ ID NO: 195851 - DNA, 592 bp, Homo sapiens
  misc_feature: GYAE6OF01BTSOP.16.68.G02.1.454.CMB.1.raw
  modified_base (262)..(262): a, c, t, g, unknown or other
  misc_feature (262)..(262): n is a, c, g, or t
  modified_base (390)..(390): a, c, t, g, unknown or other
  misc_feature (390)..(390): n is a, c, g, or t
  modified_base (592)..(592): a, c, t, g, unknown or other
  misc_feature (592)..(592): n is a, c, g, or t
tcagtgtactactccacgaccggtgctcgatttagtcgatagtgaagggaaagggtctccgaagccttcggagaccctgtccctcacctgcactgtctctggtggctccttcagcagttactactggagctggatccgtcagctcccagggaagggactggagtggattgcctatatctcttacagtgggagcagcaactacaacccctcctcaagagtcgagtcgacatattagtagacacgtccaagaccagttttcccngagctgagtctgtgacgctgcggacacggtcctttatactgtgcgcgacggcccctatcgagtgactatcgactcccgaggtccctttgactccgtggggccacgggaaccctggtccaccgtctccncacgcctccaccgaacggcccacgtccggtccttcccccgtggcccgccctcgcctccgacggcgccaccgtccgagacgcacgacggccggacccgtgggcctcggccgttacgggtaccaacgggtaccttacgttacgaggtaacgttacgtactacgtaggacggccgggcgtacgggccgaacgggcgacgtatggn

SEQ ID NO: 195852 - DNA, 562 bp, Homo sapiens
  misc_feature: GYAE6OF01CSBP9.16.68.G02.1.454.CMB.1.raw
  modified_base (300)..(300): a, c, t, g, unknown or other
  misc_feature (300)..(300): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagatataataggtgtgctgtatcagcagaaaccagggaaacgcccctaaggtcctgatatatgagacttntactttagaaagtgggtccatcaagttcagcgcagtggatcgtggacagattcactctcactatcaccagcctgcaacctgatgtattttgactaactttattactgtacccaatagtactcaactctaatctaagtttgttaacgtttcgggtagggaacgggtaccgtaaaggggttcgggaacggttaaccgaaaaggtaaccgttggtaccgggtacgttacggacctaaccgtagtttcccttggttccctttaccg

SEQ ID NO: 195853 - DNA, 592 bp, Homo sapiens
  misc_feature: GYAE6OF01A3QON.16.68.G02.1.454.CMB.1.raw
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccacctgtctgcatctgtaggagacagagtcaccatcacttgccggcagtcagaatattaataggtgttggcctggtatcagcagaaaccagggaaagcccctaaaggtcctagatatatgagacttctactttagaaagtgggtacccatcaaggttcagcggcagtggatcgtgggacagaattcactctcactatcaccagcctgacaacctnatgtatttgacttaacttattactcgtaccaanacgttaatctaatacctaagttccttaagtttagttaacgtttcggggtacggtaaggggtaaccgtaaaggggttagggaacgggttaaccgaaaaccggttaacgttacgggtacgggtacttacgggacctaacccgtaagttccgttggttaccctttacccg

SEQ ID NO: 195854 - DNA, 634 bp, Homo sapiens
  misc_feature: GYAE6OF01CEH1D.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggctggtatcagcagaaaccgagggaaagcccctaaggtaccctaggaactataatgaacgtacttacttactttaaggtaaagtcggggtaccagtacaaggttcagcgcagtgatcgtggacagtaatcacgtctacgatactcaacacgcctacgactaacgtgaatagtatttgacttaacttattactgaccaacgtagttaactacacttacctaatttactaacgttttaggtttaaacgtttacgggacgggttaaacggggtaacccgtaaaggggttacggggaaagggtttaaccgaaaaacgggttaaccggttaggttaccgggcgtttaacggacctaaccgtaggtttactacgggtttcctttaaccgg

SEQ ID NO: 195855 - DNA, 560 bp, Homo sapiens
  misc_feature: GYAE6OF01DM8GG.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagatataataggtggtgcctggtatcagcagaaaccgaggaaacgccccgtaaggtcctagatatatgagtactttactactttagaaaggtcgggtacccagtacgaaggttcagcggactagtgatcgtagggacagattcactctcactatcaccagcctgacaacctgactgtatttgactaactttattactcgaccaactagtactactattactattactatttacgttaagtttcgggtagggtaacggtacggtaaggggtaggaacggtacgaaaacgtacgttggtacgggtctacggaccactattcgtgttccttacg

SEQ ID NO: 195856 - DNA, 504 bp, Homo sapiens
  misc_feature: GYAE6OF01E3WCI.16.68.G02.1.454.CMB.1.raw
  modified_base (423)..(423): a, c, t, g, unknown or other
  misc_feature (423)..(423): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagccccctaaggtcctgatatatgagacttctactttagaaagtgggtccatcaaggttcagcggcagtgatcgtgggacagaattcactctcactatcaccagcctgcaacctgatgtattttgactaacttattactgaccaacngtatcatcatctattgtaatttcgggtaggagggtaccaagggtggaaggtcaaagtactggtgctcgcacatctgtcttc

SEQ ID NO: 195857 - DNA, 558 bp, Homo sapiens
  misc_feature: GYAE6OF01BHKHU.16.68.G02.1.454.CMB.1.raw
  modified_base (393)..(393): a, c, t, g, unknown or other
  misc_feature (393)..(393): n is a, c, g, or t
  modified_base (433)..(433): a, c, t, g, unknown or other
  misc_feature (433)..(433): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatataagtaggtgtgctggtatcagcaagaaaccgagggaaacgccccgtaaggtcctagaactatatgatactttactaactttaaggaaagtcgggtacccatcgaaggttcaagcggacagtggatcgtaggacagaattcactctacactatccacncgcctgacaacctgtatgtatttcgactaacttatacgtnacctatacgtatcctatacattctaagtttcgtaagttcggtaagggaacggtaccgtaaggggtagtaacggtacgaaaacggtcgtaggtcggtactacgaccactagttctgttccttaccg

SEQ ID NO: 195858 - DNA, 558 bp, Homo sapiens
  misc_feature: GYAE6OF01C6FD3.16.68.G02.1.454.CMB.1.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (544)..(544): a, c, t, g, unknown or other
  misc_feature (544)..(544): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgaggagacagagtcaccatcacttgccgggcagtcagaatattaataggtgttgctggtatcngcagaaacagggaacnccctaaggtcctagaatatatgagtacttctaactttagaaagtcgggtaccatcaaggttcaaggcggcaagtggatcgtagggacagtaacttccacctcactatcaccagcctgacaaccgtgaatgtactttgactaatttactactgacctaacagttactactatactattactagtttagttaagtttcggtagggaacgggtaaccgtaagggtcggaacgggtacgaaaacggtattaggtacggctacgctaaaccgtcttntcgtccttctaccg

SEQ ID NO: 195859 - DNA, 723 bp, Homo sapiens
  misc_feature: GYAE6OF01BGR47.16.68.G02.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcacntcacgttgccggcagtcagaatattaagtaggtggttggctggtatcagacagaaaccgagggaaacgcccctaaggtcctagaactatagtgaacgtactttactaacgtttaagaaaggttcggggttaccctaagtaccgtaaaggtttcaaggcggtacgtaggtacggtacgtcggtagggaactaagtaaacgtttccaacttcctactaacttaactacccgaaccgacgtccccgtagtaccctaaacccgttgtaacgttaggttaactttttacgacctttaaacttttacgtttaccgtacgtaaccctaaacgttaagttaacttacgtaacttactaacttacgttaagttttacggtttaaacggttttcgggtaacggggtaaggggtaacccgtaaaggggttacgggtaaacgggtaaccgtaaaacggttaacggttacgggtacggtaccgtaacggtaccctaaacgttattaccgttcggttcttaacccg

SEQ ID NO: 195860 - DNA, 553 bp, Homo sapiens
  misc_feature: GYAE6OF01AZGZD.16.68.G02.1.454.CMB.1.raw
  modified_base (387)..(387): a, c, t, g, unknown or other
  misc_feature (387)..(387): n is a, c, g, or t
  modified_base (439)..(439): a, c, t, g, unknown or other
  misc_feature (439)..(439): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccgagggaacgcccctaaggtcctagatatatgtagtactttctaacgtttagaaaggttcggggtaccctagtctaaggttcaggcggcaggtggatcgtgggactagaattcactcncactatccaccacgcctagaccaacctgatgtatttcgactaactttatacncgtaccaatgtactcatcattactatttagttaattcgggtaggtagggacctaaggggtggtacggtactaaaggacgttggacggctagacctacctagtctcgttcttacc

SEQ ID NO: 195861 - DNA, 883 bp, Homo sapiens
  misc_feature: GYAE6OF01A266E.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactgggtgaacgcccgttcggacgaccctcggtcccctcacctgccactgtctcgtggtcgccttccttcagctagttactacgtggagtcgtggacttccgtcgacgccgtaccggaaggggaacgggacgtgggacggtggacttcggacctatacttccgttacgttaacggaggttacggggactcgaacggacctaaaacccgtaacccctaaccccccgttaccctaacgtaaacggtaccggtaccgtaacgtaccggaaccttaagttaacgtttaacggtaaccgtaacgtaaccgtaaccgaaacggttaaacccgtttaccgttttaccccgtaaggtaccgggtccgttagggtaacgggtttcgttacgggtacggtacccgtacggtaccgggtacccggtacccggtaacccgggtttacccttttaacggtttaccggtcggttacgggtacccgggaccggggtaacccgggtcccccgttaacggtaccgggtacggttaccggtaaccgtttacgaccggttacccgtccccggttaaccgggtttcccgttaccgggtaacccggttcccgggttaaccgggggtcccctaaacgggggttacccccgttccgggttaccccgtaacccgtttcccgtacccggtacccaccggttacccccgtaccccggaaaccccgg

SEQ ID NO: 195862 - DNA, 751 bp, Homo sapiens
  misc_feature: GYAE6OF01BDDSX.16.68.G02.1.454.CMB.1.raw
  modified_base (202)..(202): a, c, t, g, unknown or other
  misc_feature (202)..(202): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatcgacccagtcctccttcccacctgtctgcatctgtagganacagagtcaccatcacgttcgcccgggccagtcaagtaataattaagtaggtggtcggctggtatcagacaagaaacgaggaacgacccgtaaggtcctagactatagtgaagtacttactaacttagaagttcgggtccaagtacgtaaggttcgaggcggtacgagtggtatcgtaggaagacgtaatcactactacgtaactactacaacccgtagtaccgtacaacctaaccgtagtacgttacgttaacgttttacgaacgttaaccttttaacgttaacccgttacgtaacccgttaaacgttaacgttaacttacctaactttacctaagtttaacccgtttaattttaaacggttttaacggttttacggggtaacggggtttaaccggggtaaaccgggttaaacgggttaaacggggtaaccggggttaaaccggtaaaacccggttaaacgggtaaccgggtttacgggtaaccggttaaaccgggttacccgaaaccttacccggtttacgttaccgggttttacctttaaccccgg

SEQ ID NO: 195863 - DNA, 537 bp, Homo sapiens
  misc_feature: GYAE6OF01COHSJ.16.68.G02.1.454.CMB.1.raw
  modified_base (167)..(167): a, c, t, g, unknown or other
  misc_feature (167)..(167): n is a, c, g, or t
  modified_base (269)..(269): a, c, t, g, unknown or other
  misc_feature (269)..(269): n is a, c, g, or t
  modified_base (393)..(393): a, c, t, g, unknown or other
  misc_feature (393)..(393): n is a, c, g, or t
  modified_base (456)..(456): a, c, t, g, unknown or other
  misc_feature (456)..(456): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccngtctctccacctgtctgcatctggtaggagacagagtcaccatcactggccggcagtcaagatattaagtaggtggtgcctggtatcagcagaacaggaacncccctaagtcctagaatatatagacgtactttctacgtttaagaaacggttcgggtaccctatacgtaaaggttcgaggcggactaggtggatcgtagggaacagtacttcgactctacatacnctaccagtcctgaccaactgtatgtatttgactacttatactagcaatgtaactcaatcattnatttagttaacgttgggtagaggtacgaacgggtggtaacggtacaacgagtcggtgtcgtagacactatctgttcgttac

SEQ ID NO: 195864 - DNA, 555 bp, Homo sapiens
  misc_feature: GYAE6OF01AWS78.16.68.G02.1.454.CMB.1.raw
  modified_base (105)..(105): a, c, t, g, unknown or other
  misc_feature (105)..(105): n is a, c, g, or t
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagtgtactactccacgaccggtgctcgatttagtcgatagtgaagggaaagggggcaggagtcagacccagtcaggacacagcatggacatgagggtccccgntcagctcctggggctcctgctgctctggctcccaggtgccagatgtgacatccagatgacccagtctccttccaccctgtctgccatctgtagganacagagtcaccatcattgccggcagtcagatattaanaggtgtgctgatnagcagaacaggaaanccctaaggtcctagactanatgagactntacttagaaagtgggtcccatcaaggttcagcgcagtgatcgtggacagagtcactcnctactatcacagcctgacaacctnactgtatttcgactaacttattacacgtacccaataagtataccagttaccaattacgtaatttaggttaacctttaggggtacggaacggggttaaccgtaaagggtgggtaaacggtaccgaaaacggtaaccgtggtacggacgttacggactaacctacttactcgttcgttacc

SEQ ID NO: 195865 - DNA, 696 bp, Homo sapiens
  misc_feature: GYAE6OF01CIHC8.16.68.G02.1.454.CMB.1.raw
  modified_base (104)..(104): a, c, t, g, unknown or other
  misc_feature (104)..(104): n is a, c, g, or t
  modified_base (300)..(300): a, c, t, g, unknown or other
  misc_feature (300)..(300): n is a, c, g, or t
tcagtgtactactccacgaccggtgctcgatttagtcgatagtgaagggaaagggggcaggagtcagacccagtcaggacacagcatggacatgagggtccccnctcagctcctggggctcctgctgctctggctcccaggtgccagatgtgacatccagatcgacccagtctccttccaccctgtctgctatctgtaggacactagacgtccaacctatcacgttcggcccgggcagtcaagaattaattaagtaggttggttggtcctggtatcagacaagaaaaccgaggggaaacnccccgtaaggtcctagtactatagtagaacgtactttacttaacgtttaaggtaaaagggttcggggtaccctaagttacgtaaaggttcgaacggtccgggactagggtaggtactcggtacggggaactaaggtaacttcgtacttcctacctactactaccaacccgtacgccgtacgacctaacccgtgtaacgttacgttattttacgaacttaactttacttactacgaacctaagtattactcctaattccgtaattcgttaagttttacggttaacgtttcgggtaacgggtaaacgggtaaccggtaaaggggtcgggttaaacggtaacgtaaacggtacgttggtacgggctacgacctaccgtatttcgtacgtttctaacccg

SEQ ID NO: 195866 - DNA, 601 bp, Homo sapiens
  misc_feature: GYAE6OF01DH73R.16.68.G02.1.454.CMB.1.raw
  modified_base (309)..(309): a, c, t, g, unknown or other
  misc_feature (309)..(309): n is a, c, g, or t
  modified_base (402)..(402): a, c, t, g, unknown or other
  misc_feature (402)..(402): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcaagaaaccagggaaacgcccctaaggtcctagatatatgagactttntactttagaaaggtgggtacccatcgaaggttcagcggcagtggatcgtggacagattcactctcactatacaccacgcctcgactaaccgtnaattgtattttcgacttaaactttacttactacgtaccaactagtactacattctaattctatttaggttaattttccggggtagggtaacggggtaaccgtaaggggttcgggtaacgggttaacgaaaaccggttaacggttggttacgggtaccgttacggacctaacccgtagtttaccgtgtttccctttaccg

SEQ ID NO: 195867 - DNA, 644 bp, Homo sapiens
  misc_feature: GYAE6OF01AP68K.16.68.G02.1.454.CMB.1.raw
  modified_base (273)..(273): a, c, t, g, unknown or other
  misc_feature (273)..(273): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagatattaatagtggtgctggtatcagcagaaaccagggaaacnccccgtaaggtcctagatatatgagtacttctacttagaagtgggtaccagtcaagtcagcgcagtggatcgtagggacagaacttcactctacactactccaccacgcctagaccaactgattcgtatttcgacttaactttacttaacctcgaacctaacgtacgttactacctaattcctaacgttaccttaaagtttaggttaaacgttttaccggggtaaggtaaccgggggtaaacccgtaaaggggttacggtaaacggggttaaacccgtaaaacgggttaaccggtttacgggtacgggttaaccctacgggtaaccctaacccgttaaagtttcccgttaccggtttacccgtttaacccg

SEQ ID NO: 195868 - DNA, 556 bp, Homo sapiens
  misc_feature: GYAE6OF01DZ5I5.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctggtaggagacagagtcaccatcacttgccgggcagtcagaatataataggtgtggctggtatcagcagaaaccagggaaacgcccctaaggtcctagatatatgagacttctactttagaaagtgggtccatcaaggtcagcggcagtggatcgtgggacagattcactctacactatcaccagcctgacaactgatgtatttgactaacttatactgaccaatagtatacatcaattctatttgttaagtttcgggaggtaacgggtaaccgaagggttgggaaggtaaccgtaaaaacggaccgttagggtacgggtccttacggtacgaacccttagtttaccgtgtttcgtttaacccg

SEQ ID NO: 195869 - DNA, 542 bp, Homo sapiens
  misc_feature: GYAE6OF01EEPOW.16.68.G02.1.454.CMB.1.raw
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
  modified_base (468)..(468): a, c, t, g, unknown or other
  misc_feature (468)..(468): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaaggactggagtggattgctatatctcttacngtggancagcaactacaacccctcctcaagacgtcgagtcgaacatattaagtacgacacgtacaaagaacctagttttcccngagtctgagtctgtgaccgctgcggacacggtccctttatactgtgcgcgacggccctagcgagtgaactagngactcccgagtcccttagacctcgtcgggaccacgggaccctggtccaccgtctcctacgcgccctccgaaccg

SEQ ID NO: 195870 - DNA, 750 bp, Homo sapiens
  misc_feature: GYAE6OF01DN8EC.16.68.G02.1.454.CMB.1.raw
  modified_base (204)..(204): a, c, t, g, unknown or other
  misc_feature (204)..(204): n is a, c, g, or t
  modified_base (717)..(717): a, c, t, g, unknown or other
  misc_feature (717)..(717): n is a, c, g, or t
  modified_base (730)..(730): a, c, t, g, unknown or other
  misc_feature (730)..(730): n is a, c, g, or t
tcagtgtactactccacgaccggtgctcgatttagtcgatagtgaagggaaagggggcaggagtcagacccagtcaggacacagcatggacatgagggtccccgctcagctccgtggggctcctgctgctctggctcccaggtcgccagatgtgacatccagatcgacccagtcctcccttccacctgtctgcatctgtagganactagacgtcaccatcacgttcggccggcagtacaagtaattaagttaagtagggtcggttaggccgttaggttatacgagacgaaacggaaaaccgaacggggaaacctaccccggttaaaggtcctaggaattaagtatacgtagtaccttttacgttaaacgttttaagggaaacggttcgggtaccctaagtaccgtaaggttcgaggtcgacgagtggactcggtaagggactaggtaacttcacgttacctactacgttacaccgtaacccgacgtacctacgaaccgtaaccgtagtaacgtttagtttaacgtttacgaaacctttaaacgtttaccgttaacgtaccgtaaaccgttaaatacgttaactaaccttaactaccttacgttaacttaagtttacggtttaacggtttcggggaacgggtacggtaaaccgggtaagggtttacggaacgggttaaaccgaaaacggttggtcggtacggtacctacggtaacccngttaaacccgttntttcccgttacgtttacccg

SEQ ID NO: 195871 - DNA, 675 bp, Homo sapiens
  misc_feature: GYAE6OF01ANT8Z.16.68.G02.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggcctcccaggtgccagatgtgacatccagatcgacccagtcctccttccacccttgtctgcatctggtagganacagacgtccaccntcacgtcggcccggcagtcagtaattattaagtacggttggttacggccttaggtactcgaggacaaacggtaaaccgagggtaaaccgaccccgtaacggtcctaggtaatacgtacgtaggaacgttacctttacttaacgtttaaggaaacgggtcgggtaccctaagttacgtaaggttcgacggtcggtacgtaggtaggtactcgggtaagggactaaggtaacttaccgactccgtactaacgttacaccaccgtaccgtcctacgaacctaacgtagtagttacttatttacgacctttaacttacttacacgaactaactagttaactctactactactacgttagtttacgttaaggttcgggtaaggacggtagtacgggtaggtacgtaacgtaaccggtaggtgtacggactactacggtacctagtttcgtgttccttaccg

SEQ ID NO: 195872 - DNA, 654 bp, Homo sapiens
  misc_feature: GYAE6OF01CJ2HD.16.68.G02.1.454.CMB.1.raw
  modified_base (508)..(508): a, c, t, g, unknown or other
  misc_feature (508)..(508): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccagtctccttccaccctgtctgcatctgtaggagacagagtccaccatcacgtgcccggcagtcagatataagtggtggtgcctggtatacagacaagaaaccgaggaacgtaccccgtaaggtcctagactagtagtgagtactttacttactttaaggaacggttcgggtaccctagtacgaaggttcaggcggactaggtgatcgaggactaagtacttaccacgttcctactactactccacctacggtccctagaccctaaccgtgaattacgttattttccgactttaacgtttacttaccgtacgtacctaacgtagttaactcaattccaacttnttaagtttacgtttaagtttcggggaaggtaaacgggttaccgtaaaggggttacgggtaacggttaaacccgtaaaggtaaccggtttaggtacgggtaccttaccggtactaacccgtagtttcccgttgtttacctttacccg

SEQ ID NO: 195873 - DNA, 721 bp, Homo sapiens
  misc_feature: GYAE6OF01E0JLQ.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctgctcccaggtgccagatgtgacatccagatgacccagtctccttccaccctgtctgcatctgtaggagacagagtcaccatcacttcgccgggcagtcagaattattaagtaggtggttgcctggtatcgagcaagaaaccagggaacgccccgtaaggtcctagaacttagtactagacgtactttacgtaactttaggaaaggttcgggtacctagtacgtaacggtttccacggtaccggacgtaggttaggtacttcggtacgggaactaaggtaaactttcccgtaacttccttactaacgttactaccaacccgtagtcccgtacgaacctaaccgttagtacttagtttaacgttttacgaacctttaaacggttttacttaccgtacgtaccctaaacgtagttactaacgtacttactaacttacgttagtttaaggttaacgttttaggggacgggtaacgggttaacccgtaaagggttagggtaaaccggttaaccgggaaaaaccgttaaggttcgggtacggtaccttacccggtaacgttaaccgaagttttcccgttacgtttccttaacccgg

SEQ ID NO: 195874 - DNA, 627 bp, Homo sapiens
  misc_feature: GYAE6OF01CNLSX.16.68.G02.1.454.CMB.1.raw
  modified_base (329)..(329): a, c, t, g, unknown or other
  misc_feature (329)..(329): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtgctcttcagctagttacacgtggagctggactccgtcagcctcccgaggggaaggactgggacgtggattcgcctatactctcttacgaggtgggancagaccaactaccaacccctcctacgaagacgtcgagtcgaactattaagttagtaagactacgtaccaaagtacccttacgttttcccaggacggtctggaggttcgtggtcgaccgtcgtacggccggactaccgggttcccttttagtacgtgtcgccgcggacggtacccctagtccgagtacgacttctcgactcccgtggtcccttgaccgttccggtcgggtacccgaacgggtacccttcgggtaccctaccggtaccttcccgtacacccgtccgtacccgtaacccgg

SEQ ID NO: 195875 - DNA, 586 bp, Homo sapiens
  misc_feature: GYAE6OF01CQLN1.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctccccaggtgccagatgtgacatccagatgacccagtctccttccaccctgtctgcatctgtaggagacagagtcaccatcacttgcccgggccagtcagaattattaagtaggtggttgcctggtatcagcaagaaaccagggaacgcccctaaggtcctgatatatgagtactttactacgtttaagaaaggtcggggtacccatacgtaaggttccaggcggactaggtggactcgtagggactagtattcactctcactatccaccacgcctgacctaactgatgttatttcgactaactttactactacgtacccaatagttatcaacttactacttacttagtttagttaacgttttcgggaagggtacggtaaccgtaggggtaggaacggtaccgaaaggtacgtggtacggtacgtacgtactaacctatcttcgtccttacc

SEQ ID NO: 195876 - DNA, 607 bp, Homo sapiens
  misc_feature: GYAE6OF01A2I0Z.16.68.G02.1.454.CMB.1.raw
  modified_base (569)..(569): a, c, t, g, unknown or other
  misc_feature (569)..(569): n is a, c, g, or t
tcagtgtactactccacgaccggtgctcgatttagtcgatagtgaagggaaagggggcaggagtaagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagatatataggtggtgctgtatcagcaagaaaccagggaaacgccccgtaaggtccctagaatatatgagtactttcttaactttaagaaacgttcgggtacctatcgtaaggtcagcgcgagtgatcgtgggacagtacttcactctacactataccactagcctagcctaacctgtattcgtattttacgacttaaactttacttacctacgaaccctaatagttaactctaacttacacttacttaatttagttaaacgttttcgggagggtaacgggaaaccggtaaggggttacgggtaaggtaaccgtaaaacggtacgttagggtcggtaccncggtacctaacctacgttacttcgttcttccgttaccg

SEQ ID NO: 195877 - DNA, 485 bp, Homo sapiens
  misc_feature: GYAE6OF01AUJKN.16.68.G02.1.454.CMB.1.raw
  modified_base (357)..(357): a, c, t, g, unknown or other
  misc_feature (357)..(357): n is a, c, g, or t
  modified_base (468)..(485): a, c, t, g, unknown or other
  misc_feature (468)..(485): n is a, c, g, or t
tcagtgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagttttccctgaggctgaggtctgtgaccgctgcggacacggtccctttattactgtgcgcgacgggcccctatcgagtgactatgatcccaggtccctttgactccgtggggccagggaccctggtccaccgtctcctcacgccctccaccgaacgggccccagtccggtcccttcccccgtggccgccctgcctccgaggcnccacctcgagacgcacacggccggccctggggcctcggcccgtggtaccaaggaccttaccgttccgagtacgtacacgtggacggcgggcgtggacgaaggcacaagtgnnnnnnnnnnnnnnnnnn

SEQ ID NO: 195878 - DNA, 760 bp, Homo sapiens
  misc_feature: GYAE6OF01BXL2K.16.68.G02.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (601)..(601): a, c, t, g, unknown or other
  misc_feature (601)..(601): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttcccaccctgtctgcatctgtaggagacagagtcaccancttttttttttacncggccggccagtacagtaatattaagtagggttggttggccgttgggttactcgagacaagaaaacccgaaggggaaaccgacccccgttaaacggttcccgtagtaattaattactaggtaacggtaccttttaccgttaacgttttaaggaaaagggttcgggggttaccccaagttaccgtaaacgggtttcagggaccggtactaagggtgggattcggtaggggtaacctaggtaaactttaccaacgttccttaacctaaccgttaactccccaacccgtaacgtcccttacggaccctaaacccgttagactttagttactttttacgaaccctttaaactttacgtttacctacgaacccgtaanaacgtttatcccttaatacctaacgttattaacgttttaggttaacgttttcgggaggggtaacggggtaacctaaggggtacgggttaacggtaaccctaaaagggtacggttggtacgggccttagggaccctacgtacttcttccggtctttaccg

SEQ ID NO: 195879 - DNA, 637 bp, Homo sapiens
  misc_feature: GYAE6OF01CB0CZ.16.68.G02.1.454.CMB.1.raw
  modified_base (521)..(521): a, c, t, g, unknown or other
  misc_feature (521)..(521): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgcccgggccagtcagaattattaataggtggttggcctggtatcagcaagaaaccagggaacgcccctaaggtcctagatatatgagtactttactaacgtttagaaaggttcggggtacccagtaccgtaagggttcacggccggcgaggtacggattcggtagggactaaggtaactttacgacttacctacgtaccttactacccgaacctacgtcccgttcgaaccctaaccctggtaattagttacttttcgacgttaaacttttaacgttactacggtaaccctaactagttaactntactcagttactagtttacgttaagtttacgggtcgggaagggtacgtaaggggtcggtaacggtacgaaaccgtacggtgtacggtactcgactacctattcctgttccgttacc

SEQ ID NO: 195880 - DNA, 722 bp, Homo sapiens
  misc_feature: GYAE6OF01D5ZEA.16.68.G02.1.454.CMB.1.raw
  modified_base (105)..(105): a, c, t, g, unknown or other
  misc_feature (105)..(105): n is a, c, g, or t
  modified_base (206)..(206): a, c, t, g, unknown or other
  misc_feature (206)..(206): n is a, c, g, or t
  modified_base (318)..(318): a, c, t, g, unknown or other
  misc_feature (318)..(318): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagtgtactactccacgaccggtgctcgatttagtcgatagtgaagggaaagggggcaggagtcagacccagtcaggacacagcatggacatgagggtccccgntcagctcctggggctcctgctgctctggcctcccaggtgccagatgtgacatccagatgacccagttcctccttccacccttgtctgctatcgtgtagganacgagacgtccaaccatcctacgttcggccggcagtcaagtaattaagttaagtacggtggttcggaccgttaggtacgtcaaggaccaaacggaaaccgaacggggaaacnccccgttaaggtcctagtacgtatagtacgagtacttacttaagtttaaggaaagttcgggtaccctaagtacgtaaggttccacggtcggacgaggtgggaactcggtagggaactagtactccgtactctacgtaactactacacccgtacgccgtanaacctaccgtagtacgttnttacgttttacgaaccgtttaaactttacgttacgtaacctaacccgtaaattaccgtaattcctaacttctaaacgtttaccttaaggtttaccgtttaacgggtttacgggaggggtaaaccgggtaacggttaaaggggtaacgggttaacggtaaacgtaaagggtacggttaggtaccggtagtaccgtaactaccgttacttcggtttcgtcgttaccg

SEQ ID NO: 195881 - DNA, 574 bp, Homo sapiens
  misc_feature: GYAE6OF01BX0E5.16.68.G02.1.454.CMB.1.raw
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtgcagctccagatgggtcctgtcccaggagcaactgcaggagtcgggcccagggactggtgaagccttcgggagaccccttgtcccctanacctgccactgtctcgtggtgctccttcagcagttactacgtggancgtggatccggtnagctcccgaagggacggctggagtggattcggcctagtactctacgttacagtggancagcaactaccaacccgtcctacaagtcgtacgagtacgacattacgtagtagacacgtacaaggaacctagtttccngagctgagtcngtnaccgntagcggacncggtccctttagtactcggtagtccgagtcggccccttagtcgtaagtctaacgtatcgatcccgaaggtcccttagaccttacggtcgggcctaacgggccctggtcaccggttcncctnacgctcccaacgg

SEQ ID NO: 195882 - DNA, 677 bp, Homo sapiens
  misc_feature: GYAE6OF01D4NGI.16.68.G02.1.454.CMB.1.raw
  modified_base (474)..(474): a, c, t, g, unknown or other
  misc_feature (474)..(474): n is a, c, g, or t
  modified_base (557)..(557): a, c, t, g, unknown or other
  misc_feature (557)..(557): n is a, c, g, or t
tcagtgtactactccacgaccggtgctcgatttagtcgatagtgaagggaaagggggcaggagtcagacccagtcaggacacagcatggacatggacgggtcccccgctcagctccgtggggcctcctgctgcttcgtggctcccgaggtcgccagatgtgacatccagatcgaccctagtcctcccttccacccgtgtctgctattcgtaggtaggacgacgaggtactacacctatccgtacgtccggaccgggcaggtacaagtaaattagttaaggttacgggttgggttcgcgttagtatacgagaccgaacgaaacggaacggaaaccgtccccgttaaacgggtcctaggtaatacgttagacgtacgtactttacgttaagtttaaggaacggttcggtacctagtacgagtcgacggcgagtggagtacgtggtacggacaagtcttaccgatctactacgtacncgacctctactcgaactggtactagttacgttattacgtaaccttaatttacgtacaccgtaactacgtactactcgttaacncgttacttaacgttaggtttaagttacgggttacgggtagggtaaccggaggttaacgggaggtaaacgtactaaagggccgtggtcgtacgaccgttacacttgacttccgtgttaccc

SEQ ID NO: 195883 - DNA, 799 bp, Homo sapiens
  misc_feature: GYAE6OF01AV1SE.16.68.G02.1.454.CMB.1.raw
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacagtccagatcgacccagtcctccttccaccctgtctgcatctgtaggagacagacgtcacatcacttgccggcagtcagatattanggtgtgcctggtatcgagcaacgaacgaggaacncccctaaggtcctgatatatgacgtactttactaacgttttaaggaaaggttcgggtacccctagttaccgtaaagggtttccaaggtccggtcgtaagggttcggtaacgttaccggttagggggtaacctaaaggttaaaccgtttcctaaacccgtttccgtaaccgttaaccctttaaccgtacccaacccccgtaacggttaccccgttacggtaacccctaaaccgtttacggtaacgtttaacggttaacgtttttttacgtaacccgtttaaaccgttttaaacttttaaacccgtacggttaaaccccttaaaacgttaacgtttaactttaacccgttaagttacccttaaacgttacttaaagtttttacgtttaacggttttaaccgggtacggggtaacggggtaccgttaaagggggtaacggtaaccgggttaaaccgtaaacgggtaccgtttagggtccgggtaccgttaggtaccccaaccgttacgttcgttccgtttcccttacg

SEQ ID NO: 195884 - DNA, 814 bp, Homo sapiens
  misc_feature: GYAE6OF01A4PGE.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccagtctccttccacctgtctgcatctgtaggagacagagtcaccatcacgtcgccgggccagtacagtaatattaagtaggtggttacggtccgttggtaactcgaagtaccgaagaaaaccggaacgggaaaaccgtacccccgtaaacggtcctagtaacttatagtgaacgtactttaccgttaacgtttaacggaaacgggttcggggttaccctaagtaccggtaaacggtttcgaacggtaccgggtacgtacgggtacggtacgttacgggtacggggtaacctaacgggttaactttaccgaacctttacctaacctaaccgttaacctaccgtaacccgtacgtacccctaccggtaaccctaaacccggttagttaacttacggtttaaccgttttacgtaacccgtttaaacctttttaacgttaaccgtacccggtaaacccttaacgtaagtttacccttataaaccgttaccttaacgtttactttacgtttaacggtttaaccggttttacggggtacgggtaaacggggtaacggtaaacggggttacgggtaaacgtaacgtaaaaccgggttacggtacggtaccggtactaccgtaacccgtactaccgtttcgttccgttctttacccg

SEQ ID NO: 195885 - DNA, 705 bp, Homo sapiens
  misc_feature: GYAE6OF01B55O0.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctccgtggggctcctgctgctctggctcccaggtgccagatgtgacatccagatcgacccagtcctccttcccaccctgtctgctatcgtgtaggagacgagacgtacacactactacgttcggccgggaccaggtacaagtaattagttaagtagggttggttcggccgttggtatcgacgacgaacggaaaccgacggggaaaccgtaccccgtaaggtccgtagaactatacgtagacgttactttacttaacgttaagtaacggtccggtaccagtaccgtaggttcacggtacggacgtaggtaggtactcggtacggactaaggtaacttcgactctactactatccgaactagtccgtacgactacgtgtatcgttattcacgttacttacgtacgtacgtaaactacgtacttactactaacttacgtaactttacgttactttacgggttaagttacgggtacggggtaaacggtaccgggttaagggtaccgggtaaacgggttaaccgaaaacgggttcgttacgggtaccgggtcgtttaccacccgttaacctagtttaccccgtttgttccccgtttaaccg

SEQ ID NO: 195886 - DNA, 620 bp, Homo sapiens
  misc_feature: GYAE6OF01AIV5I.16.68.G02.1.454.CMB.1.raw
  modified_base (201)..(201): a, c, t, g, unknown or other
  misc_feature (201)..(201): n is a, c, g, or t
  modified_base (610)..(610): a, c, t, g, unknown or other
  misc_feature (610)..(610): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatcgacccagtctccttccacctgtctgctatctgtagganacagagtccaccatcacttggccggcagtcagtaatattaagtaggtggtcgcgtggtatcagacaagaacgaaggaacaccccgtaaggtcctagtatatagtagagtactttacgtacgtttaaggaaggttcgggtaccctagttacgtaacggttcgacggcgcgtaggtgagtcgtaggactaggtaactcactactactactactccgaccgactccgtacacgtaaccctagtatcgttaatttactacttaaccgttattaaccgtcgtaacctaagtacgttactctaattccgtaataccgttagtttagttacgttacgggtagggtaaccgggaacgtaggggtaggtacgtaacggtaaccgttaggtacggtgtaatcggtactacctatcgttnttcccgttac

SEQ ID NO: 195887 - DNA, 678 bp, Homo sapiens
  misc_feature: GYAE6OF01EH5NY.16.68.G02.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (670)..(670): a, c, t, g, unknown or other
  misc_feature (670)..(670): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacgttcggcccgggaccagtcaagtaatattaagtaggtggttgccgtggtatcgagacaagaaaccgagggaaacgccccgttaaaggtccnggaatatanggatacttctaactttaggaaaggtcgggtacnccctaaagtacgtagacggcgacgtacggtagtactacgggtacggaaggaactttaactaccgttaccgttactacctaactacttaccaaccgtactaccgtgaaccctaacgtaacgttcgagttttaacgttcgttaacttaactttaaaccttacgtaccgaaacctaacgtaagtttacaccgtaatacgtactatttacgttaagttttaacggttacgggtaagggtaacgggaacggttagggaacggtacggtaaacgaaacggtaacttcgggtcgacgtcgaaccggtaactacgtttacgtccgtttnttaacccg

SEQ ID NO: 195888 - DNA, 706 bp, Homo sapiens
  misc_feature: GYAE6OF01A1GH6.16.68.G02.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (500)..(500): a, c, t, g, unknown or other
  misc_feature (500)..(500): n is a, c, g, or t
  modified_base (675)..(675): a, c, t, g, unknown or other
  misc_feature (675)..(675): n is a, c, g, or t
tcagtgtactactccacgaccggtgctcgatttagtcgatagtgaagggaaaggggcaggagtcagacccagtcaggacacagcatggacatgagggtccccgctcagctcctggggctcctgctgctctggctcccaggtgccagatcgtgacagtccgacgagtcgacccaggtctccgtccaccgtgtccgtgccattcgtgtagganacgagacgtcaccngtacacgttgccggacaggtcagaatattaagtaggtgtcggctggtatcgagacaagaacgagggaaacgtcccctaaggtcctagtatactaagtcgtaacgtacttcgttaacgtttaggaaacggttcgggtaccctaagttaccgtaacggttacacgggtccggactagggttacggacgtttaccggtaacggtaacgtaacgtaactttcgaaccttccgtaacgtacctactaccgtaccgtacgtccttacggcctaaccggttntaacgtcttaagtttaccgaaccgtttaatttacgtacgttaccgaactaacctaaggttactacgtaacttacgtaattcttaagttccggttaagtttaccggggcgggtaaaggtaaccggtcggttaacgggtaacggtaaccgtaacgtaggttaccggtgtaccggtanacccgtataccgttacgttgtaaccccgttc

SEQ ID NO: 195889 - DNA, 777 bp, Homo sapiens
  misc_feature: GYAE6OF01DUIGD.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtccaccatccacgttcggcccggaccagtacaagtaattattaagttagggttggttcggccgttaggtactacgacgacgaaacggaaaccgaagggtaaaccgtacccccgtaagggtacctaggtaattaacgttacgtaggtaacttaccgttttacgttaacgttttaaaggtaaacgggttccggggttaccctaagttacgtaaacggttccgacggccggtacgtaggttacggtacgttacggtacgggtaacgtaacggtacttaccgacttccctaaccgtaactttacgtacccaacccgtacgtacccttacgtacccttaacgttgtaacgtttacgttactttacgtaacttaaccgtttaacttaccgaccgttaacctaacgtgttaactacgtactactacttatttaacgtttacgtttaaggttacgggtacgggtaaccgggtaacggttaaggggtaacggtaaaccggtaaaccgtaaacggtacggttaggtaccggtatacccggtaaccttaccggttagtttcccgtcgtttcccgttaaccc

SEQ ID NO: 195890 - DNA, 754 bp, Homo sapiens
  misc_feature: GYAE6OF01DPT5R.16.68.G02.1.454.CMB.1.raw
  modified_base (104)..(104): a, c, t, g, unknown or other
  misc_feature (104)..(104): n is a, c, g, or t
  modified_base (209)..(209): a, c, t, g, unknown or other
  misc_feature (209)..(209): n is a, c, g, or t
tcagtgtactactccacgaccggtgctcgatttagtcgatagtgaagggaagggggcaggagtcagacccagtcaggacacagcatggacatgacgggtccccntcagctccgtggggctcctgctgctctggctcccaggtcgccagatgtgacatccagatcgacccagtcctcccttccacccttgtctcgcatcgtaggtagganacagacgtccaactatctaccggttcggcccgggtacaggtacaagtaattaagtttaagttagggttcggtttacggccgttagtactcgaacgacgaaacggaaaccgagggaaaccgtccccgttaaggtcctagtaattactagtacgtaacgttactttacgtttaacgttaaggtaacgggttccgggtaaaccctagttacgtaacggttccgaggtcggtacgttaggtagtacgtcggtagggaactaggtacttcgactctacgacttacctaccacgtactccgtacacgtaacctgtaactagttatttacgaactttaacttacgtactacgtaacctaacttaagtacttactaacgtttacctaacgtttacgttaagttttacggtttaaacggtttccggggtaaacgggttaaccggtaacgggtaaggggttaccgggtaaacggtaaccggtaaacggtaaacgggttcggtacggaacccgtacggtaacctacggttactttcgttaacctcgtttaaccccg

SEQ ID NO: 195891 - DNA, 843 bp, Homo sapiens
  misc_feature: GYAE6OF01D9OC0.16.68.G02.1.454.CMB.1.raw
  modified_base (686)..(686): a, c, t, g, unknown or other
  misc_feature (686)..(686): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagatgggtcctgtcccaggagcaactgcaggagtccgggcccaggactgggtgaacgtccgttcggacgtaccctgtccctcacctgacactgtcctcgtggtcgccttccttcacgctagtttactacgtgggacgtcgtggtactcccgtcgaacgccgtacccggaaggggaacgggtacgtagggacgttagggatttacggaccgttacgttacttccgttacttacggaacgggtgggagtaccgaacgtaccaaaccgttaccccgtaaccccctccgttaacgaacgtcgtacgtacgtacgaaccgtaagtttagttaacggtaacgtacctaaccggtaaccaaacggttaacccttacgttttaccggtaggtacgtacggtaggtacgtacggttcggtaacgtacccggtcgtaccgggacccgttaaccgtcccgggtttaacccctttgttaaccggttcgggtacggtccccgggtacggggtacccgggttaccccgttaaggtaccgggttagtacgtttacccggttanacccgggtaaccgttcccggttaacgttcccgtttaccggaccggttcccggggtaccggggtacccgtaaacccgggttcccggtaaccgggtcccgttaaaccccggttccctacccgggtaacctcccggtccccgtaaccccggtaaccccgg

SEQ ID NO: 195892 - DNA, 737 bp, Homo sapiens
  misc_feature: GYAE6OF01BI57Q.16.68.G02.1.454.CMB.1.raw
tcagtgtactactccacgaccggtgctcgatttagtcgatagtgaagggaaagggggcaggagtcagacccagtcaggacacagcatggacatggacgggtccccgctcagctccgtggggcctcctgctgctctggctcccgaggtcgccagatgtgacatccagatcgaccctgtcctccttcccacccttgtcctgacctagttcgttaggtaacggacgacgacggtacgtacccacctacttaccgtaccgttccgggcccgggacctaaggtacaagttaattaacgttaaggtagggttcggttcggtccgtaggtactacgacggacgaaacgaaaccggaacgggaaccgtaccccgtaaggtacctagtattatagtacgtacgtaccttacgttaacgttaaggtaacggtcggtaccctagtacgtacgtacgacggtcggagtacgtaggtacgtacggtacgggaactacgttactaccgtacttaccgtactaacgtacctaccgacccgtacgccttaccgaaccttacgtacgttacgttaacgtttacttacgtaacctttaactttacgtaacctcgtaaactacgtactactacgtaacttacgtactttgtaactttacggttacggttacggaacggtacggtaacgtagggtacgacggtaacgtaacggtagttcggtcgacctacgtaccacgttcttcgtacttgtacccg

SEQ ID NO: 195893 - DNA, 806 bp, Homo sapiens
  misc_feature: GYAE6OF01CYVB2.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagatgggtcctgtcccaggagcaactgcaggagtcgggcccaggactggtgaagccgttcggagaccctgtccctcacctgcactgtctcgtggtgcttcctcagctagttacacgtggacgtctggactccgtcagcctaccggagggtaacggactgggagtaggatttcgaccttatacgtcttacttacgagggtggacgacgtaagacctaaaccgtaccctaacccccgttaccgtaacgaaacggtacgttaccggaagtacccggaacttaagttaacgtttaacggaacgaaccgtaccgttaaacccgaaacgtaaccctttacggtttttacccgagggtacggttcgtaagggtacggttcgttacgggtaccggtaccgtcggttacgggaccggtaaccgtaccggttaccttttaacgacgttcgggtacggaccggtaccgggtaaccgggtcccctaagggtccggtaaacggttccggtaaacgttacgtacggtaacccgttcccgttaacgggtttaccccgtttcggaacccgttacccggggtaccggggtacccggtaaaccgggttaccccggtccggttaccccgtaaccccgttcccttaacccgtccggtaacccgtccccgaaacccgttaaaccccggg

SEQ ID NO: 195894 - DNA, 697 bp, Homo sapiens
  misc_feature: GYAE6OF01DDXW1.16.68.G02.1.454.CMB.1.raw
  modified_base (335)..(335): a, c, t, g, unknown or other
  misc_feature (335)..(335): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagatgggtcctgtcccaggagcaactgcaggagtcgggccaggactggtgaagccttcggagaccctgtccctcacctgcctactgtctcgtggtggcttccttcagctaagttacacgtggagctggactccgtcagcctacccgaaggggaacggctggagtggattcgccttaatatctctacgaggtgggacncgaacgacctaaaacctacccaaaccccccttcctacgaaacgtcggtacgacgtacgaacctaatttaagtttacgagtaacccacgtaaccaaacgtaaccctttagtttcccgagtacggtctaggtacggttctacggtccgaccggtcgtcggaccggtacgaccgttaccctttagtaccgttggtcggcgtccggtacggtcccctagtacggagttacgtacttagtacgtacctacccggtacgttcccgttacgtcccgttccgggtccgggacccggtaccgggtaacccggttccggtacccgaccgttcccgtaccctcccgaaccgtccccgacccgtaaaccccggg

SEQ ID NO: 195895 - DNA, 817 bp, Homo sapiens
  misc_feature: GYAE6OF01D32ON.16.68.G02.1.454.CMB.1.raw
  modified_base (105)..(105): a, c, t, g, unknown or other
  misc_feature (105)..(105): n is a, c, g, or t
  modified_base (144)..(144): a, c, t, g, unknown or other
  misc_feature (144)..(144): n is a, c, g, or t
tcagtgtactactccacgaccggtgctcgatttagtcgatagtgaagggaaagggggcaggagtcagacccagtcaggacacagcatggacatgagggtccccgntcagctccgtggggctcctgctgctctggctcccaggtnccagatgtgacatccagatcggaccctagtccttccttaccaccctgtctgctatcgtagtaggacgacagacgtccacctatctaccgttcggcccggggaccaggttacaaacgtaatttaacgttaaggttaggggttcgggtttacggacccgttagggttactaccgaacggaccgtaaaacggaaaaccccgaaagggggtaaacccctaccccccggtttaaagggtttccccaaggtaacttaagtaacgttggtaaccttacctttacgttaaacgtttaaggaaaccggggttcgggtacccctaagttaccgtaagggttccaacgggaccgtacggtaagggttacggtacgttaccggtagggaaacctaagttaaaccgtttccgaacgttacctagtaaccctacgtacccgaacccgtacgtccgtacgaactaacccgttgaacgttagtaaccgttttacgactttaacttaacttacgtaacctacctaactagtactaccgtatactacgttacttaacgtttacggttaacgttcgggtaacgggaacgggtaaccggaagggttaacggaacggtaaccgtaacggtaacggttacggtaccggtacgtacgtaaccgtacccgttacgtacctttcggttcccttaaccg

SEQ ID NO: 195896 - DNA, 747 bp, Homo sapiens
  misc_feature: GYAE6OF01AXA05.16.68.G02.1.454.CMB.1.raw
  modified_base (213)..(213): a, c, t, g, unknown or other
  misc_feature (213)..(213): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacagtccagatcgacccagttcctaccttccaccctgtctgcatctgagagacagatcaccntcacgttcgccggcctagtcaagtaattagttaagtaggttggttcggtccgttggttactcgacgacgaaacggaaaccgaacgggtaaaccgtacccccgttaagggtcctagtaacttagtatacggagtaaccttttccttaaagttaagtaaacgggttcgggtaaccctaagtacgtaacggttcgaacggtccggacgtagggtcgaacgttcggtacggaacgtaacgttaccgttaccgtaacctttcgtaacctaacgttaacctacccgtaacctaccggtccgtaccgtacccgtaaaccgttagtacgttagtttaacctttagtaccctttaaacgtttactttacgacctaaccgtaatacgttaactactacttacctaacgttactagttttaacgtttaacggttacgggtaacgggtaacgggtaaccggtaaccgggttggaaacggtaacctaaacgggtacttggaccgttacgtccgaacctacggtaacttcgggtttctccgtttaacg

SEQ ID NO: 195897 - DNA, 685 bp, Homo sapiens
  misc_feature: GYAE6OF01CFSCY.16.68.G02.1.454.CMB.1.raw
  modified_base (105)..(105): a, c, t, g, unknown or other
  misc_feature (105)..(105): n is a, c, g, or t
  modified_base (197)..(197): a, c, t, g, unknown or other
  misc_feature (197)..(197): n is a, c, g, or t
tcagtgtactactccacgaccggtgctcgatttagtcgatagtgaaggggaaagggggcaggagtcagacccagtcaggacacagcatggacatgagggtccccnctcagctcctggggctcctgctgctctggctcccaggtgccagatgtgacatccagatcgaccagtctcctccacctgtctgcatctgaganacagagtcacatcacgttcggccggcagacagaatataagtaggtggtggcctggtatcagacaacgaaaccgagggtaacaccccgtaaggtccagtaatatatagacgtacttacgttaactttaggaaacggttcgggtaccctagttacgtaaggttacgacggtcggactaggtggtactcggtaggggaactacgtaaacgttacctacgtaccttaccaacttaactcccaaccgtaccggtaccccttacgaacccctaaaccgttggtaaactttacggtttacttttacgtaacctttaaactttaacgtttaccgtaccgtaacctaaagttacgtaacgtctaacttactacttaagtttaagtttaacggtttaggtttaccggaggggtaaccgggtaagaaggggtacggtaaacggtaaaccgtaaggaacggttggacgtcgtactacgtacgtacttggtacttctaccg

SEQ ID NO: 195898 - DNA, 768 bp, Homo sapiens
  misc_feature: GYAE6OF01BM7Q5.16.68.G02.1.454.CMB.1.raw
  modified_base (105)..(105): a, c, t, g, unknown or other
  misc_feature (105)..(105): n is a, c, g, or t
  modified_base (209)..(209): a, c, t, g, unknown or other
  misc_feature (209)..(209): n is a, c, g, or t
tcagtgtactactccacgaccggtgctcgatttagtcgatagtgaagggaaagggggcaggagtcagacccagtcaggacacagcatggacatgagggtccccgntcagctcctggggctcctgctgctctggctccaggtgccagatgtgacatccagatcgacccagttcctcccgttccacccttgtctgacattcgtgtaagganactaggactcacctatcaacgttcggaccgggctaagttacgaagtaaattagttaaagttagggttcggtttacggtaccttaggtatacgaacgacgaaacggtaaaaccggaacgggtaaaccgtacccccggttaaagggttcctaaggtacttaagttagtaggtaacgttacctttacggttaaacgtttaacggtaaacgggttccgggtaaccctaagttaacccggtaaggttaccgaaggacccgggtaagtacgggttaggtacgttacggaacgggtaaccgaataccgtttactaacttcctactatactaccacctacggcttacggacttaacctaggtataacgtttattacgtaaccttaacttaagttaccagtaacctaagtaacgtaacttactaactcgttaactacgtttaagttacgttaacggttacggtacgggtaacggtaacggtaacggtagggtaacggtaaacccgtaaaggtacggtggttaacgggaccctaaggaacctacgtaatttccgtacgtttacggtacc

SEQ ID NO: 195899 - DNA, 703 bp, Homo sapiens
  misc_feature: GYAE6OF01BYV35.16.68.G02.1.454.CMB.1.raw
  modified_base (105)..(105): a, c, t, g, unknown or other
  misc_feature (105)..(105): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (688)..(688): a, c, t, g, unknown or other
  misc_feature (688)..(688): n is a, c, g, or t
tcagtgtactactccacgaccggtgctcgatttagtcgatagtgaagggaaagggggcaggagtcagacccagtcaggacacagcatggacatgagggtccccgntcagctcctgggctcctgctgctcgtggctcccgaggtcgccagattgtgactagtccagatcgacccagttccttcccttccacccttgtctcgctatcctaggtaggacanagagtccaccntcgtacgtcggcccggacagtacgaatactaagttagtaggtcggttcgtccgttgtacncgacgtaacgaacgaaaccggaagggaaaccgtaccccgttaagggtaccttaggtaactttacgtaagttacgtacgttacgtttaccgttaagtttaacgggtaaacggttccgggtaccacgttacgtaaggttccgacggtcgacggtagtacggtacgtcggtaacgggaactagtaaccgttactacgtttaccaacgtttaccgtactaccgtacccgacgtaccgtacgaaccgtaccgtatacgttacttacttacgtaacttaacgtttacgtactacgactatacgtactgaactctacttagttattacggttacgttcggtaaggtacgtaaggtacggtaggtaaccgtacgtaaagttcggtacgtcgtacgtacgtactactnttcgtacctcgttac

SEQ ID NO: 195900 - DNA, 722 bp, Homo sapiens
  misc_feature: GYAE6OF01C8I64.16.68.G02.1.454.CMB.1.raw
  modified_base (107)..(107): a, c, t, g, unknown or other
  misc_feature (107)..(107): n is a, c, g, or t
  modified_base (155)..(155): a, c, t, g, unknown or other
  misc_feature (155)..(155): n is a, c, g, or t
  modified_base (198)..(198): a, c, t, g, unknown or other
  misc_feature (198)..(198): n is a, c, g, or t
tcagtgtactactccacgaccggtgctcgatttagtcgatagtgaagggaaagggggcaggagtcagacccagtcaggacacagcagtggacatggacgggtccccntcagctcgtgggctcctgctgctgtgcctccaggtcacagatcggtanaacactccagtatcgacctagtcctccttaccaccgttgtctnctattcgaggtaggagaccgaagcgtacacctatctacggtccggccggactaagctaagtaaatttagttaaggtacgggttcggtaggtccgtaggtactacgacgtacgaaacggaaaccggaacggggtaaacctaccccggttaaggtaccgtaagtaactagtacgttaggaactttaacggtttccttaaagggttaacgtaaacgggtccggtacctaagtaacggtacggtcgaacggtcggagttaggactttccggtaggtaacggaactaacgtactacgtacgttactacgaaccttcgtacaccgtacgtcctaacgtaccgtaaagttctaagttacgtttagtaaccttaacttaactactactacgaactaaggtaataccgtataacgttcaacgttagtacgttaggtttacgttaggggaaccgttaagggaaacggtcggtaaacggacgtaagtaacgtacgtgtacggtactacgacttaatgttaccttagtcttaaccg

SEQ ID NO: 195901 - DNA, 752 bp, Homo sapiens
  misc_feature: GYAE6OF01DGKGK.16.68.G02.1.454.CMB.1.raw
  modified_base (208)..(208): a, c, t, g, unknown or other
  misc_feature (208)..(208): n is a, c, g, or t
tcagtgtactactccacgaccggtgctcgatttagtcgatagtgaagggaaagggggcaggagtcagacccagtcaggacacagcatggacatgagggtccccgctcagctccgtggggcctcctgctgctcgtggcctcccaggtgccagatgtgacactccagatgacccagtcctccttcccaccctgtctgctatctggagganacagacgtaccaacctatacctacgtcgggcccgggctaaggtaccaagtaattaattaagttagggttggttcgtccgttaggtatcgagacgaaacgaaaaccggaacgggaaaccgtaccccggtaaggtccgtagtaatataagtggtaacgtactttacggtttaacgtttaaaggaaacgggttaccgggtacctaacgttacgtaacggttaccgaggtccggtacgtaagggttggtacgttcggtacgggtaacctaagtacgttacctaacgttaccgttactaaccttactacccgaaccccgtacggttaccctacggtaaccctaaccgttagtacggtttacttacgttttacgaacctttaactttaacgttaccgtaacaaccgtaagttactacgttactacttactaagttcttaaggtttagttacgggtttcgggtaaggggtacgggtacggtaaagggttaggtaacggtaacgtaagttacggtgcgtacgtactacctactacgttcttacgtcttaccg

SEQ ID NO: 195902 - DNA, 847 bp, Homo sapiens
  misc_feature: GYAE6OF01B3J3H.16.68.G02.1.454.CMB.1.raw
  modified_base (105)..(105): a, c, t, g, unknown or other
  misc_feature (105)..(105): n is a, c, g, or t
tcagtgtactactccacgaccggtgctcgatttagtcgatagtgaagggaaagggggcaggagtcagacccagtcaggacacagcatggacatgagggtccccgntcagctcctgggctcctgctgctctggctcccagtgcctagatgtgacatccagatgacccagtctccttcaccctgtctcgcattctggtacggacgacagacgtccaaccgtattccaacgtttcggacccgggacctaagttccgaaaggttaaattaacgtttaaacggttaggttaggttcggcccgttaggtacttacgaaggtccaaaaggaaaacccgaaggggtaaaacccgacccccttaagggtaccctaggtaaacttaacgtacgtttacggaacggttaacctttacgtttaaaccgtttaagggtaaaacggttccggggtaccccaagttacccggaaaaggttttccgaacggccggggtactaacgggtacgggtactttaccggtaggggtaaccctaagggttaaacccgtttcaaccgttttaccggtaaaccgttacttaaaccggtttaccccaacccgtaaacggtccccgtttaggaaacccgtaacccgtttaggtaacgtttaccgggttaaactttttaccggaacctttaaaaccggtttacttaacttaaccggacctaaacgttacgttaatcctaaagttcctaagttctaaggtttcgttaaaccgtttggacgggtacggtaaactaggggtccgaaaggtcccgtaaaaggaacgttttcgggagtacccgttcgaaccgttaccaagtttcgtgttaacccttccg

SEQ ID NO: 195903 - DNA, 1012 bp, Homo sapiens
  misc_feature: GYAE6OF01EB7PH.16.68.G02.1.454.CMB.1.raw
  modified_base (108)..(108): a, c, t, g, unknown or other
  misc_feature (108)..(108): n is a, c, g, or t
  modified_base (150)..(150): a, c, t, g, unknown or other
  misc_feature (150)..(150): n is a, c, g, or t
tcagtgtactactccacgaccggtgctcgatttagtcgatagtgaagggaaagggggcaggagtcagacccagtcaggacacagcagtggacatggacgggtccccgntcagctccgtgggcctcctgctgctctcggcctcccaggtcncagtactgtacgacactccgagacgtccgaccctagttcccttcccttacccaccttgtctcgacctagttcggtaggaacggacctagaaggttacctacccgtaaaccctagtttaccccgtaccggttccgggggacccccggtaaccgttaaggtaaccggtaaaaaggttttaaaacttttaaagggttttaaacggggttaggggtttacggggttaccggttacccggtttaagggtaaccgttaccggaaacgggaaacccgaaaacgggtaaaaaccccgggtaaaacggggtaaacccccgtttaaccccccggtttaaacggtaaccgtttaagtaaatttaacgttaacggttaccggtaaaaccgttttaaccttttaacggtttaaaacggttttaaaggtaaaccccggggttacggtttaaccccgtaacggtaaccgggttaccgtacggaaccggttaccgggtacggtttacgggtaagtcgggtttaaccggaacgggttaaactacgggtttaaaccctcgtaaacccttacccttaacgttaccttaacgtaacccaaccggttacccgtaccttaccgaacccgttacggttaacgtaacgtttaccgtttaacgtttaaccggtaacctttaaacgtttacctaaccggtaccgtaaacccgtataccgttactaaccgtaactacgttcgttaaacgtttacgttacgtttaacgggtacgggttaaccgggaaacggttacggacgggttaaacggaacgttaaacggtaaacttcgggtcgttacgtacccggttaacgtcctaaccgttccgttacgttccgttcgttaacccg

SEQ ID NO: 195904 - DNA, 904 bp, Homo sapiens
  misc_feature: GYAE6OF01EQGLR.16.68.G02.1.454.CMB.1.raw
  modified_base (104)..(104): a, c, t, g, unknown or other
  misc_feature (104)..(104): n is a, c, g, or t
  modified_base (173)..(173): a, c, t, g, unknown or other
  misc_feature (173)..(173): n is a, c, g, or t
  modified_base (206)..(206): a, c, t, g, unknown or other
  misc_feature (206)..(206): n is a, c, g, or t
tcagtgtactactccacgaccggtgctcgatttagtcgatagtgaagggaaagggggcaggagtcagacccagtcaggacacagcatggacatgagggtccccntcagctccgtgggcctcctgctgctcgtggcctcccgaggtcaccagtatgtgacatccagatcgaccngtcctcctccacctgtctgcatcgtggtagganacgagtacgtccacctatcctacgtcggcccggcagtcaagtaactagttaacgtaggtggttacgtccgttaggtactcgtaacgacgaaacggaaaccggaagggaaccctacccggtaaacggtccgtaggaattacgtagtcggtaacttacctttaccgttaacgtttaaagggaacgggttccgggtacccttaagtaccgtaacgggtcgaacggcgggtacgtaggttacgggtacgtttacgggacgggaacttaagttaccgttactaccttaccgtaccgtaactttaccgacccgaaaccctcggtaccgttacctaacccggtaagttccgtaacgtttaggttttaacccgttagttaaccctttaaacgttttaacgttaccgtaaccgtaacccgttaaacgtaacgtttacgtaccttaacgttacccgttaaatttacccggtttaacggtttttacggttttaaaacgggggtttccggggttaaacgggggaaaacccggttaacggggttaaacccgggggtttaaacgggtaaaccggggttaaaaccccgttaaaaacggggttaccggggttttccggttaaccgggtaaacccgggtttaccgtaaacccccgtttaaccggttaaccgttttacccggttttaccccggttttccttttaaaaccccccggg

SEQ ID NO: 195905 - DNA, 841 bp, Homo sapiens
  misc_feature: GYAE6OF01CQVUQ.16.68.G02.1.454.CMB.1.raw
  modified_base (420)..(420): a, c, t, g, unknown or other
  misc_feature (420)..(420): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagagtgggtcctgtcccgaggagcaacgtgacgaggacgtccgggcccaaggactggtagaacgtccgttacggacacccgtcgtcccctacaccgtcgctacgtcgtcttcgtggtacgtccttccttcgacgcttaacgtttacctaaggtggacgtcgttcggtaccttaccggtcgaacggtccgtaacccgggaagggggtaacgggtacggttagggtaggttacggtacgtttaccggtacctttaatttaccgttaccgtttacggtttaacgnggggttacgggataccgaacggtaaccctaaaaccccgtaaccccgtaacccccttaccggaagtaaaccggtaacggttaccgtaaccgtaacgtaacgtaacgtttaaagttaacggaaacgaacccgttaaccgtaaaccctaaagttaacccgtttacgtttaccgaggtacggtcgttaggtacgttcgcgtagccgtaggcgacgtacgtcggttacttgacgtgtaccgacggtaccggccgttaccgtagtccgtagtaacgtacgttactaccggtaccctaccgggttacttcccggttacgacccggtttaccggggaccgggtaacccgtaaccgggtcccgtttccgggtaacccctccggttaccctaccctaccgtacccctaccccgggttaacccgaacccggg
